United States Patent 6,812,339 (POLYMORPHISMS IN KNOWN GENES ASSOCIATED WITH HUMAN DISEASE, METHODS OF DETECTION AND USES THEREOF) - sequence listing, part 106

SEQ ID NO: 170460 - DNA, 601 bp, Human
gtaaaaagaacataggataaatccaagaggtccaatacttaaaagagtctgagtaagggaattaaatgatcaaagtaaatagttttggtttgtacctatacagtcaggttatatacatctatataatgaaatactatacagctatttacttaaaagtttttttctttaaagatggggtcttaacccgtcacccccgctggaacacagtcacaactcagtgcagccttgaaatcttgggctcaactgatcctcctgcctcagcttcctgagcagctggcactacaaacaccagccaccatgsccagctgtacagctattttaaaaaaagacctacatatgctgaaatggaacaataaaaaataaaaaaatgattttaaaaacagcacatgaaatacactaccgcacacccacagggttacttcttgaaagacgcccaagaaactgctaactgactgcctctggcaaagggcattaggggtttagaacagtacgagatttttgtattttcaccacattctttggaatttttttttttacgtgaagggcaaacattcttgaaaaactttttgttaaagaaccataaagcatggatttcagaaga

SEQ ID NO: 170461 - DNA, 601 bp, Human
ctgagttgttaaaaagtacaagagctaatccaaccagatggagttcaaagacagtaattcagcttgcccaggcctgtttgcgattggtttggaagcacatagagtcaaatatgacacgtatccatggctacactgatcatatttcttggacattcctgttgataatttttggtcccatcatctctgtattttggtttgcaagtttagatcactgtacacttcttatccaagaaaccagtgctgtatattcaagttaggttctgtacattccaaggcaccctaatcaagagaaggtcaccgwgcacgtggaattgtgctgcacttcactaaaggaaagactcaagctgtcaccaaggtagcagttcccaaacctacttcatcagagacctccctttaattaaaggggaagacatttaatctcagacaaataaaaataagacaacagtgttctgaataaaccatctggagaaactagtatctttgatgttagcaagccaaaataaaatctcttttcattctagcatttgggaaacccgtgtatccccgaggcaagcctgcaatctgggagagaagccctgcctgggtccagtgagtcagcatt

SEQ ID NO: 170462 - DNA, 601 bp, Human; identical to SEQ ID NO: 26244

SEQ ID NO: 170463 - DNA, 601 bp, Human; identical to SEQ ID NO: 26245

SEQ ID NO: 170464 - DNA, 601 bp, Human; identical to SEQ ID NO: 26246

SEQ ID NO: 170465 - DNA, 601 bp, Human
ataaagtagattgggaagtttgggaccagtggtggaatagggaagggatcaatcttatctcattgcagccacagaacacactgcaaattagcagctgcctctaccttcataagcctcccttcccctgctgctctcctcactcacatctgcatcaacccaggtctcagggtcttcattaaagtagtagcagtaggagcgataggcattggtgccttctgggcagctgattcggggattaggcagctctgtctgggactcctggcctggggaaaaaaaaaaggagataattaagaaagaatckcagggcaaggaaaaggctggaaggtgaattaggggcttcttggtgtcctttataagaacatatggatacagtgaatactggggcgattgctcacttctgccctcctgcatcctatctcttttctctctagtttcctctgctcaagacaagagctcacaatgaataggctaaataaatgagtcctcgttttcctttaattctgaggctgaggcttctgcctttaaagacccaggcttcctcctttctcaagtttctctcggtttccctgcacacgtttgccttagctctccatcctagcaa

SEQ ID NO: 170466 - DNA, 601 bp, Human
atccagacattgctgtcatcagtgctactctccttaatcagtgaggccacgaaggcaccctccgcctgggtgagcacagacaccaggttgcctgaattcatgttctggcaatagagctgttggagaagaaaatggagcactcagtggagaaggaaggtgtgagggatatactgagaccttccagaggatgtaacagaaaaaggacagcacagaaatgtccctgatgatgctgtcactgaccaccagcatctctgtgctgggaatgtgtcaaatgatgggataaagtagattgggaagtttkggaccagtggtggaatagggaagggatcaatcttatctcattgcagccacagaacacactgcaaattagcagctgcctctaccttcataagcctcccttcccctgctgctctcctcactcacatctgcatcaacccaggtctcagggtcttcattaaagtagtagcagtaggagcgataggcattggtgccttctgggcagctgattcggggattaggcagctctgtctgggactcctggcctggggaaaaaaaaaaggagataattaagaaagaatcgcagggcaaggaaaaggctgga

SEQ ID NO: 170467 - DNA, 601 bp, Human
atgggctgtagaaagagcaaatgcagaagacagaacactggataaaaataagtttgtttttatttttcagggctctagagactgagacaggtgaaggtactgaagatcagcgatgcaaactcattagggaggagatggtctgaactgagttggagacatagtctagtttaatttttgacttcatagtaattgcaggaccagttctagacatccatttttcagcttcctctagtttttgaacttgcaaacaaaggagaacttcttctcacaagattcatccttccatttcttgaatcctatrgtacaatgagaagtgtcagacatagaggatcagaaggagtgtagcccctcctcaacctaggactcagaacaaaaaactagaggaaatacttctttattttccagataaggagcttacctttcctctatcccagtccccatgttcatccccagagataagtgggaaggaaatggcaacaggtggatagattgtctgcctctcacctgagcatgaagtcaggcttgcacagtagccagcattagcactgctcggggatccagtgtcccaggacttgtaggagaccagggacccactactcca

SEQ ID NO: 170468 - DNA, 601 bp, Human
agaaaggaccaactcttgattatacggggtgcctggggagtgcagtcgtttgacacgtgtctgggtcaggtcccagctcccattctcaatcaacagttttgctgtcatccgcatcacacattagagcataaaataaacttttatttgtcaaaagtgttctgcataaatgcttaaacaaaatgtggtatagccatacaactgaatattatttggtcataaaaggaatgaaatcctgattcatgctacaacatggatgaactgtgaaaacatgctaagtgaaagaagcctgacacaaaaggcsgcatatcatatgtttccatctgaatatacgaaatagtcattaaaggcaaatctagaaagacaaagtagatgaaaggttgcctgtggcggggcctggaaatgggcattgactacaactgggcatcagaggtcttggggtaacggaaatgttctaaaagtggatttggtggtggctgtgctgctgtaaatttactaaaaaccactgaatagtacacttaaaacaggtggattttatggtatgtaaattctacttcaatgaagctcttacattaaaaaataagtataaataataaaagcggat

SEQ ID NO: 170469 - DNA, 601 bp, Human
caggtggcctgtagaaactgaaaaacaaaaggaaactgattctctccacagagcctccagacggagacaaccctgctgaaactttgacttgagctcagtgaggcggattctggacttctgatatccagaactgtgagacagtaaattcatgttgttctaggccactgtttgtggtcatttgttacaatagaaatatggggaaatgctaatgaaatgttaagtaaaacagttcatgcaccacataatccaaatttttacatttcaattttaaaatgtgtctatgagcaaaaaaaaaaaaaaatgcagctgggtgcggtggctcattcctgtaatcccagcactttgggaagccaaggcaggcggatcacttgaggccaggagttcaagaccagcctggccaacatagcaaaaccctgtctctactaaaaatacaaaaaattagctgtgcatggtgacacatgcctgtaatcccagctactcaggaggctgaggcaggagaatcgcttgaaccaaggaggtggaggttgcagtgggcggagataaagccactgcattccagcctgggcaatggagagactgtctcaaatggaaacaatgacaa

SEQ ID NO: 170470 - DNA, 601 bp, Human
cagtgagccaagactgtgccactgcactccagcctgggcaacagagagagactccatctcaaaaaaaaaaaagaaaaaagaaagcaatcaagaggttgagataatttgaggaagaagtcaggagccaaggaacgcaggtggcctgtagaaactgaaaaacaaaaggaaactgattctctccacagagcctccagacggagacaaccctgctgaaactttgacttgagctcagtgaggcggattctggacttctgatatccagaactgtgagacagtaaattcatgttgttctaggccactrtttgtggtcatttgttacaatagaaatatggggaaatgctaatgaaatgttaagtaaaacagttcatgcaccacataatccaaatttttacatttcaattttaaaatgtgtctatgagcaaaaaaaaaaaaaaatgcagctgggtgcggtggctcattcctgtaatcccagcactttgggaagccaaggcaggcggatcacttgaggccaggagttcaagaccagcctggccaacatagcaaaaccctgtctctactaaaaatacaaaaaattagctgtgcatggtgacacatgcctgta

SEQ ID NO: 170471 - DNA, 601 bp, Human
tgcataaacaaggagactggctcaataattatggtcggtgcacaccacagaacgccacgcagcaatttcaaatgctcctcctgcagtaggctgaaaaatggtccccacaaagatgctcacatcctcattcctagaacctgggaatgttactttacacacaaaagcatacaggccaaagggactttgcagctgtgactaaatgaaggcactgagacagtatcctcggtgatccaggtgggccaggtgtcatcacaagggtgtctataagagagaggcaggagatgacaacaggtagtaatasatgtgatgatgaaagcaacaggctggctgggcacagtggctcacgcctgtaatcccagcactgtgggaggccaagtcgggcagatcacctgaggtcaggcgttcgagaccagcctggccaacatggtgaaaccccgtctctacaaaaaatacaaaaattagctaggtaatggtggtgggtgcctgtaatcctagctacccggaaggctgaggcaggagaatcacttgaacccgggaggcagaggttgcagtgagccaagactgtgccactgcactccagcctgggcaacagagagagact

SEQ ID NO: 170472 - DNA, 601 bp, Human
gaaaagctggagaccatctgaatgtgcataaacaaggagactggctcaataattatggtcggtgcacaccacagaacgccacgcagcaatttcaaatgctcctcctgcagtaggctgaaaaatggtccccacaaagatgctcacatcctcattcctagaacctgggaatgttactttacacacaaaagcatacaggccaaagggactttgcagctgtgactaaatgaaggcactgagacagtatcctcggtgatccaggtgggccaggtgtcatcacaagggtgtctataagagagaggcmggagatgacaacaggtagtaatagatgtgatgatgaaagcaacaggctggctgggcacagtggctcacgcctgtaatcccagcactgtgggaggccaagtcgggcagatcacctgaggtcaggcgttcgagaccagcctggccaacatggtgaaaccccgtctctacaaaaaatacaaaaattagctaggtaatggtggtgggtgcctgtaatcctagctacccggaaggctgaggcaggagaatcacttgaacccgggaggcagaggttgcagtgagccaagactgtgccactgcactc

SEQ ID NO: 170473 - DNA, 601 bp, Human
gcaggaaaagctggagaccatctgaatgtgcataaacaaggagactggctcaataattatggtcggtgcacaccacagaacgccacgcagcaatttcaaatgctcctcctgcagtaggctgaaaaatggtccccacaaagatgctcacatcctcattcctagaacctgggaatgttactttacacacaaaagcatacaggccaaagggactttgcagctgtgactaaatgaaggcactgagacagtatcctcggtgatccaggtgggccaggtgtcatcacaagggtgtctataagagagaggcaggagatgacaacaggtagtaatagatgtgatgatgaaagcaacaggctggctgggcacagtggctcacgcctgtaatcccagcactgtgggaggccaagtcgggcagatcacctgaggtcaggcgttcgagaccagcctggccaacatggtgaaaccccgtctctacaaaaaatacaaaaattagctaggtaatggtggtgggtgcctgtaatcctagctacccggaaggctgaggcaggagaatcacttgaacccgggaggcagaggttgcagtgagccaagactgtgccactgc

SEQ ID NO: 170474 - DNA, 601 bp, Human
tatgagcaggaaaagctggagaccatctgaatgtgcataaacaaggagactggctcaataattatggtcggtgcacaccacagaacgccacgcagcaatttcaaatgctcctcctgcagtaggctgaaaaatggtccccacaaagatgctcacatcctcattcctagaacctgggaatgttactttacacacaaaagcatacaggccaaagggactttgcagctgtgactaaatgaaggcactgagacagtatcctcggtgatccaggtgggccaggtgtcatcacaagggtgtctataaragagaggcaggagatgacaacaggtagtaatagatgtgatgatgaaagcaacaggctggctgggcacagtggctcacgcctgtaatcccagcactgtgggaggccaagtcgggcagatcacctgaggtcaggcgttcgagaccagcctggccaacatggtgaaaccccgtctctacaaaaaatacaaaaattagctaggtaatggtggtgggtgcctgtaatcctagctacccggaaggctgaggcaggagaatcacttgaacccgggaggcagaggttgcagtgagccaagactgtgcc

SEQ ID NO: 170475 - DNA, 601 bp, Human
acaccagcaagtagaacagctgggctgagaactcaggtggtcagcctggctccagaggccacactcttcagaggcaggtcgcctgctttcctaaaatctcccctagggattcaatccaagaagtatgaatctggaagcacataaggctttatgtccaaagatacacactgcaagattatgagcaggaaaagctggagaccatctgaatgtgcataaacaaggagactggctcaataattatggtcggtgcacaccacagaacgccacgcagcaatttcaaatgctcctcctgcagtaggckgaaaaatggtccccacaaagatgctcacatcctcattcctagaacctgggaatgttactttacacacaaaagcatacaggccaaagggactttgcagctgtgactaaatgaaggcactgagacagtatcctcggtgatccaggtgggccaggtgtcatcacaagggtgtctataagagagaggcaggagatgacaacaggtagtaatagatgtgatgatgaaagcaacaggctggctgggcacagtggctcacgcctgtaatcccagcactgtgggaggccaagtcgggcagatcacctg

SEQ ID NO: 170476 - DNA, 601 bp, Human
cacatatgtattaaaacgcttaaaaatgaacattaaaaacttttcgtctaacaaatccaaaataagaaaaacactcactgagcatttatgatgtagcaggtgccattctaagtagtctgcaaatattaactaatttaatcctcccaacaacccgttactacccccactttcagatgagaactgagacccagagtagctaagcaacttgcctggggccacaacaccagcaagtagaacagctgggctgagaactcaggtggtcagcctggctccagaggccacactcttcagaggcaggtcrcctgctttcctaaaatctcccctagggattcaatccaagaagtatgaatctggaagcacataaggctttatgtccaaagatacacactgcaagattatgagcaggaaaagctggagaccatctgaatgtgcataaacaaggagactggctcaataattatggtcggtgcacaccacagaacgccacgcagcaatttcaaatgctcctcctgcagtaggctgaaaaatggtccccacaaagatgctcacatcctcattcctagaacctgggaatgttactttacacacaaaagcatacagg

SEQ ID NO: 170477 - DNA, 601 bp, Human
tcctaagcaccaaggtaatgaaaggcaagaatgactgagctactgccccagattgaaggagactccagagtcagtgcaactcatgaatccaaactggatccatctgctgtaacaggcactcagggacaactggcaaaacccaagtaagcctgcccgtggatcagatggtagtgatgtatcaagactaatttcctgattttgacaactgtgctgtgattatgtaagaaggtccttgcttggaaaatacacccactaaaacaccgggggataatggagtatcaggtctgcaatttactctcawatgctttagagaaaaaatggtttcatactgttcgtgcaaccttcctgttaggttcagcctgtttccaaaacaggcagaaaaaataagttctttatttaccctcacctgccaaggacgcatgaggctgggctattttaaatgtggtgacaggcacattctaagcctcttattcagattcagtcagtgctgatcactgcatacataaccagaccacacacgtcagacagatttacactcatcaattgttacgtagaaggacatccaaagatgggactgagctagttaaagggaaactaaaag

SEQ ID NO: 170478 - DNA, 601 bp, Human
ggacagtggcacaatcatggttcactgcagcctcaacctctgaggctcaagtgatcctcctacctcagcctaccaagttgcacggactacaatacggcactatgtccagctaattttttttttttttttttgtagagatgggggtctcaccttgttgcccaggctggtctcaaactcccaggctcaagatatcctcctgcctcagcctctcagagtgttgggattataggcatgagccactgtgtctggcctgggcctaaagagatcttgtccccacagactcactagacaagtcagtgasgctttgcaagcacagactgcactttccagggtctaatacatctattcagctgtgacgaatggtccctcctggttctcactatacaatgcaaacccgatgggcacacttcccaagatgggctcaccactgagaggtaagcagacaagcagcagcaggacaggcagacagagcatgcacacacagatacagacacacaaacctaaggaaaagcactgttttcttctttttagatggagtctcactttgctgcccaggctggagtgcaatggcacgacctctgctcactgcaacctccaactc

SEQ ID NO: 170479 - DNA, 601 bp, Human
atggcagagggactggggtccccaaggctgagcttattaccaacccccgaactcctgggcctattttttttttttttgagacagggtcccgcttggtcacccagggtggaggacagtggcacaatcatggttcactgcagcctcaacctctgaggctcaagtgatcctcctacctcagcctaccaagttgcacggactacaatacggcactatgtccagctaattttttttttttttttttgtagagatgggggtctcaccttgttgcccaggctggtctcaaactcccaggctcaagatrtcctcctgcctcagcctctcagagtgttgggattataggcatgagccactgtgtctggcctgggcctaaagagatcttgtccccacagactcactagacaagtcagtgacgctttgcaagcacagactgcactttccagggtctaatacatctattcagctgtgacgaatggtccctcctggttctcactatacaatgcaaacccgatgggcacacttcccaagatgggctcaccactgagaggtaagcagacaagcagcagcaggacaggcagacagagcatgcacacacagatacaga

SEQ ID NO: 170480 - DNA, 601 bp, Human
tatagtttcccaatcctagaataaggtggtttcaaaatataaatttcctttaaggaaaacaaaaatgccataacgggggcaagagaccagtaaatgatggcagagggactggggtccccaaggctgagcttattaccaacccccgaactcctgggcctattttttttttttttgagacagggtcccgcttggtcacccagggtggaggacagtggcacaatcatggttcactgcagcctcaacctctgaggctcaagtgatcctcctacctcagcctaccaagttgcacggactacaatasggcactatgtccagctaattttttttttttttttttgtagagatgggggtctcaccttgttgcccaggctggtctcaaactcccaggctcaagatatcctcctgcctcagcctctcagagtgttgggattataggcatgagccactgtgtctggcctgggcctaaagagatcttgtccccacagactcactagacaagtcagtgacgctttgcaagcacagactgcactttccagggtctaatacatctattcagctgtgacgaatggtccctcctggttctcactatacaatgcaaacc

SEQ ID NO: 170481 - DNA, 601 bp, Human
ccccttgctgtgtttggatctcgtggacttgcttgcgttcctaaaaggtgagctaaaatccaggctctatcaagactatttcaaaggatttatggctcaaaaaatatggcaacagatcctgaggtttctatagtttcccaatcctagaataaggtggtttcaaaatataaatttcctttaaggaaaacaaaaatgccataacgggggcaagagaccagtaaatgatggcagagggactggggtccccaaggctgagcttattaccaacccccgaactcctgggcctattttttttttttttgagacagggtcccgcttggtcacccagggtggaggacagtggcacaatcatggttcactgcagcctcaacctctgaggctcaagtgatcctcctacctcagcctaccaagttgcacggactacaatacggcactatgtccagctaattttttttttttttttttgtagagatgggggtctcaccttgttgcccaggctggtctcaaactcccaggctcaagatatcctcctgcctcagcctctcagagtgttgggattataggcatgagccactgtgtctggcctgggcctaaagagatc

SEQ ID NO: 170482 - DNA, 601 bp, Human
ctagtgagcgggtgagcctggccgccagactgtaccttaccaagcctgtcaactccagcccacctgctctagtcaccaagccaccagtggctggaaggaaggtgccttcaagtgtaaaaatcccatggggatgaatgataaggctggaaatgacagggacaaggacacacccccttgctgtgtttggatctcgtggacttgcttgcgttcctaaaaggtgagctaaaatccaggctctatcaagactatttcaaaggatttatggctcaaaaaatatggcaacagatcctgaggtttctayagtttcccaatcctagaataaggtggtttcaaaatataaatttcctttaaggaaaacaaaaatgccataacgggggcaagagaccagtaaatgatggcagagggactggggtccccaaggctgagcttattaccaacccccgaactcctgggcctattttttttttttttgagacagggtcccgcttggtcacccagggtggaggacagtggcacaatcatggttcactgcagcctcaacctctgaggctcaagtgatcctcctacctcagcctaccaagttgcacggactacaatacgg

SEQ ID NO: 170483 - DNA, 601 bp, Human
tcaaaggtaaagactcttaggtaagaaattttaacacagcccatgcagaagagatggctgatgttctcttacaacttaggcaggtacttgcctttaaaagaaatgaaaagaaaggatttggcggttttcaaatgaaaaaaaggccaggcgcggtggctcacacctgtaatcctgggtgtgattccactttaggaggctgaggccggcggatcacttgaggccaggagttagagaccagcctggccaacatggtgaaaccccatatctactaaaaaccaaccaaccgacccaaaaaaaaaaatacaaaaattagttgggcattgtggtgcatgcctgtaatcccaactactccggagggtgaggcaggataatcgtttgaacccaggaggcagaggttgcagtgagctgagattgggacactgcagcagtcccgcctgggtgacagcgagactctgtctcaaaaaaaaaaaataaataaatgaaaaaaactctctaaggtaatcagttcttccccaaattaaaaataataataaatgtggggtatgtggaaaacagagaaggcaattattatcataagacattttaccttaactcattcatt

SEQ ID NO: 170484 - DNA, 601 bp, Human
aagagccaaacagaaagatcagaaaagcagagggcacctaaagccaccctaacaggtttgacagaagtttgctcaggagtaagcccctacttcttagtttctttatgcttgatacatccagcaatggagtaccaaagaaaataatgacatgaagcatgtatctagcttaattaaagactactggccgaagaagataaaagccagtaataacagttctcatatcacagtaaatgaatatatatttaaaagatatttattaaatgcgtttctcactcaaggcaggctttttgttgttgttgttaaaaaggaaggaacaatcatttgagcccagaggtttgagaccagcctgggcaacgtggagaaacctcatctctacaaaaaaaacattaaaaattagctaggcatggtggcgcgcctatagtcccagctactcaggaagattgctttagcctggagggttgcagtgggccaagagtgcaccactacattccagcctgggtgacacagtgagactctctctccacttaaaaaacaaacaaacaaacaaaaaagcctcttaaaacttttctgcctcaagctaaagaatctatgacacatgtgg

SEQ ID NO: 170485 - DNA, 601 bp, Human
acaagcccatctctggcactggcactggcaactaaggggcgtggaactcatcagaaatgagtcaaagtttaaagcagttacatccacctcgacaagaacaacaataacaatgccaactgcaagagcaaaaacaaagagccaaacagaaagatcagaaaagcagagggcacctaaagccaccctaacaggtttgacagaagtttgctcaggagtaagcccctacttcttagtttctttatgcttgatacatccagcaatggagtaccaaagaaaataatgacatgaagcatgtatctagcttaattaaagactactggccgaagaagataaaagccagtaataacagttctcatatcacagtaaatgaatatatatttaaaagatatttattaaatgcgtttctcactcaaggcaggctttttgttgttgttgttaaaaaggaaggaacaatcatttgagcccagaggtttgagaccagcctgggcaacgtggagaaacctcatctctacaaaaaaaacattaaaaattagctaggcatggtggcgcgcctatagtcccagctactcaggaagattgctttagcctggagggttgcagtggg

SEQ ID NO: 170486 - DNA, 601 bp, Human
gcattctagcagccaaagagaagaaggcatcaggatgatcctttgttctgtttcagattctgtatttcctatcatttgcaactcaatccccagagcatttccccagttggcacttttacttcccacaaatttcatcaatttttcaggcaaaagcttggtataaagccttactttctgctgtaacattaatacctaacagcaaagtaatttccctatcagtgatatttaacaccttctttaagaaacactatgctttaatattacatagtttgaaatattttctaccaattctatgaaaagrgcataaaagggtttactgtcctgaaatttattttacctgaaacctcacacttaaagaaatgtaacctgctaaatgtgttataaaaccagattatctctttactggagtgacatgagaagacagtttgtgagggaaactactgctaaagaaaaatgtcacctgaatattaaattaagcatgcgcacagatatcttccaaaacatctgaattgtaagaaaaactgccattcttcacaatgaaaacagagcgatagtaaagaacaatgctggctgtagcataaccagaaaaacagttgcacag

SEQ ID NO: 170487 - DNA, 601 bp, Human
tcagccatcttacagtcttgcccaacataaataaaagttaaatcccatggccttttgtggttcagcctgaagagaggctttcatttctttctccgcttcttctccatcttggaaataaggcttctctcactcaggccgtgacgactgagtcctgtactccatttgtaccacagaaccaacgtccaatggggttgatcaatcaaccactgtgagccaatctatgaaacaaaaaacagtgcacacagacattagtagcaaactgacatagccaggtatgatttagttgtatttataatttaarcaagtgggtcagccaggcaaggtggcaggtgcctgtagatcagctgcttgggaggctgaggtgggaagatcacttgagcccaggagtctgagtccagcctgagcaacaaagtgagaccctatgtctaaaataataaaataataaaataaataagagggtaaaagagatatcctggttttaagacaaattaatgtgccatacaaccatgaaacatattatttcatttttatttacttattactcactgctttcacgggaaaattttttttaggcatcttcaaaaataaaacaataaaatca

SEQ ID NO: 170488 - DNA, 601 bp, Human; identical to SEQ ID NO: 28557

SEQ ID NO: 170489 - DNA, 601 bp, Human; identical to SEQ ID NO: 28558

SEQ ID NO: 170490 - DNA, 601 bp, Human; identical to SEQ ID NO: 28559

SEQ ID NO: 170491 - DNA, 601 bp, Human; identical to SEQ ID NO: 28560

SEQ ID NO: 170492 - DNA, 601 bp, Human; identical to SEQ ID NO: 28561

SEQ ID NO: 170493 - DNA, 601 bp, Human; identical to SEQ ID NO: 28562

SEQ ID NO: 170494 - DNA, 601 bp, Human; identical to SEQ ID NO: 28563

SEQ ID NO: 170495 - DNA, 601 bp, Human; identical to SEQ ID NO: 28564

SEQ ID NO: 170496 - DNA, 601 bp, Human; identical to SEQ ID NO: 28565

SEQ ID NO: 170497 - DNA, 601 bp, Human; identical to SEQ ID NO: 28566

SEQ ID NO: 170498 - DNA, 601 bp, Human; identical to SEQ ID NO: 28567

SEQ ID NO: 170499 - DNA, 601 bp, Human; identical to SEQ ID NO: 28568

SEQ ID NO: 170500 - DNA, 601 bp, Human; identical to SEQ ID NO: 28569

SEQ ID NO: 170501 - DNA, 601 bp, Human; identical to SEQ ID NO: 28570

SEQ ID NO: 170502 - DNA, 601 bp, Human; identical to SEQ ID NO: 28571

SEQ ID NO: 170503 - DNA, 601 bp, Human; identical to SEQ ID NO: 28572

SEQ ID NO: 170504 - DNA, 601 bp, Human; identical to SEQ ID NO: 28573

SEQ ID NO: 170505 - DNA, 601 bp, Human; identical to SEQ ID NO: 28574

SEQ ID NO: 170506 - DNA, 601 bp, Human; identical to SEQ ID NO: 28575

SEQ ID NO: 170507 - DNA, 601 bp, Human; identical to SEQ ID NO: 28576

SEQ ID NO: 170508 - DNA, 601 bp, Human; identical to SEQ ID NO: 28577

SEQ ID NO: 170509 - DNA, 601 bp, Human; identical to SEQ ID NO: 28578

SEQ ID NO: 170510 - DNA, 601 bp, Human; identical to SEQ ID NO: 28579

SEQ ID NO: 170511 - DNA, 601 bp, Human; identical to SEQ ID NO: 28580

SEQ ID NO: 170512 - DNA, 601 bp, Human; identical to SEQ ID NO: 28581

SEQ ID NO: 170513 - DNA, 601 bp, Human; identical to SEQ ID NO: 28582

SEQ ID NO: 170514 - DNA, 601 bp, Human; identical to SEQ ID NO: 28583

SEQ ID NO: 170515 - DNA, 601 bp, Human; identical to SEQ ID NO: 28584

SEQ ID NO: 170516 - DNA, 601 bp, Human; identical to SEQ ID NO: 28585

SEQ ID NO: 170517 - DNA, 601 bp, Human; identical to SEQ ID NO: 28586

SEQ ID NO: 170518 - DNA, 601 bp, Human; identical to SEQ ID NO: 28587

SEQ ID NO: 170519 - DNA, 601 bp, Human; identical to SEQ ID NO: 28588

SEQ ID NO: 170520 - DNA, 601 bp, Human; identical to SEQ ID NO: 28589

SEQ ID NO: 170521 - DNA, 601 bp, Human; identical to SEQ ID NO: 28590

SEQ ID NO: 170522 - DNA, 601 bp, Human; identical to SEQ ID NO: 28591

SEQ ID NO: 170523 - DNA, 601 bp, Human; identical to SEQ ID NO: 28592

SEQ ID NO: 170524 - DNA, 601 bp, Human; identical to SEQ ID NO: 28593

SEQ ID NO: 170525 - DNA, 601 bp, Human; identical to SEQ ID NO: 28594

SEQ ID NO: 170526 - DNA, 601 bp, Human; identical to SEQ ID NO: 28595

SEQ ID NO: 170527 - DNA, 601 bp, Human; identical to SEQ ID NO: 28596

SEQ ID NO: 170528 - DNA, 601 bp, Human; identical to SEQ ID NO: 28597

SEQ ID NO: 170529 - DNA, 601 bp, Human; identical to SEQ ID NO: 28598

SEQ ID NO: 170530 - DNA, 601 bp, Human; identical to SEQ ID NO: 28599

SEQ ID NO: 170531 - DNA, 601 bp, Human; identical to SEQ ID NO: 28600

SEQ ID NO: 170532 - DNA, 601 bp, Human; identical to SEQ ID NO: 28601

SEQ ID NO: 170533 - DNA, 601 bp, Human; identical to SEQ ID NO: 28602

SEQ ID NO: 170534 - DNA, 601 bp, Human; identical to SEQ ID NO: 28603

SEQ ID NO: 170535 - DNA, 601 bp, Human; identical to SEQ ID NO: 28604

SEQ ID NO: 170536 - DNA, 601 bp, Human; identical to SEQ ID NO: 28605

SEQ ID NO: 170537 - DNA, 601 bp, Human; identical to SEQ ID NO: 28606

SEQ ID NO: 170538 - DNA, 601 bp, Human; identical to SEQ ID NO: 28607

SEQ ID NO: 170539 - DNA, 601 bp, Human; identical to SEQ ID NO: 28608

SEQ ID NO: 170540 - DNA, 601 bp, Human; identical to SEQ ID NO: 28609

SEQ ID NO: 170541 - DNA, 601 bp, Human; identical to SEQ ID NO: 28610

SEQ ID NO: 170542 - DNA, 601 bp, Human; identical to SEQ ID NO: 28611

SEQ ID NO: 170543 - DNA, 601 bp, Human; identical to SEQ ID NO: 28612

SEQ ID NO: 170544 - DNA, 601 bp, Human; identical to SEQ ID NO: 28613

SEQ ID NO: 170545 - DNA, 601 bp, Human; identical to SEQ ID NO: 28614

SEQ ID NO: 170546 - DNA, 601 bp, Human; identical to SEQ ID NO: 28615

SEQ ID NO: 170547 - DNA, 601 bp, Human; identical to SEQ ID NO: 28616

SEQ ID NO: 170548 - DNA, 601 bp, Human; identical to SEQ ID NO: 28617

SEQ ID NO: 170549 - DNA, 601 bp, Human; identical to SEQ ID NO: 28618

SEQ ID NO: 170550 - DNA, 601 bp, Human; identical to SEQ ID NO: 28619

SEQ ID NO: 170551 - DNA, 601 bp, Human; identical to SEQ ID NO: 28620

SEQ ID NO: 170552 - DNA, 601 bp, Human; identical to SEQ ID NO: 28621

SEQ ID NO: 170553 - DNA, 601 bp, Human; identical to SEQ ID NO: 28622

SEQ ID NO: 170554 - DNA, 601 bp, Human; identical to SEQ ID NO: 28623

SEQ ID NO: 170555 - DNA, 601 bp, Human; identical to SEQ ID NO: 28624

SEQ ID NO: 170556 - DNA, 601 bp, Human; identical to SEQ ID NO: 28625

SEQ ID NO: 170557 - DNA, 601 bp, Human; identical to SEQ ID NO: 28626

SEQ ID NO: 170558 - DNA, 601 bp, Human; identical to SEQ ID NO: 28627

SEQ ID NO: 170559 - DNA, 601 bp, Human; identical to SEQ ID NO: 28628

SEQ ID NO: 170560 - DNA, 601 bp, Human; identical to SEQ ID NO: 28629

SEQ ID NO: 170561 - DNA, 601 bp, Human; identical to SEQ ID NO: 28630

SEQ ID NO: 170562 - DNA, 601 bp, Human; identical to SEQ ID NO: 28631

SEQ ID NO: 170563 - DNA, 601 bp, Human; identical to SEQ ID NO: 28632

SEQ ID NO: 170564 - DNA, 601 bp, Human; identical to SEQ ID NO: 28633

SEQ ID NO: 170565 - DNA, 601 bp, Human; identical to SEQ ID NO: 28634

SEQ ID NO: 170566 - DNA, 601 bp, Human; identical to SEQ ID NO: 28635

SEQ ID NO: 170567 - DNA, 601 bp, Human; identical to SEQ ID NO: 28636

SEQ ID NO: 170568 - DNA, 601 bp, Human; identical to SEQ ID NO: 28637

SEQ ID NO: 170569 - DNA, 601 bp, Human; identical to SEQ ID NO: 28638

SEQ ID NO: 170570 - DNA, 601 bp, Human; identical to SEQ ID NO: 28639

SEQ ID NO: 170571 - DNA, 601 bp, Human; identical to SEQ ID NO: 28640

SEQ ID NO: 170572 - DNA, 601 bp, Human; identical to SEQ ID NO: 28641

SEQ ID NO: 170573 - DNA, 601 bp, Human; identical to SEQ ID NO: 28642

SEQ ID NO: 170574 - DNA, 601 bp, Human; identical to SEQ ID NO: 28643

SEQ ID NO: 170575 - DNA, 601 bp, Human; identical to SEQ ID NO: 28644

SEQ ID NO: 170576 - DNA, 601 bp, Human; identical to SEQ ID NO: 28645

SEQ ID NO: 170577 - DNA, 601 bp, Human
ggacaaacggaagtgtaggttacggtctgagacatcaccgccaagctgggcatcggggagatggccgagactgaccccaagaccgtgcaggacctcacctcggtggtaagggacggctgtgagggccggaggccgcggccttcccgggcggcgccgggccaagccctgctggacagaggcgcgcccaccgcggccgcgcgtggcgtctgccgaggccccgtttctggaagcgtctctggccgaggctcccggccaccttgacccccggggcgctcggtgcgggccagtctccccgcgggcrcccccaagcccgaccccttccagtagccccattcatctgtcgcgaacgccctccgggtccctcccgcctacctctgacaccctccccgcccttcaactcctcacacacccccgggtgccccagcccggcagaaacaacctaaagaccctgagctttgagtcgcagcggcctccccagcccagcagtctaattggacaggttggaaaacggaagcccagagaaggaagatcttgctgaaggccgcacagctgtccagaggcagaaatggggctggaaccccgggaccagggcttgcgtcct

SEQ ID NO: 170578 - DNA, 601 bp, Human
gacctcatgacacaggctggggtggaagaactggaaagtgaaaacaagatacctgccacgcaaaagagttgaaggtgaggaagggggcaattttttttttcttttcttttcttttttttttttttttttttttgacacggagttttgctcttgttgcccaggctggagtgcaatggcacgatctcggctccctgcaacctttgccctcctgggttcaaacgattgtcctgcctcagcctcccgagtagctgggattacaggcttgtgccaccacacccagccaattttgtatttttagtaragacggggtttctccatgttggtcatgctggtctcgaattctgaccttgagtgatttgcccgcctcagcctctcaaagtgctgggattacaggtgtgagccgccgtgcccggtctttttttttattttgtcttaaaagaatagagagaacctgtaagtataatttgtatgtagtcagacattctgtagatcagttcccagccatgatcccagcaagcatcactgtattgtttacctgctgtggacttgatgttttgaaatttttcatgccaaactcattctttacaccgaatttattttc

SEQ ID NO: 170579 - DNA, 601 bp, Human
attctttacaccgaatttattttcccagtttttattaattagacttctgtcactattagtgaagaccactggctaacattagataaccactgagtttttatcattccagctaataataaggtgtctttttgttggcctataaagcctgtcactggaagattttccattgcttttttttttttttatggaaataactgataagtcacccacattaccaccttcttaaatggcttaaattctggagactttcttggtaacttgacataggtgaactagattgtggccacattaagcttttacyctggagttcatttaaatttcctctgaatagtttcagatgtcagaggaaagcctagtaattcaaagtacctacacagcaagataggtaaatgtacagaatcactcagcagagtgcatggtgatccttttcctctgtatgtgtgaaaaataagttttagactcacttttctcttgtttcatttataacattttaattctctataaaaatgaatgttgctgagggaggcggaggttgcagtcgaggtcacgccactgcactccagcctgggcgacagagtgagactctgtctcaaaaaaaaaa

SEQ ID NO: 170580 - DNA, 601 bp, Human
ggtaatcaggcattagcacagttcattcatgttaaatgcagacacatactttgagatttaaatgattatgacccgaaagaaggcctagagcaacatatactcttcttttatactgttagtattaaatacggcgaaaaactaacctgccctttttttatttttatttttgttgcccagactggagtacagtggtgttatcacggctcactgcagcctcgacttccccaggctcaagcaatcttcccacctcagcctcctgagtagctgggactacaggtgcaggccaccatgcccggctaawtttttttttttttttttttttttgtagagagggcgtttcaccatgtggcccaggcttaacctgcccttttaatgaacgaaaaatgacgtaaatgtttcaggaagttttggacattcagaagtttgttatgtgcagttggtgttaaaaaaaaattgaacacttgaatgattatgacttgacccatttaagaactctaatactggtttaatagtttacattccttcagtcttacgtgggtgataacacgtatcccttttacagtaaaggagaacatgctgaggttgtgttacttgtcctgaa

SEQ ID NO: 170581 - DNA, 601 bp, Human
gtcaaagttctgagtcctttcaccctttaacagggattaaaatgtaaaattgttttataaaatttggaagctgagacaggagaatcgcttgaacctagggagcagaggttgcagtgagccagggttgcaccactgcactccagcctgggtgacagaggaagactccatctctcaaaaaaaaaaaaaaattctagctgttgtaaagccattcttataggtgttgcccattgtgttctttatgacccttgtagagagattcagaaggtcattcttgtatcagatgtcctgagatgtttactgktatttaataataatgttcagtggatctgttactatgtagtttatgagtaacaaagacccaaaataacagtgatttgaatatgacagaagtttgtctgtcatgtgaaagtctagaggtgggcagcccagagctgattctgctctttggtgctcttggtggattcagacttgaatcttgttgctctgccgagaaaaaccttcatctccaaagccacgtcgtggcccaggatggctgctccaatgccagccatcacaccgccttccagtctgcagtggaaaggacaaagaaaaagatgggcca

SEQ ID NO: 170582 - DNA, 601 bp, Human
ttctagctgttgtaaagccattcttataggtgttgcccattgtgttctttatgacccttgtagagagattcagaaggtcattcttgtatcagatgtcctgagatgtttactgttatttaataataatgttcagtggatctgttactatgtagtttatgagtaacaaagacccaaaataacagtgatttgaatatgacagaagtttgtctgtcatgtgaaagtctagaggtgggcagcccagagctgattctgctctttggtgctcttggtggattcagacttgaatcttgttgctctgccsagaaaaaccttcatctccaaagccacgtcgtggcccaggatggctgctccaatgccagccatcacaccgccttccagtctgcagtggaaaggacaaagaaaaagatgggccaagggcctgctcctgctgtcttttcaagttccccaaagtggctgcaggagacctctgcttacccctcattgaccagaactctgtcacatggctgcccccagccgcagtgcaatctttgttctggacagctgtgtccctagctgaaaagtgaggcttctgttaatttgaaagaaaaggggtacagccatc

SEQ ID NO: 170583 - DNA, 601 bp, Human
atgcatcctgacttgagagatgttaaaatatgaaaatgtacatctctgagttgatgaaatagggttcctgaaccaagtacttgtctttcttaggaaatgtaggcgtaatgttttgacgtatcaaagaaggttcccgagaggatgaggacagtgctgttgacacccttgctgtcttagtgtttcccttacagtgcatctttcattgttatgttgattttatatgattagtatgctcactatggtgaacgaattggaagatattatttgatttgggcaacttagttcaaattgaattgtttcattcagaggtcttaacagactgaagtagttaagtctaaatagagcgttgaacgaaagaaagcctgacttggtttgagataagatgtctgacagaggaatcttgggaaaagctgtttggagagttgtcttgcacaattgtcttatgtattgtgcttgagtgttttcattccttgtgctgaccacaacacagagatgggcttgatctgtcgcacattggaggcctgggatttatcttctccttttcaggaaatgaatggggtgctgaaaggaatgctctcagaatggttttcctccgggttcc

SEQ ID NO: 170584 - DNA, 601 bp, Human
cgagaggatgaggacagtgctgttgacacccttgctgtcttagtgtttcccttacagtgcatctttcattgttatgttgattttatatgattagtatgctcactatggtgaacgaattggaagatattatttgatttgggcaacttagttcaaattgaattgtttccttcagaggtcttaacagactgaagtagttaagtctaaatagagcgttgaacgaaagaaagcctgacttggtttgagataagatgtctgacagaggaatcttgggaaaagctgtttggagagttgtcttgcacarttgtcttatgtattgtgcttgagtgttttcattccttgtgctgaccacaacacagagatgggcttgatctgtcgcacattggaggcctgggatttatcttctccttttcaggaaatgaatggggtgctgaaaggaatgctctcagaatggttttcctccgggttcctgaacctagaacgggttacctggcattcaccgtgtgaagtgcttcagaaaatcagtgagtaagtattacggttttcattttctttgtacatacatttttcatatatatttgtgtatgttttatattggctaaaa

SEQ ID NO: 170585 - DNA, 601 bp, Human
cagtgctgttgacacccttgctgtcttagtgtttcccttacagtgcatctttcattgttatgttgattttatatgattagtatgctcactatggtgaacgaattggaagatattatttgatttgggcaacttagttcaaattgaattgtttccttcagaggtcttaacagactgaagtagttaagtctaaatagagcgttgaacgaaagaaagcctgacttggtttgagataagatgtctgacagaggaatcttgggaaaagctgtttggagagttgtcttgcacaattgtcttatgtatygtgcttgagtgttttcattccttgtgctgaccacaacacagagatgggcttgatctgtcgcacattggaggcctgggatttatcttctccttttcaggaaatgaatggggtgctgaaaggaatgctctcagaatggttttcctccgggttcctgaacctagaacgggttacctggcattcaccgtgtgaagtgcttcagaaaatcagtgagtaagtattacggttttcattttctttgtacatacatttttcatatatatttgtgtatgttttatattggctaaaagctaatctatctcc

SEQ ID NO: 170586 - DNA, 601 bp, Human
tccactcctaggaacttctcctggggagatgctcagccctgagagtcagatggctattcctgcagcattgctgacagttcaaaagggtggggatgataacctagggcccatcaggagagaatgggctccaggagggcgctgtagacacatggcgcggcctcgtgtacatcagatatctgtgcatgtatttaaatattgttgtaggtttatatggaaaaccagccttgacttactcttgagtagaagttcaggtttatagagtagcatgggtatggtgtggtcttatgaataatattaatartatctgttgagtagtgctctgtgcctgtcagtctgtgaagcacattttgtgtgttattgccctgagcaccctgtgatttaggtggtggtgttgtgttttttttttttttttttgaagcggagtttcgctcttcttgcgcaggctagagtgcaatggtgctgtctcggctcactgcaacctccaactcccgggtacaagcaattctcctgcctcagcctcccgagtagctggggattacaggcatgtgccaccatgcccagctaatttttttttttttttgtatttttagcagagatggga

SEQ ID NO: 170587 - DNA, 601 bp, Human
gtagaagttaaaatagtttaaatgggttcttcaaaagtaagctggtttccctgcttcaaagcaaatgaaaaggtagccccctgctgttccactgttatccagtgagctttggagtgttaaggattatgcttcggagtataagggattagaaaacgctgccgtgagaatgagaggcaataaactcagacttcagctaagcgacttcccagtctagctcgtttcttagaatgcctcgcagggatgtctgcaaatgtgttaccatttaggaaaaacagaaatggcacaaaacccaaaaggtacrtgaaaaagtcaaacaaaggtatatttcctaaaagaaaattatataggactgcttatagcctcttgagaaatttgaaaaacctagggttcagagaaaaggaggaaaaacaattcagtggtgggaaacgtcagtcctttaggagaagctgaaggaactggagctgtttggtctcaaggatccgtgtgttatcgctgagtgttggccggagagtttatggagcaagtttttgtttgcacaaaggcctaaaagagacagaaaggggcatacattgctcttcaacaaagtttgcatgaaaatttc

SEQ ID NO: 170588 - DNA, 601 bp, Human
ctcagacttcagctaagcgacttcccagtctagctcgtttcttagaatgcctcgcagggatgtctgcaaatgtgttaccatttaggaaaaacagaaatggcacaaaacccaaaaggtacatgaaaaagtcaaacaaaggtatatttcctaaaagaaaattatataggactgcttatagcctcttgagaaatttgaaaaacctagggttcagagaaaaggaggaaaaacaattcagtggtgggaaacgtcagtcctttaggagaagctgaaggaactggagctgtttggtctcaaggatccrtgtgttatcgctgagtgttggccggagagtttatggagcaagtttttgtttgcacaaaggcctaaaagagacagaaaggggcatacattgctcttcaacaaagtttgcatgaaaatttcaagaaacgatgcagtgctgaggacccccaggcacgcggtggagtcgcctcctccagagagttttcaaaacagagcagcttttaggctctgtagcctgaaccccagctggggagccgaggtctcttccagctccttcagtgctctgagaattgtcttctcgtcccagcaacaggcttgcctc

SEQ ID NO: 170589 - DNA, 601 bp, Human
gattcagctgggcgtgggcttcattaccacgccgccatgtttcccccgggtaacaatgagccgtagctcattcccacagtttcctcattcctctgtcttcactgagggtggtgattagcagggcggggtggggaaatgtatcagggtaaggaaggcaggaagaggaggagcagatcccgggattcgggggagttgggccttagcccagcagctgtcctgagggtgtcgcttaactgcccctgggcggccagcctagaagtcctcaaagggagtctggaagggaacaaatggcccctctgcrtggaggcgctcgtcagggtttacaaaagcaaaacacagctgggcgcagtggctcacgcctgtaatcccagccgaggcaggcagatcacctggggtcaggagttcgagactagcctggcgaacgtggtgaaaccccgtctctactaaaaatataaaaattaggcatggtggtgcatgcctgtagtcccagctactcgggaggccgaggcaggagaatcacttgaacctaggaggcggagattgcagtgagccaagactgcaccattgcgctccagcctgggagagacagtctcaaaaaaaa

SEQ ID NO: 170590 - DNA, 601 bp, Human
gtgtaccaccatgccccactaatttttttcttttatttttctgtagagacgtggtctgacactacgctggtctcaaactcctgggctcaagtgatcctcttgccttggcctcccaaagtgctgggattacagatatgagccaccacacctggcttctcactgctattctttatgttcttatatttctcattgaaaacatggtgattatggggaagtgattccttggtattgagaacctctgaaattttgcaggcagaaggcaaagtggattttaacttttagctgatcgatggtggctgtkcccaggcttagtgggagagcatgccaaggttgattagcagtgtctggcaagggcatggctaggagtggcctctgtgcttatgtttgctctcttcttagcacgtgggtcctggcccctttgccactcaccctcaggcttattgcttttgtcatttattctataggtagcactggctgtatccttgaacttgagaacattcctccggcttcaaccccacagcaatgggaaagtggacctcagcttacccaacattggtatcaagcgggcctgggatgtggccaggcttcagtcactggacac

SEQ ID NO: 170591 - DNA, 601 bp, Human
ctttgccactcaccctcaggcttattgcttttgtcatttattctataggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtgagtgcaaggaggagaaaccaggtgtgctaagagcctacagagagggcagctggccaggtattctgggctgtccccaagggagccaggggccagctatttccygggtgttttctaccctgacctcataaaattagcttcactcattttatttttttaaaatttataggtgtaaaacaatgcattggatctctgtgggctgttgtggacagatcatcaaggcctattgttgagtgaaaaaaatgcaaaacagcaaacatacgtatttaagtataaatatgtgtataaatgatagaaaaggtctcgggggcatagacatcagattggcagtggtgattagttctcctgggagagacctagggccagagagtagacaaagtgacacatgttttaaataaggagaat

SEQ ID NO: 170592 - DNA, 601 bp, Human
gctggccagaaaggctctgccttctcagtgtctcagaggaaagtggcccaggttcctgtacatccctgggaacaacctgcctcaccttccccttctgcccaggcaccgcctcgcatttacactgtcctattcctgatgattatcttttggaggagggaaatattttgggggttaacttaacactcttttgattttggttttatacaatggaaggtgaaacctaggcccttgtgcgattgagccagcattctctgtgtgtgtctgtgtgtctgtgtgtgtttgttttaagactacaattttwtttttttttttttttgagacagggtctcactctgttatgcagcctggagtacagtggtgcgaccacagctcactgtttcttcaacctcctgggctcaagcgatcctcctgcctcagccttctgagtagctgggaccacaggtgtgcgccaccatgcctggctagtttttgtactttctgtagagttggggtttcgccatgttacctaggctggtctcaaactcctaggcacaagtgatctgcccaccttggcctcccaaagtactggggttacaggcataagcgcctgcacccaacctta

SEQ ID NO: 170593 - DNA, 601 bp, Human
ccagaaaggctctgccttctcagtgtctcagaggaaagtggcccaggttcctgtacatccctgggaacaacctgcctcaccttccccttctgcccaggcaccgcctcgcatttacactgtcctattcctgatgattatcttttggaggagggaaatattttgggggttaacttaacactcttttgattttggttttatacaatggaaggtgaaacctaggcccttgtgcgattgagccagcattctctgtgtgtgtctgtgtgtctgtgtgtgtttgttttaagactacaatttttttttwttttttttttgagacagggtctcactctgttatgcagcctggagtacagtggtgcgaccacagctcactgtttcttcaacctcctgggctcaagcgatcctcctgcctcagccttctgagtagctgggaccacaggtgtgcgccaccatgcctggctagtttttgtactttctgtagagttggggtttcgccatgttacctaggctggtctcaaactcctaggcacaagtgatctgcccaccttggcctcccaaagtactggggttacaggcataagcgcctgcacccaaccttaaaact

SEQ ID NO: 170594 - DNA, 601 bp, Human
aacactcttttgattttggttttatacaatggaaggtgaaacctaggcccttgtgcgattgagccagcattctctgtgtgtgtctgtgtgtctgtgtgtgtttgttttaagactacaattttttttttttttttttttgagacagggtctcactctgttatgcagcctggagtacagtggtgcgaccacagctcactgtttcttcaacctcctgggctcaagcgatcctcctgcctcagccttctgagtagctgggaccacaggtgtgcgccaccatgcctggctagtttttgtactttcygtagagttggggtttcgccatgttacctaggctggtctcaaactcctaggcacaagtgatctgcccaccttggcctcccaaagtactggggttacaggcataagcgcctgcacccaaccttaaaactactgttaattagcacttactacatgccaggtgctgtgctaaaaagtttacaccccttatttaactttacgttcctgacaaccgtaagaagaggcactgttgttatccctgttttaccaaggtgggaaacaggttcagggaggttaagtcacacggccagtaaatggcacagtt

SEQ ID NO: 170595 - DNA, 601 bp, Human
ttcctgatgttcaatagggatacatttggggtcaggaattctcccccagttgagaaaactggaccagatgcttggagtcaggcctgggcctggcccctggttcagtgctggcaccccactgccctgcgggagagtcacgtttcacaccctggtgtgtttcagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggayggggattgcgtcaacaggtaaccatggtccttacctggccagtgtccctcccgcacggcaggacagggacgtggcttctctcactgagacctcaccacctccctgtgaggtgagaggtgtcatagtggccattttaacatgaggaagctgagccccgagaggtcaaatggctggcccagggccacacagctagtgctggcagagtgggatttgaactcagagtctgagcttttctctcctgctctccaccacctctgctcacccccatcttggctctgttggtttcaagcgcccatggta

SEQ ID NO: 170596 - DNA, 601 bp, Human
caaaaggtggagggtgactgtgtgtgtgcacttgcatgtgtgtgtgttcttatgctgcttctaaccatttctcccaccttcccctgaaggccagtcattccttctcagaacccttagggagagtagacctcccaccccaccccaccccaccacaccccacccatcatgtgtttctgagtcggaaaggactggagcccagtctcctttgaagactcaaatctgagccccctaaaaaacaaactgtgtagagcaggaggaagactcacatttgttgagagggccaggccctgggctaggtcarctgcctgagttaccttcccccgcctccatcactcacttcatcccaggcacgctgccacctgttggtccctgggaagggccagccagctctggtgtggttccagtgctgcacaagtggtgtgtctggaatgcaccccacacacacaccttgcccagctggctccccttgtccttcaggcaccaccaccccgccccagcccccagcaattcagcccatcgtactcttacagaaacacctggtttgtttttgtttttgtttttttaactatattatcatttattaaatgtaattaggtagctc

SEQ ID NO: 170597 - DNA, 601 bp, Human
agataacaggcccagagtcactcagctagtaagaggcaatgcaggggccaggtgcggtggctcatgcctgtaatcccagcactttgggaggccaaagcgggcgttcgagaccagcctgtccaatatggtgaaaccccgtctctactaaaaaatacaaaaattagctgggcgtgctggtgtgcacctgttgtcccagctgctcgggaggctgaggcaggagaattgcttgaacccgggagaaagtgagctgagattgcaccactgcactccagcctgggtgacagagtgagactccgtctcaaaaaaaaagaaaaaaaaagaggcaaagtaggaccacgggagtccaaagcccaggctgttttgactgcgccaggtgggcttcagagggaagggcgcacacttggcacgctccgtagctggagaggttcagagtggacttgttctttctgagctcaagggcccaagctcctatgccccttggcctgcccagcacagccccaggtgacccctccccagccccactcctcactgccacagtaaagatgaacatctgtgtcttcaggtggaccaaggaggatttggagctaattaacaagtgggc

SEQ ID NO: 170598 - DNA, 601 bp, Human
atggtgaaaccccgtctctactaaaaaatacaaaaattagctgggcgtgctggtgtgcacctgttgtcccagctgctcgggaggctgaggcaggagaattgcttgaacccgggagaaagtgagctgagattgcaccactgcactccagcctgggtgacagagtgagactccgtctcaaaaaaaaagaaaaaaaaagaggcaaagtaggaccacgggagtccaaagcccaggctgttttgactgcgccaggtgggcttcagagggaagggcgcacacttggcacgctccgtagctggagagrttcagagtggacttgttctttctgagctcaagggcccaagctcctatgccccttggcctgcccagcacagccccaggtgacccctccccagccccactcctcactgccacagtaaagatgaacatctgtgtcttcaggtggaccaaggaggatttggagctaattaacaagtgggccttccaaggggagagaatgattcacgggaacccctccggagtggacaatgctgtcagcacctggggtaggtgtggcctcaggtttattttattgttgttattttaaaaattcttattacaatgg

SEQ ID NO: 170599 - DNA, 601 bp, Human
gtttgcacccacggcagaattgttgggtgcctggaatgaaacgcatggcagaggggagccaggtgcctttttgactgttccctaagcccttgatcaagttgtggggtggtgtttgtcccagggcactttgccacctccatgggccttttcgcatcagtaagggtcctggggctctctcctctttactcagggcggtcttcatggatgagtggcaggtcctggcctgcagcccccaccagctgggccactccattagtggctcagtaacctggcctgccacagcgccacacctgggcccccrgctagttctctgggatctttctgtcccagctcagtcatgcctccctttccaaggctgtacgtcagagttgtcagcattggcactattgagatttggggctgggttattctttgtggtggggctgccctgtgcattgtagccatccccagcccctacccactagatgccagtagcaccctcagcgtggcaatcaaaaacatctccagacattgcttagtgtcccttgggaggcagaatcacccttgccgccgacctttgcactccgcagaagccagtaggagcgtggaacagcttcctcgg

SEQ ID NO: 170600 - DNA, 601 bp, Human
cctaagcccttgatcaagttgtggggtggtgtttgtcccagggcactttgccacctccatgggccttttcgcatcagtaagggtcctggggctctctcctctttactcagggcggtcttcatggatgagtggcaggtcctggcctgcagcccccaccagctgggccactccattagtggctcagtaacctggcctgccacagcgccacacctgggcccccggctagttctctgggatctttctgtcccagctcagtcatgcctccctttccaaggctgtacgtcagagttgtcagcattgscactattgagatttggggctgggttattctttgtggtggggctgccctgtgcattgtagccatccccagcccctacccactagatgccagtagcaccctcagcgtggcaatcaaaaacatctccagacattgcttagtgtcccttgggaggcagaatcacccttgccgccgacctttgcactccgcagaagccagtaggagcgtggaacagcttcctcgggttgctccagcagtcgtcaggagagcctcgggtgccgaggtgaagctggtctgccaccgccccggatccatgtggaacca

SEQ ID NO: 170601 - DNA, 601 bp, Human
cactttgccacctccatgggccttttcgcatcagtaagggtcctggggctctctcctctttactcagggcggtcttcatggatgagtggcaggtcctggcctgcagcccccaccagctgggccactccattagtggctcagtaacctggcctgccacagcgccacacctgggcccccggctagttctctgggatctttctgtcccagctcagtcatgcctccctttccaaggctgtacgtcagagttgtcagcattggcactattgagatttggggctgggttattctttgtggtggggcygccctgtgcattgtagccatccccagcccctacccactagatgccagtagcaccctcagcgtggcaatcaaaaacatctccagacattgcttagtgtcccttgggaggcagaatcacccttgccgccgacctttgcactccgcagaagccagtaggagcgtggaacagcttcctcgggttgctccagcagtcgtcaggagagcctcgggtgccgaggtgaagctggtctgccaccgccccggatccatgtggaaccagagctggatcatgtgggggagtctcaaatgcccgggccccggc

SEQ ID NO: 170602 - DNA, 601 bp, Human
gtggctcagtaacctggcctgccacagcgccacacctgggcccccggctagttctctgggatctttctgtcccagctcagtcatgcctccctttccaaggctgtacgtcagagttgtcagcattggcactattgagatttggggctgggttattctttgtggtggggctgccctgtgcattgtagccatccccagcccctacccactagatgccagtagcaccctcagcgtggcaatcaaaaacatctccagacattgcttagtgtcccttgggaggcagaatcacccttgccgccgacctttgcactccgcagaagccagtaggagcgtggaacagcttcctcgggttgctccagcagtcgtcaggagagcctcgggtgccgaggtgaagctggtctgccaccgccccggatccatgtggaaccagagctggatcatgtgggggagtctcaaatgcccgggccccggcctgtcttcaggagcccacggtctgatggggaaggcggtcactggaatcgtcagagagaagacacctgaagggttgtgaagctgctgtgggtgacagtgacaggcgtcttagatctggctgcgagcctgggga

SEQ ID NO: 170603 - DNA, 601 bp, Human
ccagtagcaccctcagcgtggcaatcaaaaacatctccagacattgcttagtgtcccttgggaggcagaatcacccttgccgccgacctttgcactccgcagaagccagtaggagcgtggaacagcttcctcgggttgctccagcagtcgtcaggagagcctcgggtgccgaggtgaagctggtctgccaccgccccggatccatgtggaaccagagctggatcatgtgggggagtctcaaatgcccgggccccggcctgtcttcaggagcccacggtctgatggggaaggcggtcactgkaatcgtcagagagaagacacctgaagggttgtgaagctgctgtgggtgacagtgacaggcgtcttagatctggctgcgagcctggggaatcattcatggaagtggtggcatttcattccttcagtgtctcctgagagccacttgtggcctaagcactggactaggccctggagctagaaaactgatgaagacgtgggctgggcaccgagtgtacggtctactgggggcatcaggagatgaatgaggaggtttccaaggggggcgggcaggggaacggccaggggaatggccaggcgttgc

SEQ ID NO: 170604 - DNA, 601 bp, Human
ggctggtccctggcagaggaagcgcggtgcaaaggtcctgagacgagcacgctgcctgccgtgtgacacagtagctgggaggtcagagtggctgagtggagtgagcagcctggggagcgaggagagaagaagaggctggggcagtggccaagcccggatcacaggagcgcttaccaggcttaccccctgcgtggtggccgctggatgggtatgagccctggatctggtggggctggtgacaggcctgtctgcagaggacttgtctaagaaagatgaagatgcaacacccaaactcctcccrcctggctagatgggagcatggagcaaaccaacctttgctgcctgctgtggggtgccacgggagcagatggcggcttcacagagaagctgggggccagactccacgttaatcccatggatggcttaaggagcttccccccaccaaccatgcgtggtgcctctctgtaaagaaaaaatgcattgtttgtgaagtggatcaagatgcggcctcccagaacgctgcccttttgaggaatggcttgtcttagaagggaagagaaaagccaaatagaatgttcatcttttgtaaagttaaaaaaaa

SEQ ID NO: 170605 - DNA, 601 bp, Human
ggatcaagatgcggcctcccagaacgctgcccttttgaggaatggcttgtcttagaagggaagagaaaagccaaatagaatgttcatcttttgtaaagttaaaaaaaaaaaaaagccagcctccaaggctgagaatcgatattaatttcatgggcttatgggcagtgagataaagcaggtttctggcagccctttccagccctattggattttacaatcttgaactgtgaagacagcgaataaaggtatcaagggctctgcccgtctccagctgtctcgggccagagctcatccaaatccyccaccttccatcccagcctgcagccctctgaaaggcaggttggatggcaagaaatgtcagcttgagccctcgaagacggctcactacaaggacagttgggattgtggctttaggagggatttatgcagctcctctggggcaggtgaggaccacggggtcatgctagagagtcagctcaacgtggctgcctgggacacgtctatgtgccagagggcagccaaggggatgactgactctacatctggttttagaccagggctgctcgtccgggcaccattgaggtagggcaagaatgggctc

SEQ ID NO: 170606 - DNA, 601 bp, Human
tattggattttacaatcttgaactgtgaagacagcgaataaaggtatcaagggctctgcccgtctccagctgtctcgggccagagctcatccaaatcccccaccttccatcccagcctgcagccctctgaaaggcaggttggatggcaagaaatgtcagcttgagccctcgaagacggctcactacaaggacagttgggattgtggctttaggagggatttatgcagctcctctggggcaggtgaggaccacggggtcatgctagagagtcagctcaacgtggctgcctgggacacgtctrtgtgccagagggcagccaaggggatgactgactctacatctggttttagaccagggctgctcgtccgggcaccattgaggtagggcaagaatgggctcagcgtgctggggaccatcctcctctgcaaccctgccctccctgcatttacgagcccgtgcgtggcactgcccgcaccagctagcctgggcatcttccctctgtgtgatccatttcagggcctgttgcttggtctttctaaaactccagcttcgtgggggtgacccacacaagtgaaccttcgccccctccttgtactctgct

SEQ ID NO: 170607 - DNA, 601 bp, Human
gcaggtgaggaccacggggtcatgctagagagtcagctcaacgtggctgcctgggacacgtctatgtgccagagggcagccaaggggatgactgactctacatctggttttagaccagggctgctcgtccgggcaccattgaggtagggcaagaatgggctcagcgtgctggggaccatcctcctctgcaaccctgccctccctgcatttacgagcccgtgcgtggcactgcccgcaccagctagcctgggcatcttccctctgtgtgatccatttcagggcctgttgcttggtctttctraaactccagcttcgtgggggtgacccacacaagtgaaccttcgccccctccttgtactctgctatagccactttgaatttctcactggatgactgtgccgggttccgccacctccaggctcacacaggctgctccaactgccagaaatcctcacccttctagctttgcttggtggcttcttacccttcctcagttctcagtgtccacgtcatgccagaaaaaccttctcggcccttctcccctatcccctctctggccccggccccaaggccacgctgtgcctagcatgttgtaggtccc

SEQ ID NO: 170608 - DNA, 601 bp, Human
gtgggcggcttcccggactgctcccagtcctgtcccagctcctccatcttgagttcagtgtggacctgcctcctcttcaccctgcaggtcgccagctctccagatcctgctgaccaacaccaaagtccctcgcaataccagggcccttgtggctggcgtcagaaacaggctgctcaaggtgactcttgttcccttcttgggcaggtttcaggaaggccaggacacaattacatctggattttcgaggtctccctctggctgatgggttatagggggtgtggtgggtggtgggggcccttagggaggtggttttggcagaaaagaaggtaccgtccgtgcccgtagcctggccaggaaaatgacagtggtcgggctcgttagacacactgactttgcagctgggaaggcaaaaaaacaggctcagaagagaggtggtttccccagaggatgggcacgggctgtgtgaacacctcctccctccaccccactgctggggcagctgtcctgcatctgcctgcccccaggcctcaccagccgttccttctttttttctccagttcccagagatcgtggcccccctcctgacctcaatagatgccat

SEQ ID NO: 170609 - DNA, 601 bp, Human
ggacacaattacatctggattttcgaggtctccctctggctgatgggttatagggggtgtggtgggtggtgggggcccttagggaggtggttttggcagaaaagaaggtaccgtccgtgcccgtagcctggccaggaaaatgacagtggtcgggctcgttagacacactgactttgcagctgggaaggcaaaaaaacaggctcagaagagaggtggtttccccagaggatgggcacgggctgtgtgaacacctcctccctccaccccactgctggggcagctgtcctgcatctgcctgccyccaggcctcaccagccgttccttctttttttctccagttcccagagatcgtggcccccctcctgacctcaatagatgccatctccctggagtgtgagcgcgtgctgggagagatgggggaagccccagccccggagcagtacctcgtgctggaagtaagagcctgtctgcaggaaccggggttactgagtccacaccactgtccaaggcagtggctctgcaatctggctgtgctcagaatcccccggaagctagcacatagaggtcaggacctgcctctggcctatgctctcagctgggc

SEQ ID NO: 170610 - DNA, 601 bp, Human
gctgggaaggcaaaaaaacaggctcagaagagaggtggtttccccagaggatgggcacgggctgtgtgaacacctcctccctccaccccactgctggggcagctgtcctgcatctgcctgcccccaggcctcaccagccgttccttctttttttctccagttcccagagatcgtggcccccctcctgacctcaatagatgccatctccctggagtgtgagcgcgtgctgggagagatgggggaagccccagccccggagcagtacctcgtgctggaagtaagagcctgtctgcaggaaccrgggttactgagtccacaccactgtccaaggcagtggctctgcaatctggctgtgctcagaatcccccggaagctagcacatagaggtcaggacctgcctctggcctatgctctcagctgggcccaggtctgtgcgtgccatataagcgtatcttattttcaggcctcttcctgggtgattccgagtaattgggagagtgcaagggaggccagggcctggctcgtgctaagtgcaatggaaacaggtttgggtcacttctaaggagctctggcccacgtaggtagatggggatgtggctga

SEQ ID NO: 170611 - DNA, 601 bp, Human
agctctggcccacgtaggtagatggggatgtggctgatgcagagtgctctgtcggtgcaggggtgacttcttggtcactctcctgctattgctaacttcatgggtgcattcaacaactacttgtcaactgcctgctttgggtcagacagatcctaacattgttttttcatcattgcaaccccatccactgccatttgcataattctagtgtagaggttgtgacctggtactttgggtgtgatcaggcctgtgtgtgaatcccagctccacttctgctggacgtgtggcctcgctagagtgwcttaagaatgctcagattagacgggcgcagtggctcacctgtagtattagcactttgggaggccaaggcaggtggattgcttgagtccaggagttcgagaccaggctgggcaatgtggtgaaactctgtctctacaaaaaatacaaaagttagccagacatgacggtacatatcggtagtcccagctactcgagaggctgaggcaggaggatcacttgagcccaggaggtcaagtttgtagcctgggcgacagaatgagaccttgtctcacacacacacaaaaaatgcttggagtctcat

SEQ ID NO: 170612 - DNA, 601 bp, Human
aggcctgaagagagacttcccccaaggttatccagctagtgagtggccgagccaggggtccagccgacggactggtctgtccctttattcaacagatctgtcatgagcacctactatgtgccagggcagcgcctccatcgaattcctgtgtttcggccctcattccctcagtctttgtcttcctagctctcaattccttccacatagaaaggagggaacacagtccccccgagtaggaaatcaataatgatagaatactgcctaaaatacaccctgtcgagtccctggagaatgccacagcacagcacgttgattatacattgtgtgtatttttggctgtggcagccgctgaaatgtgcagctcagctcctggacagctttgcactcaaaccagcgaactgttctcctgtgtcacaacctgtcatctgatccttgacagattttggatcagaatgtgacaggtgtctggaacctgcctcggcaacgtgacacctggtgctcaggcgcagagagcggcccccagaagtcttctctcacatccagcccatcaggctggtgagaggcacccggggctgccaccaggccatcatgcctgtctgct

SEQ ID NO: 170613 - DNA, 601 bp, Human
agtccctggagaatgccacagaacagcacgttgattatacattgtgtgtatttttggctgtggcagccgctgaaatgtgcagctcagctcctggacagctttgcactcaaaccagcgaactgttctcctgtgtcacaacctgtcatctgatccttgacagattttggatcagaatgtgacaggtgtctggaacctgcctcggcaacgtgacacctggtgctcaggcgcagagagcggcccccagaagtcttctctcacatccagcccatcaggctggtgagaggcacccggggctgccacyaggccatcatgcctgtctgctcatttgtcaaaaatggtgagcttggcgcagagcgaggtatgaggcaggctgttggggagggccactccaaccctgcctgaccggccatccccatgcgggagagctaggtgggcctccgcagagatgcctcagtgattggcaactcctggtatacaggcaatccaggtgccccggaacagagcttcacacggaagtgaggaatgccagggggtgctctcagaggcagggtagacaggagcttcatgtcaggcagacccgccttccagtgccagcttggta

SEQ ID NO: 170614 - DNA, 601 bp, Human
acgcctctctggaccagctctgccaggtgaccagggcccgcggacttcacagcaagctgactggcgcaggcggtggtggctgtggcatcacactcctcaagccaggtatcccgggggtaggtgggccaggctgccagcctgggctcctaagaggggtccacctggagaattcccttgaaaggaaaaagagacctggaaacaggtctcagctccgctgtgtggccttgggcaagttagttaacctctggtctttgcttcctcattggtaaaataaggatgagagtatctagcttgcaagatygttgcccagattcaagcaggaaagtgcacctagagagcctggtgcagggctgggctgtggctggggctcctgtcatcggggctgtccgcacaagcttgggaagtaaccagggcattgtcactctccacgtctgcctaaccttgccccacttgtacccttgatgtggtcaggatgcggttgattttgctacaaaacgaaagggtttccttcccgttggtttggggaaagaggaagaccgagtaatgggcttggcttaggaagctccctggtgcctgggggcctggcaaggggcttctgcta

SEQ ID NO: 170615 - DNA, 601 bp, Human
cacactcctcaagccaggtatcccgggggtaggtgggccaggctgccagcctgggctcctaagaggggtccacctggagaattcccttgaaaggaaaaagagacctggaaacaggtctcagctccgctgtgtggccttgggcaagttagttaacctctggtctttgcttcctcattggtaaaataaggatgagagtatctagcttgcaagattgttgcccagattcaagcaggaaagtgcacctagagagcctggtgcagggctgggctgtggctggggctcctgtcatcggggctgtccscacaagcttgggaagtaaccagggcattgtcactctccacgtctgcctaaccttgccccacttgtacccttgatgtggtcaggatgcggttgattttgctacaaaacgaaagggtttccttcccgttggtttggggaaagaggaagaccgagtaatgggcttggcttaggaagctccctggtgcctgggggcctggcaaggggcttctgctagtgtttaaccacctgacacctacctctgccctcaggctcgctcctggcctacagtaggcactaaccggtcccacctgcctccatttcc

SEQ ID NO: 170616 - DNA, 601 bp, Human
cccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagtaagtatgaatgaaggaataaattaatacataattttagtagatkagttaactgcccttctttcgtcattgttcagttgaagaatacctgctatccctccaaagtgtataaaaactcatgttgcaatgggtaccttatatttgacaaaaaaaaaaaaaaaattaacacgagctcatttcttgtactttgcggatgtgctaatttaacttgctcctttggatacttggcatctagcaagagaactacccccttggggggttgaggatttgagaaggcatcggggaggattatctcgaaactgactcactgctgaatgtgtgcttggtttctcccactaggaaaaac

SEQ ID NO: 170617 - DNA, 601 bp, Human
cccagttactcatcgcgatatctatgttttaatgtctgtgttctctactaagattgttagctccataagacttgagactatgtctgttttggtctccatcatctaaccagcacagtacctggtacataattggcattcagtaagtatgaatgaaggaataaattaatacataattttagtagattagttaactgcccttctttcgtcattgttcagttgaagaatacctgctatccctccaaagtgtataaaaactcatgttgcaatgggtaccttatatttgacaaaaaaaaaaaaaaaattaacacgagctcatttcttgtactttgcggatgtgctaatttaacttgctcctttggatacttggcatctagcaagagaactacccccttggggggttgaggatttgagaaggcatcggggaggattatctcgaaactgactcactgctgaatgtgtgcttggtttctcccactaggaaaaacagtaccagttttactgtcatcttgcaacagcacacatatcagtgcttcagagatgatttggaaatttgatgtgaaagactaataagatcaagtctttattcaaaagttaatgcagt

SEQ ID NO: 170618 - DNA, 601 bp, Human
tcttgacacactagttgggaggctctgtcataaatattacagcaatgagcaccattcagttttaccttaacaaatatttatgtgcctgctatgtgtctggcactgtggtaacccttggggacctatgtgtgaccagagtagaggatctctaccccagtgacactttgagttgggagagtgggttgacccatcaaacaaataattttagatgtataattacaataatttttccaaaggaggtgattgcaagttagtgtagtataattaaggaacagtaaaaagtttgatgagaggctgggcrtggtggctcacacctgtaatcccagtactttgggaggctgaggcgtttgagctcaggagtttgagatgagcctggccaacatggcaaaaccgcgtttctacaaaaaatacaaaaattagctgggcgtggtggtgcacctctgtggttccagctacttgggggactgagatgggaggatctcttgagcccaggaggtgggggttgcagtgagccaagatcgcagcaccacactccagcttaggcaacagagggagaatgtgtctcaaaaaaaaaaaaaagtgtgatgagagattataacac

SEQ ID NO: 170619 - DNA, 601 bp, Human
tttaatgtaaaaggtcttctgttttcagtaatgatggactgagttattcagatagaatcttcctgctgaaacagaaaatgttagtatataaaaagtgtatatctgtattttttttacctttttttttgagatggatttttgctatgttgcctaggctggtcttgaatttctgggttcaagtgaccctcctgcctcagcctcctgagtagctgggattacaggtatgtgccactatgcccaactaaaagtatatcttttaaaaaatggcttaagaaaaatgaagagccagcagcatagtggmgaattgctaggttagtgttggtgggagaaagcgagaatccaaagaggtaagcgcagtcttggcaaaccaaaaccacatttgcctttgaattcacagcattatggggtgaggaggattgaaggaaagacctaagactcacccaaggtagattgtcctgtaggtcttgcagtgtaggagacccttcctgtgttaccctggaactccaaagggctacatcctcagggaagagtgaactagaactaacttccctgcccactcttagggactacatggaaggttgtcttggcactgaacggagaa

SEQ ID NO: 170620 - DNA, 601 bp, Human
tcttctgttttcagtaatgatggactgagttattcagatagaatcttcctgctgaaacagaaaatgttagtatataaaaagtgtatatctgtattttttttacctttttttttgagatggatttttgctatgttgcctaggctggtcttgaatttctgggttcaagtgaccctcctgcctcagcctcctgagtagctgggattacaggtatgtgccactatgcccaactaaaagtatatcttttaaaaaatggcttaagaaaaatgaagagccagcagcatagtggcgaattgctaggttagtgttggtgggagaaagcgagaatccaaagaggtaagcgcagtcttggcaaaccaaaaccacatttgcctttgaattcacagcattatggggtgaggaggattgaaggaaagacctaagactcacccaaggtagattgtcctgtaggtcttgcagtgtaggagacccttcctgtgttaccctggaactccaaagggctacatcctcagggaagagtgaactagaactaacttccctgcccactcttagggactacatggaaggttgtcttggcactgaacggagaaaggtcaaaaggaag

SEQ ID NO: 170621 - DNA, 601 bp, Human
atttttgctatgttgcctaggctggtcttgaatttctgggttcaagtgaccctcctgcctcagcctcctgagtagctgggattacaggtatgtgccactatgcccaactaaaagtatatcttttaaaaaatggcttaagaaaaatgaagagccagcagcatagtggcgaattgctaggttagtgttggtgggagaaagcgagaatccaaagaggtaagcgcagtcttggcaaaccaaaaccacatttgcctttgaattcacagcattatggggtgaggaggattgaaggaaagacctaagrctcacccaaggtagattgtcctgtaggtcttgcagtgtaggagacccttcctgtgttaccctggaactccaaagggctacatcctcagggaagagtgaactagaactaacttccctgcccactcttagggactacatggaaggttgtcttggcactgaacggagaaaggtcaaaaggaagataaaaagtttgttccagagaaggtaaagtcaaaaactggctatcatgcagacttacagcccaaatctgtgcatcgagaggagatcagggaaccttaatccctgagcatggtttaatacg

SEQ ID NO: 170622 - DNA, 601 bp, Human
atatcttttaaaggggaaagcatttcagtgcaagttactatgtttctttctttacagaaagccatggctgaaaccttttacctttctaacattgtgcctcaggattttgataataattctggatattggaacaggtgagggatgagagttttaaaaacatgattctatggaagataaatgaagtgacaggagaatgtactgatgtgcctattagctgtttctgtctttgtttttcaaaagctaagcctctgaaggtaagtatgttgggccagttttctttgctgtgttttgggagtacagycttctacagaagatcagacttcaaaacgtagcctgcctttttgatcatgtttgccactgttcaaaagtcaagttttgaaagaaatgactcaaaataataatcttaataattgaggcagcatcttttttgagtgtgttcagtgaacactattattttctcttgtattccaatatttcttagctttttttaaaaaaacagttttgtatttcaagagctcctgagctttaggccagggtcagtggttcatgtctatagtctcagcacctggagaggccgaggcaggagaattgcttgaggcca

SEQ ID NO: 170623 - DNA, 601 bp, Human
cctgagctttaggccagggtcagtggttcatgtctatagtctcagcacctggagaggccgaggcaggagaattgcttgaggccagcagtttgagactggcctgggacatagtgaagccttgtctctactaaaaatttaaaaaattaaccaagtgtggtggtccatgcctgtatcccagctactcaggaggctgaggtgggagaatcacttgagcccaggagtttgaggctatagtgagcggtgattgtgccactgcactccagtctggacaacagagcaagaccctatctcaaaaaaaaaagttcctgaacttaaaaaaagttggggtatagtttaatgtaactattaaccagtttttttgtttgttttttgtttttttgagacaaagtctcacactgtcgcccgggctggtgtgcagtggcacaatctcggctcactacaacctccgcctcccgggttcaagcgattctcctgcctcagcctcccgagtagctgggattataggcacacgccaccacacccggctaatttttgtatttttagtagacatggggtttcactatgttggccaggctagtcttgaactcctgacctcgtgatt

SEQ ID NO: 170624 - DNA, 601 bp, Human
ttatcagtcatggcgacatttgtttcatctacataccctcactttgccccactcagattatttttagcagattgcagatattttatccataaatgtttcgttacatatatttagaagataaggattcttttaaaatataaccacagtattattaatgcccttaaagaatttaacaataattctttattaccaattttatagtcagtgttcaaattttcctggttgtctttaattttttgttgttgttggttggtttgaaccaggattcaaataagatagacacaaaaatttggttgatatrtctctttagttcctataaatctgtagattttcctttctttttttttttcctccattcagattatctgttgaagatctaggatgtttgtcctagagtttcctttccatattctggatttgctgatcgcatacctgtggaagcatttaacattttcttttcccaagagataaatttctgggaggaaaactttaccttgtaattggacatatatatacaccctattaaaaataatttaaaaaaatttttaaggccagtcaagtgaagcagtgggagtagagaaggaacaaagaagtatgtaac

SEQ ID NO: 170625 - DNA, 601 bp, Human
aatgataaatcccagcattataaagattgttgtgaaactgctgtgttgtattttaattttttagagtaaattgatataaccctattaaaagcttatagagtaaattgatataaccctattaaaaatgttagttttacatatgatgacgagtctttaaaataaattcattcagtaattctggtccttgaaatttatcctaaggaattgatacaacgttgcattatataagaaatgttaacataagcccaattgtcctgcaagaggaatggttaaataaagtatatcatcttgttggaatgayacataattcttgaaagctggttgggaactatggcataaaaaaagttttaagttcatgaaatttgaattccagaatgtactctgagcgcacataaagaaaaatgtagatagttttgttagtgtatgtgatttttaagttttttctgtgcagtaagcaaactgggaaaataattgtttatatgcttataatgttttgtgccatgttcttgtttaatttctcaaatgcagtttttcttggtatctttcataggaattgatatgatttgctgctgtcttacatgtatatatgtgagaatatcat

SEQ ID NO: 170626 - DNA, 601 bp, Human
tgtcgagagctgacagaaaggtttgaagatgtttgggtggtatctgggcctttgaccttacctcagactagaggcgatggaaagaaaatagttagttaccaggtaaggatgtttaatagtcaggtttatgttatctgtatgagattataatctcactttccattctgctttttatttttatttttatcattcaaaaaaaattttgcattctactttttaatttcacttattcaacaatatttattgaacacctattaggaatgataggcatagggaatatagtgatggataaaagcaactrttgacttcaaggaactcacggtttagagtggaaaacagatgttaacaattaattacattaaagtgtgacatgctgtaatagaggtaaacacacacagtgtggtcttgtgaaaggactgatgggctctactcatatgagtcaggaacgcttaaaagaggaagtgatattgagctataccttgacagataagagtcaggagtggaccctgaggattccagaggatggagcaggatgagcacaggacatttgtggtcaacatcagggttttgagatttatatatcattcataaaaattggagc

SEQ ID NO: 170627 - DNA, 601 bp, Human
aatcttatcatgcagaaatatcctgaggattcttccaagagggtggctgaaatgttatactatactgtgaggcttacagagggcagggaacaggtggagtgaagcagaagaggtggtagagtgagtaaaaagaagcactgaaggacttgctaataaggccaaagaggaggggagggaacacctagctcagctctggaaataaagtagatatttaataaatgctggttaggtaaatgattacttaagtctgtgataaaatttaataacctgaggaacagattgaggaaccacccccccccccaaaaaaaaaccaaaacttttagagtatattctgtccatttgacttgcttattatcagcctgtctagatcagatgtgcagtaatgtccaagcatccaaggatttgtataggtccatatgaatagcccactttctctttttccacacaaaattatgacccaactacttctttttgttaagtggaaatgatagagtagttgttttcaaggatttgtacatccttggaaaattccagtagatatgggagtgaaggaagtcaaaggaattagtattttaaaattaattcatttaatatctctcct

SEQ ID NO: 170628 - DNA, 601 bp, Human
ttttttttcgctcatggcattaaagtcataactggcaaactatctttccttgaaattaaacttgaaaaatttttaaattatgcaattatatgtgcataatgataaaaatgctaaatcttaaaacatgattgtggaaatatatgacattgtaatgaaattcaaacagtacaaagcagcatgaaaaggtaaagtctcacttatactccttatcccactgtccagtttttatttgttttggcacttatttctatatctcagaataatgagcactaaaatatatttttaacttgtgacctgtcgyttattaacagttactttatctctataaaattatgaaatttattgtttatttcttgcactgcactatactctgctagtcatatatacttaattttagttcttccgttggtaaactttgcatcatatactttacataatatacttgaacctctaatcttgatctaccatttatacttgtcaaggtttgtagcatttacatttatgtttgctaacgataatgtagtctgagttttgcctgtagcagagtttgtaaactgaggcctcttatggcaagtccagcccatagaggtattttatttgg

SEQ ID NO: 170629 - DNA, 601 bp, Human
atttatattattataagtgtgtatgtagtatgtttggacctataaggaaatagatataattctatatcattaaatctgtgccacttgagagagaaatattaccacaaacaacggaaaaacagaagtggaaggtaagggtggcagtgtattataattgctctttttaaaaatactttctaattcagataatttaggtcatttaagcatattatcatatgattttttaaaaaggtaaattagttttttcgtgaaaatatattcttggagccctctgactttctgttttaatttggattacttrtttcctccctccttccctttctccttcattccctttcttctttccttccttttattcaacagagacttaactaagcttttactaggtacctggtgctgttctgggtgcttctgatacagcattaaacaaggcagaaaagagtaccctcatggagcatgcattatagtggaggagatacctagtaagtaaaatgcctcgtagaaatataaagcacggtagaggattgtattagggtgggaaagaaagacaaggggaagtgagatagggcagaagcctaagtgaagtgagggagcaagccat

SEQ ID NO: 170630 - DNA, 581 bp, Human
cgaaagagtcagaggagcagcctttaaggtaggagaaatctaggggagagtgatgttccagaagctaagtgaagaaatcatttaaaggagggaatgatgagttgagaactgactgtttgcaatcccagtaagcttttttagttttaagtcatctatatatctgtccttctgtttctccttattatactcctagcttgggtccttaaattcctctttccccttaaatattatcttaaatccctcttttccaccctcccccccctccccctgcttttttttttgagacggagttttacggtgtcccccaggctggagtgcagtggtgcgatcttggctcaccgcagcctccacctcccaggttcaagcaattcttctgcctcagcctcctgaatagctggtattacaggcacctgccaccacatttggctaattttttatatttttagtagagacagggtttcaccatgttggccaggctggtcttgaactcctgactgcaagtgatccgcctgccttagcctcccaaagtgctgggattacaggcatgagtcactgcacctggctacccttttttatagata

SEQ ID NO: 170631 - DNA, 601 bp, Human
atccgcctgccttagcctcccaaagtgctgggattacaggcatgagtcactgcacctggctacccttttttatagataacttttttttgctttggtagagtatatcctcaaattttttctggaagagtcaatggatgataacctttccgagtccttgcatgtctgaaaatgtcctaaaactctgaagatgcgctcaggaatctttatgtatgacaagttctctagagtagttttatgtataccaccattttattttattttaatgaggatgatccctttatttgacttgaggatggagaaraagaggattatgaggtcacgggaatgtctcatgaggaattacccaaagctggtaacaccaggtgctctgccaggaggactctctggaaggggcagccagctcacagatgccctggatccctcgaggccagtcactaaaaagttatgaccatccccttcttgccagtctgccagggctccaggggggaaaagtggaaaattatctggtcctggcccagggccagctcctcggtgaggaactcgaagaagtgggtgctgtggctgcggttctcctcagtggtgtccatcatgctggtggagg

SEQ ID NO: 170632 - DNA, 601 bp, Human
atttttcagcacttttatacctttttactgccattccatatatttatgtggaatatatatatggatatccatatatatatatatgtattttccttttaatttgcagaggagaggaccaaaaacccgtgttcaatttgccttttttaactggaaaccctactttaatctatatttattagtgttttgcaaagcaggttaatttgtttttgtctttgcttttagcaggttaatatttcttaatgttttatttggaaataatttcaaatttatagaaaggttataagaacaataaaaagaactyccctgtatctttcacctagatttactggttgttaacattttgccacatttatgctcccccatatagataggcatacacctgtttttgttttctgaaccatttgagttagttgcagatatcttgttcctttcctcctaagcattctgtcatgtaaccacagaataattatcaaattcgtgaaaaaacatatagaaatactacctaatatttagtccatattgaaattttacaaattacccaatactatcctttatactgttttttttttctgattcagtatccaaccaggattgagcattg

SEQ ID NO: 170633 - DNA, 601 bp, Human
ttgcaaagcaggttaatttgtttttgtctttgcttttagcaggttaatatttcttaatgttttatttggaaataatttcaaatttatagaaaggttataagaacaataaaaagaactcccctgtatctttcacctagatttactggttgttaacattttgccacatttatgctcccccatatagataggcatacacctgtttttgttttctgaaccatttgagttagttgcagatatcttgttcctttcctcctaagcattctgtcatgtaaccacagaataattatcaaattcgtgaaamaacatatagaaatactacctaatatttagtccatattgaaattttacaaattacccaatactatcctttatactgttttttttttctgattcagtatccaaccaggattgagcattgcatttagttgtcatgtctctgtagtctcctttaatctgaactagcttctgactcagccttttgtcttgaatgactttgatatttttgaatagtacgggccagttgttttacagtatgtccctcctttgggtttgtctgttgtttgctcatgattcattatgtttttggcagaatgtaggagca

SEQ ID NO: 170634 - DNA, 601 bp, Human
gttataagaacaataaaaagaactcccctgtatctttcacctagatttactggttgttaacattttgccacatttatgctcccccatatagataggcatacacctgtttttgttttctgaaccatttgagttagttgcagatatcttgttcctttcctcctaagcattctgtcatgtaaccacagaataattatcaaattcgtgaaaaaacatatagaaatactacctaatatttagtccatattgaaattttacaaattacccaatactatcctttatactgttttttttttctgattcrgtatccaaccaggattgagcattgcatttagttgtcatgtctctgtagtctcctttaatctgaactagcttctgactcagccttttgtcttgaatgactttgatatttttgaatagtacgggccagttgttttacagtatgtccctcctttgggtttgtctgttgtttgctcatgattcattatgtttttggcagaatgtaggagcagtgatcttgtgtccttctcagtgcattgcatcaggaggtgcataatatcagtttgtctgattattgatgattttaactttacttggttaaggt

SEQ ID NO: 170635 - DNA, 601 bp, Human
aaccatttgagttagttgcagatatcttgttcctttcctcctaagcattctgtcatgtaaccacagaataattatcaaattcgtgaaaaaacatatagaaatactacctaatatttagtccatattgaaattttacaaattacccaatactatcctttatactgttttttttttctgattcagtatccaaccaggattgagcattgcatttagttgtcatgtctctgtagtctcctttaatctgaactagcttctgactcagccttttgtcttgaatgactttgatatttttgaatagtaygggccagttgttttacagtatgtccctcctttgggtttgtctgttgtttgctcatgattcattatgtttttggcagaatgtaggagcagtgatcttgtgtccttctcagtgcattgcatcaggaggtgcataatatcagtttgtctgattattgatgattttaactttacttggttaaggtggtgtctaccaggttttttcaccatttccccctttggaatttataagtaatctgtggaaatactttgaggcgatgtaagcatctttttcgtcttcgaactttcactcaatagttttagc

SEQ ID NO: 170636 - DNA, 601 bp, Human
ttggaatttataagtaatctgtggaaatactttgaggcgatgtaagcatctttttcgtcttcgaactttcactcaatagttttagcatccattgatatttcctgcctgaattagttattactatgttagttgctaaatgatgactttctaattcttactcccttaatttattagttgacattccactgttagagcttttccttgttatcaatgtagactcacagatttatttttattcaaagagttttaatgtttactgtgattgttcattttgatgctcaaattgccccagatttagccrgtgggagctccttccagtgtctcctgtgtccttttgatgcatcctcatcattttttagcatttcctactttctggtataaggctatgttccatgttcatcttggccatcggccatttctccaaggagcactggatccttttagtggggattgatgtttagaaaccaagatctggacagcaattcagattgattcttgagtgcttgctctgctgtttggtttgtcaggtgtgttcaccacatttatttttagccttttgtagtggatggagagagccccaaagctcgtagtatatggattc

SEQ ID NO: 170637 - DNA, 601 bp, Human
tagttttagcatccattgatatttcctgcctgaattagttattactatgttagttgctaaatgatgactttctaattcttactcccttaatttattagttgacattccactgttagagcttttccttgttatcaatgtagactcacagatttatttttattcaaagagttttaatgtttactgtgattgttcattttgatgctcaaattgccccagatttagccagtgggagctccttccagtgtctcctgtgtccttttgatgcatcctcatcattttttagcatttcctactttctggyataaggctatgttccatgttcatcttggccatcggccatttctccaaggagcactggatccttttagtggggattgatgtttagaaaccaagatctggacagcaattcagattgattcttgagtgcttgctctgctgtttggtttgtcaggtgtgttcaccacatttatttttagccttttgtagtggatggagagagccccaaagctcgtagtatatggattccattgcctttagtggctcactgttgagaaggcctttctcctctgctttctgtgttcttgtatttcaaaacagggat

SEQ ID NO: 170638 - DNA, 601 bp, Human
agcaattcagattgattcttgagtgcttgctctgctgtttggtttgtcaggtgtgttcaccacatttatttttagccttttgtagtggatggagagagccccaaagctcgtagtatatggattccattgcctttagtggctcactgttgagaaggcctttctcctctgctttctgtgttcttgtatttcaaaacagggattgacagacactggtcattaggaaagcagttcactgtgtttgtacattgtgtatgtatatgtaaagttgaatattgacttcacgaatccatatttctggagragcatatggtttttcagttttctcagaagcatatcaaactgacatctacttttatatatttatgtttttcactaacaaatatctccataataatactgcttttattagttttggcattatatttcaagtcaaactttatttcaggtagaattttaaacctaaaaatctttggtgtatctgttagatgaaagcaaaatatagtttgttagtaaaataaatttgaaaaattatcttgaaattcttgccaagaatttaattgggcccaaatttttatatatatgcacacacacatgtatctat

SEQ ID NO: 170639 - DNA, 601 bp, Human
caggtagaattttaaacctaaaaatctttggtgtatctgttagatgaaagcaaaatatagtttgttagtaaaataaatttgaaaaattatcttgaaattcttgccaagaatttaattgggcccaaatttttatatatatgcacacacacatgtatctataaacttgggagaatttggttaagaaatagagatgtgggaggtctacctaggcaaggtgaagagatgagaagcgataggatatatgctgagaaaacagttaagttagagcgttcatgtagggaaggagacaaaaataaaaggraagtttggggcctggtggcagaaacttcaaatgaccagctaaaaagtttaggcaagaacttcaagataattttctagcaagcagggcctttgaaaagtaggcaattaattataaaacaaatatagataaaatgatgtcctttaattattctgggaaaggggacacagcattgcccagtgctggagactggtctgtttctctcaagcaacgaataatttgaatcatgaattcccactttcaaggcaatgtcttgcaattacgtacggcaattcagagtgcttggaaagtgttttgttttct

SEQ ID NO: 170640 - DNA, 601 bp, Human
gcaacgaataatttgaatcatgaattcccactttcaaggcaatgtcttgcaattacgtacggcaattcagagtgcttggaaagtgttttgttttctcagatctagccatttaatatttactgcttgcttacaactatactctgaaccttattttaggaagttgtacccaataaaagggtttatttagttttctgtccaggcaatgaagcatatatgtgtttttactttgggggaagtaaagcaaatgaactggcatttcttgagggccaggtataccaggcagtatgtaagtagctttatrtatgcatctcattcaatcttcactacacccttacaaaaaaagtagtgaccattttcttttatagacaagaaaatcaaggctttaaggatcaagtctcaggcatatagcttataattgtcaaagagggtatccaaacatgggtctgtctgacaattgccagtcattcacagtgttactctttgaagcgctcaagtttatagtaaatgaattgctgtgctgttcatatacaaaagcttaaggttagcagataataaaagatggtgtggatggagagaggagttacaagtgatacttgctagc

SEQ ID NO: 170641 - DNA, 601 bp, Human
caattacgtacggcaattcagagtgcttggaaagtgttttgttttctcagatctagccatttaatatttactgcttgcttacaactatactctgaaccttattttaggaagttgtacccaataaaagggtttatttagttttctgtccaggcaatgaagcatatatgtgtttttactttgggggaagtaaagcaaatgaactggcatttcttgagggccaggtataccaggcagtatgtaagtagctttatatatgcatctcattcaatcttcactacacccttacaaaaaaagtagtgamcattttcttttatagacaagaaaatcaaggctttaaggatcaagtctcaggcatatagcttataattgtcaaagagggtatccaaacatgggtctgtctgacaattgccagtcattcacagtgttactctttgaagcgctcaagtttatagtaaatgaattgctgtgctgttcatatacaaaagcttaaggttagcagataataaaagatggtgtggatggagagaggagttacaagtgatacttgctagcatgcaaaaataacagaaaatgggccaagaggaggattccttatagccag

SEQ ID NO: 170642 - DNA, 601 bp, Human
tttctcagatctagccatttaatatttactgcttgcttacaactatactctgaaccttattttaggaagttgtacccaataaaagggtttatttagttttctgtccaggcaatgaagcatatatgtgtttttactttgggggaagtaaagcaaatgaactggcatttcttgagggccaggtataccaggcagtatgtaagtagctttatatatgcatctcattcaatcttcactacacccttacaaaaaaagtagtgaccattttcttttatagacaagaaaatcaaggctttaaggatcragtctcaggcatatagcttataattgtcaaagagggtatccaaacatgggtctgtctgacaattgccagtcattcacagtgttactctttgaagcgctcaagtttatagtaaatgaattgctgtgctgttcatatacaaaagcttaaggttagcagataataaaagatggtgtggatggagagaggagttacaagtgatacttgctagcatgcaaaaataacagaaaatgggccaagaggaggattccttatagccaggcagaaatgtctgttagaatatgtaggaaaggatcacatcat

SEQ ID NO: 170643 - DNA, 601 bp, Human
cctttgagtcctttgttacagacatcatttgtgcccaagttgctttctcctcctgaaaccccattgctgacctgtaactagtctaatcttgcttgattatacgtttcccccgcccccatccctctgtaaaaccatcttttgtaccaaatgccgttgtatcttttgaatgatgtccactacaaaatagctttttacatagatcttgtagattttgaaaaatttttaactaacatgtcattgtatcttcataacaattctatgagagaggcatttataaaatacaaaatagcaatccacccayggggatggctgttacgtattttgtaaatgaagaaacaagaaatgggtggacgcgacttgcagcttagtggcaaagccaggtttgaccaggtctctgggcttccagtccaccaaacctctagtagtgtttagaaacatttctggaagtctcccaatttttccaaaagtaggaaaaatttattatgtagattgagttgtctttaaagagacagctctaaaatattttacgattgatgttgttttaaaaaattgtcttaaattcaaggaagaaacggtgtgtttttctgaatatccaactagg

SEQ ID NO: 170644 - DNA, 601 bp, Human
ttcccccgcccccatccctctgtaaaaccatcttttgtaccaaatgccgttgtatcttttgaatgatgtccactacaaaatagctttttacatagatcttgtagattttgaaaaatttttaactaacatgtcattgtatcttcataacaattctatgagagaggcatttataaaatacaaaatagcaatccacccatggggatggctgttacgtattttgtaaatgaagaaacaagaaatgggtggacgcgacttgcagcttagtggcaaagccaggtttgaccaggtctctgggcttccrgtccaccaaacctctagtagtgtttagaaacatttctggaagtctcccaatttttccaaaagtaggaaaaatttattatgtagattgagttgtctttaaagagacagctctaaaatattttacgattgatgttgttttaaaaaattgtcttaaattcaaggaagaaacggtgtgtttttctgaatatccaactaggacctgtccctatattagacagattaaagatgtttgcttcctaagaacaaagcagactgaatcagaaaagagattagtgagtggctaagtttttatttttctcct

SEQ ID NO: 170645 - DNA, 601 bp, Human
atccacccatggggatggctgttacgtattttgtaaatgaagaaacaagaaatgggtggacgcgacttgcagcttagtggcaaagccaggtttgaccaggtctctgggcttccagtccaccaaacctctagtagtgtttagaaacatttctggaagtctcccaatttttccaaaagtaggaaaaatttattatgtagattgagttgtctttaaagagacagctctaaaatattttacgattgatgttgttttaaaaaattgtcttaaattcaaggaagaaacggtgtgtttttctgaatayccaactaggacctgtccctatattagacagattaaagatgtttgcttcctaagaacaaagcagactgaatcagaaaagagattagtgagtggctaagtttttatttttctccttagttctagggatagtattttacccccttgaaatagtgtgagaaggtcatgggtagaaggatcacacctgtgattcctaataggaatttctgtttccatgaggtttctcaaaagtagaatcgaggtcctttagcaattgtaagagtttttaaacacctatagaaatggtacatttgcataaagtaaa

SEQ ID NO: 170646 - DNA, 601 bp, Human
aaaagaaacctcctttgtagctgtcgtgtctctgtcttatttgggctcacaagaaggaatcttgctgcaggcagagctgtctgatcaggaaagaaaactgactcttaccagggaagggcccgggaggggcagtaataccaatgagcatgttttagttggattatgtcagttattggggaccattaagtaaatagatgttgagtattttctttttcaaaaaagcctttttgttttgttttgttttgttttgagatggagtttcgctcttgttgcccaggctggagtgtagtgtcacaatctyggctaactgcaacctccacctcccgggttcaagtgattcttttgcctcagcctcccgagtagcagggattacaggcatgcgccaccacgcccagctaattttgtatttttagtagagatggggtttctccatgttggtcaggctggtctcaaactcccaacctcaggagatctgcctgccttggcctcccaaagtgctgggattacaggcatgagccaccacacctggcccagatgccaattggaaggaaatttgaaaaggtttagtaataatgttatttcattaatttcagccaaacca

SEQ ID NO: 170647 - DNA, 601 bp, Human
tctttgggttggcattattttatttttattttttgaggtggagtcttgctctgtcggccaggctggagtgcagtggtgcaatctcggctcactgcaccctctgcctcctgggttcaagcaattcttctgcttcagcctcccaagtagctgggattacaggcgcctgccaccacacccagctaatttttgtatttttttttagtagagatggggtttcaccatgttggccaggctggtcttgaactcctgacctcaagtgatctgcccgccttggcgtcccaaagtgctgggattacaggtrtgagccaccgtgcctcacctggggttatattattttaaagaatgtgatcagaattgacctgttaaatactcttcttgtatgtgaatctctgagtcagtttattatttttggcagttgaatttaaattcattagaacagagtgggatggcttataagtacatttcagcaatgcattaaataagtatttttcagaaaaaatttgcgaactgttagcacaaattggcatcactaatatggctgctttgtttttaggtgattggcgaggacaacgtggcagtcccctcacacctttataaggta

SEQ ID NO: 170648 - DNA, 601 bp, Human; identical to SEQ ID NO: 38381

SEQ ID NO: 170649 - DNA, 601 bp, Human; identical to SEQ ID NO: 38382

SEQ ID NO: 170650 - DNA, 601 bp, Human; identical to SEQ ID NO: 38383

SEQ ID NO: 170651 - DNA, 601 bp, Human; identical to SEQ ID NO: 38384

SEQ ID NO: 170652 - DNA, 601 bp, Human; identical to SEQ ID NO: 38385

SEQ ID NO: 170653 - DNA, 601 bp, Human; identical to SEQ ID NO: 38386

SEQ ID NO: 170654 - DNA, 601 bp, Human; identical to SEQ ID NO: 38387

SEQ ID NO: 170655 - DNA, 601 bp, Human; identical to SEQ ID NO: 38388

SEQ ID NO: 170656 - DNA, 601 bp, Human; identical to SEQ ID NO: 38381

SEQ ID NO: 170657 - DNA, 601 bp, Human; identical to SEQ ID NO: 38382

SEQ ID NO: 170658 - DNA, 601 bp, Human; identical to SEQ ID NO: 38383

SEQ ID NO: 170659 - DNA, 601 bp, Human; identical to SEQ ID NO: 38384

SEQ ID NO: 170660 - DNA, 601 bp, Human; identical to SEQ ID NO: 38385

SEQ ID NO: 170661 - DNA, 601 bp, Human; identical to SEQ ID NO: 38386

SEQ ID NO: 170662 - DNA, 601 bp, Human; identical to SEQ ID NO: 38387

SEQ ID NO: 170663 - DNA, 601 bp, Human; identical to SEQ ID NO: 38388

SEQ ID NO: 170664 - DNA, 601 bp, Human; identical to SEQ ID NO: 30842

SEQ ID NO: 170665 - DNA, 601 bp, Human; identical to SEQ ID NO: 30843

SEQ ID NO: 170666 - DNA, 601 bp, Human; identical to SEQ ID NO: 30844

SEQ ID NO: 170667 - DNA, 601 bp, Human; identical to SEQ ID NO: 30845

SEQ ID NO: 170668 - DNA, 601 bp, Human; identical to SEQ ID NO: 30846

SEQ ID NO: 170669 - DNA, 601 bp, Human; identical to SEQ ID NO: 121185

SEQ ID NO: 170670 - DNA, 601 bp, Human
gaggctgaggtgggtggatcacctgaggtcaggagtttgagaccagcctggccaacatggtgaaactctgtctttactaaaaaaaaatacacaaaattagccaggtgtggtggcagatgcctgtaatcccagctactccggaagctgaggcaggagaatgtcttgaacctgggagacggaggtttcaatgagccaagatctcgccattgcactccagactgggcgacaagagtgaaactctgtgaaactttatttgaaaaagaaaaaaaagagagaaaaagggaaactcaggtcccagagrtgcacgtgtccgctcgatcagcttagaggatgggacaggggagagctagaggggatagcttgggccttagaatctgtgcccatgagctgagtgactcggacgggtcacctcacctctccgggctctatccccgtctgcacaaaggggatcacagcaggacctgcctatggggccaccgagagggaggttctgcccctgaaatgattatcgcctgtgggtataacatgcaccagtgaacaggctgttgtgtcccaaatgctcataaatggaccccgatgcttggtgctttgtctggggacc

SEQ ID NO: 170671 - DNA, 601 bp, Human
ctacccaacaggagcctcaaactaatcacgtccagaggagatgaccaccttcccccagcccagctcattttctgtcttcatctcatcacaatgaccatgggcggtctcaacccctcagccagaaacctggagtccctggactcagtcacctcgcctcccacactgaaatggcttctgcgaacttagctactgcatctagacattctttttttttttgagacagagtctcgctctgttgcccaggctggagtgcagcctggcaacagagcaagactgtcccaaaaaaaaaaaaaaaaaaaaagaagtgtcatattgatctctccctctctctcctgctatgtacagtcccatttccttttatttttttgaaatggaatttcacccttgtcgcccaggctggagtgcaatggtgccaccttggctcaccgcaacctccacatcctgggttcaagcgattctcctgcttcagcctcccgagtagctgggattacaggcatgtgccagcacacttggctaattttttgtattttcagtagagacggtgtttctccatgtttgtcaggctggtctcgaactcccgacctcaggtgatctgcccacc

SEQ ID NO: 170672 - DNA, 601 bp, Human
ctctgcagcctcagtttccccgtgtgcacccagggcaggctgtgctccctccttcctggtttctggagtctgagtttggaatctaggggtctccctcacagcacacaaaactgtactggcaggatgtggggagacccaagcctggcatggcctggagcttcccatcccctggggcaccaggctgtgccccagcctggcccactcagctctcctggtgaagcgtgggctccacccagacacaccctggggctctgccgtcgcccctgtccccaccagcccgaccacaggacccttcacagcrgctgggttcttggggctgctcccccagactttggggcaccgcagcccccatgcccaccccagcagcctctgatgcccctggacttcacctggcagccatggagttctctgcactcccgtttactccccgctagtcaccttctgagtctaaggtgcccttcctcaaatgaaggtgggaggtcgacccatgaacagagagacaccaggccccagagatgacagggctccagggacaggcacatctctgcactaagagaccctctcctttctggtgactgtcctgggagggctgggctctggg

SEQ ID NO: 170673 - DNA, 601 bp, Human
tcctctgcagcctcagtttccccgtgtgcacccagggcaggctgtgctccctccttcctggtttctggagtctgagtttggaatctaggggtctccctcacagcacacaaaactgtactggcaggatgtggggagacccaagcctggcatggcctggagcttcccatcccctggggcaccaggctgtgccccagcctggcccactcagctctcctggtgaagcgtgggctccacccagacacaccctggggctctgccgtcgcccctgtccccaccagcccgaccacaggacccttcacakcagctgggttcttggggctgctcccccagactttggggcaccgcagcccccatgcccaccccagcagcctctgatgcccctggacttcacctggcagccatggagttctctgcactcccgtttactccccgctagtcaccttctgagtctaaggtgcccttcctcaaatgaaggtgggaggtcgacccatgaacagagagacaccaggccccagagatgacagggctccagggacaggcacatctctgcactaagagaccctctcctttctggtgactgtcctgggagggctgggctctg

SEQ ID NO: 170674 - DNA, 601 bp, Human
gtctatctgaattaactgacattcggggcctgggaggggaacttgaacagacaccctctctccgctggatctctcgaataaaaatcagagactggggcaaacttcaaaacaggacatccccaaatcggcatgaactttcagctcctggaggttaatccccaaacaatgggatcccggtttttatttagttatttttagagaacctccctctgtcacccaggctggagtgcagcggcatgatctcggctcactgcaacctccgccttctgggttcaagcgattttcctgcctcagcctcccragtagctgggatcacagacgtgcaccaccacgcccgaataatttttgcatttttagtggagacaaggtttcaccatattgggcaggctggtctcgaactcctgacctcaagtcatctgcctgccttggcctcccaaagtgctgggattacaggcgtgagccaccacaccgactgacttgacattaaaggccggtgtaggtcaccaaggcctggcctcagggacaatcggggtgggagtcagaggagccggccacgaagacccttttcaggtgggtttggggcgcctctctcgccgtttgt

SEQ ID NO: 170675 - DNA, 601 bp, Human
cattcattcattcattccagtagagatggggttttgctatgttggccaggctggtctccaactcctggcctcaagcgttctgcccacctcagcctcccaaactgctgggattacaggcatgagccacagcacctggcttgctgttgttttaagtcacattttggggtagtttggtacacagcaacaggaaggggaatattaacataatttgcccaaagtcacgctgtgagtgaggcagggaggcaggatttgaactcgggcagctggctccagggctcaggctctctctgcgacccatggrtgtggctcaggctcctgcttctggatgggctctgggggatgaagcagctggggtggcccggggtctagccacagccacgtccacccacccagccttcccatctcccctgccttctgctgagagtctcagggaggatttgattctcctcaacttgggccgggccagaagagatcagctgacgatggccaaggggctctctggttccccctccctccaccatcccagaaggccaggcaagggtggctagccagagacccatctccaatgccaccttgtccagccccctgtcctgggcactcc

SEQ ID NO: 170676 - DNA, 601 bp, Human
gtatcttggcttaaatggacgatcccaggacccagcaaaatgcctgactcatagtagatgttcaataaatatttatttaaaaaaaaacaaaataacctaacttttgggaagcccaatattcagttaggaaaagctctttcataattattaattttgtcataattattatagcagtgactaatcacagcttttaaattttattcattcattcattcattcattcattcattcattccagtagagatggggttttgctatgttggccaggctggtctccaactcctggcctcaagcgttctgmccacctcagcctcccaaactgctgggattacaggcatgagccacagcacctggcttgctgttgttttaagtcacattttggggtagtttggtacacagcaacaggaaggggaatattaacataatttgcccaaagtcacgctgtgagtgaggcagggaggcaggatttgaactcgggcagctggctccagggctcaggctctctctgcgacccatgggtgtggctcaggctcctgcttctggatgggctctgggggatgaagcagctggggtggcccggggtctagccacagccacgtcc

SEQ ID NO: 170677 - DNA, 601 bp, Human
cactccagcctcgtctacagatcgagactctgtctcaaacaaacaaacaaacaaacaaaaacaacctggcagctggctcttctgacatgcagttccaagtatcttggcttaaatggacgatcccaggacccagcaaaatgcctgactcatagtagatgttcaataaatatttatttaaaaaaaaacaaaataacctaacttttgggaagcccaatattcagttaggaaaagctctttcataattattaattttgtcataattattatagcagtgactaatcacagcttttaaattttattyattcattcattcattcattcattcattcattccagtagagatggggttttgctatgttggccaggctggtctccaactcctggcctcaagcgttctgcccacctcagcctcccaaactgctgggattacaggcatgagccacagcacctggcttgctgttgttttaagtcacattttggggtagtttggtacacagcaacaggaaggggaatattaacataatttgcccaaagtcacgctgtgagtgaggcagggaggcaggatttgaactcgggcagctggctccagggctcaggctct

SEQ ID NO: 170678 - DNA, 601 bp, Human
ccatccacacacacgcacaatccatccacacacacatatagtccacatgtttcttttatatatttttttaatttttttatttgaatttttttttgttttgttccacatgtttccatgtgcacagagcatttcaggaaacatgcatgacaggctggccagggtggggcctctgaggagagctggccctcgggatcatagcacccaccttttgcacagtttgatgttttaccatgtgcctctattacttacttaaatgcatacatttaaaaaaaacctgggctgggcgcggtgactcacaccggtaatcccagcactttgggaggccgaagcgggcggatcacgaggtcaggagatcgagaccatcctggctaacatggtgaaaccccgtctctactaaaaatacaagctacttgggaggctgaggcaggagaatggcgtgaacccgggaggcggagcttgtagtgagccgagatcgcgccactgcactccagcctcgtctacagatcgagactctgtctcaaacaaacaaacaaacaaacaaaaacaacctggcagctggctcttctgacatgcagttccaagtatcttggcttaaatggac

SEQ ID NO: 170679 - DNA, 601 bp, Human
ggaatgtagacccaacccgggttgttcttcgctagggccttggccagctcgaaggcttcatccaataactgcaaagccacaggggagataggagggggtgaggcacagggggcaccctgtccagccaccaggcgccctctctcttccttgccctgggtcggcactcacctcacccaccaccttgactgtggcaccttcattcttgaggcgctcaatggtgagagcaggtgtggtgctgggcaccacgatggtggcggggacgccgagttgcctggccgcatatgcagccgccatgcctgcrttgcccgctgccagggtcgggggtggagagcgtgtcagtgcgggagcatctgggagcccaggcaggactgcgtaccctctactgggggctctggagttcccccctcacctccccaccctgggcgactgctggcctccccctggaattccaaattggtggctgctgccattgttttcagtggcacattgctggggaaaccagggctcagagaagcagagtgtctgatcccaggacacacagcagaggacaggatggggaagcagatcacttacccgaggagcagacaaaatgtgcacagcc

SEQ ID NO: 170680 - DNA, 601 bp, Human
ctgaaacctttgtccccaagtctgcttccaggaggactcaactgcagacacttgggcatctgtgtgcttgcatgttcagccttgggtgtgttgcatgtgcagccgtggataatgggcatttggtgacatgtgtgcacttgctgctgcacctgggtgtaacgtgtgtttcttctttttttttttttttgtttttttttttgagatggagtctcactctcttgcccaggctggagtgcagtggcgtgatcatggctcactgcaacttccacctcctgggttcaagcgattctcctgccttagyctccctaggagctgggattacaggcgtgtgtcaccaagtacaggtaatttttgtatttttagtagagatggggtttccccatgttggccagactggtctcaaacacctgacctcaagtgatcctcccaccttggcctcccaaagtgctgggattacaggcgtgagccactgtgccccgcctaagtgtgcttctacatggtggtgtgcgcacacatgtgcagctgctgtgcatgaggacgtgatgatgtgcatcatagcaatgcctgcccagtgatatagggcagtggctgccacccccac

SEQ ID NO: 170681 - DNA, 601 bp, Human
gaaagcccccttcctgacattttggactggatgatagaaaaagaaaaaagaaacagcaaagcccccttccttccctggcttacttccccactcccccactgaatcacctcccaaataaactcctttccctgaaacctttgtccccaagtctgcttccaggaggactcaactgcagacacttgggcatctgtgtgcttgcatgttcagccttgggtgtgttgcatgtgcagccgtggataatgggcatttggtgacatgtgtgcacttgctgctgcacctgggtgtaacgtgtgtttcttctttttttttttttttgtttttttttttgagatggagtctcactctcttgcccaggctggagtgcagtggcgtgatcatggctcactgcaacttccacctcctgggttcaagcgattctcctgccttagtctccctaggagctgggattacaggcgtgtgtcaccaagtacaggtaatttttgtatttttagtagagatggggtttccccatgttggccagactggtctcaaacacctgacctcaagtgatcctcccaccttggcctcccaaagtgctgggattacaggcgtgagccactgt

SEQ ID NO: 170682 - DNA, 601 bp, Human
ccttggcaacactgagagaagtgggaacccagaagaggatgggagtgggggaaacaggagagagatgggggcagggagggagagaaggagatggatgtgagacagagaaggcaatgcatctgggggcagggggacaggtatcacctctgcagctgtaaaaccctgaaaagcctcagggatccccaaaccaagtggggtcttctaataaggtgcagagtgtttgaattgacatcatatagtatattctttagtatcatttttttaatttttttgagactgagtgtcactatgttgcccaggygggtttttgttttgtttgtttttttgttgtttttttgtttttttttttttttagacggagtcttgctctgttgcccaggctggagtgcagtggtgcgatctcagctcactgcaatctctgcctcccgggttcaagcaattctccagcctcagcctaccgagtagctgggactacaggtgcccaccaccacacccggctaatttttgtatttttagtagagatggggtttcactatgttgaccaggctggcctcgaattcctgaccttaggtgatccacccccctcggccttccaaagtgc

SEQ ID NO: 170683 - DNA, 601 bp, Human
tcagggcctgagcccccacagtcttcacgcccagggccttggcaacactgagagaagtgggaacccagaagaggatgggagtgggggaaacaggagagagatgggggcagggagggagagaaggagatggatgtgagacagagaaggcaatgcatctgggggcagggggacaggtatcacctctgcagctgtaaaaccctgaaaagcctcagggatccccaaaccaagtggggtcttctaataaggtgcagagtgtttgaattgacatcatatagtatattctttagtatcatttttttaatttttttgagactgagtgtcactatgttgcccaggcgggtttttgttttgtttgtttttttgttgtttttttgtttttttttttttttagacggagtcttgctctgttgcccaggctggagtgcagtggtgcgatctcagctcactgcaatctctgcctcccgggttcaagcaattctccagcctcagcctaccgagtagctgggactacaggtgcccaccaccacacccggctaatttttgtatttttagtagagatggggtttcactatgttgaccaggctggcctcgaattcctgac

SEQ ID NO: 170684 - DNA, 601 bp, Human; identical to SEQ ID NO: 35313

SEQ ID NO: 170685 - DNA, 601 bp, Human; identical to SEQ ID NO: 38460

SEQ ID NO: 170686 - DNA, 601 bp, Human; identical to SEQ ID NO: 38461

SEQ ID NO: 170687 - DNA, 601 bp, Human; identical to SEQ ID NO: 38462

SEQ ID NO: 170688 - DNA, 601 bp, Human; identical to SEQ ID NO: 38463

SEQ ID NO: 170689 - DNA, 601 bp, Human; identical to SEQ ID NO: 38464

SEQ ID NO: 170690 - DNA, 601 bp, Human; identical to SEQ ID NO: 38465

SEQ ID NO: 170691 - DNA, 601 bp, Human; identical to SEQ ID NO: 38466

SEQ ID NO: 170692 - DNA, 601 bp, Human; identical to SEQ ID NO: 38467

SEQ ID NO: 170693 - DNA, 601 bp, Human; identical to SEQ ID NO: 38468

SEQ ID NO: 170694 - DNA, 601 bp, Human; identical to SEQ ID NO: 38469

SEQ ID NO: 170695 - DNA, 601 bp, Human; identical to SEQ ID NO: 38470

SEQ ID NO: 170696 - DNA, 601 bp, Human; identical to SEQ ID NO: 38471

SEQ ID NO: 170697 - DNA, 601 bp, Human; identical to SEQ ID NO: 38472

SEQ ID NO: 170698 - DNA, 601 bp, Human; identical to SEQ ID NO: 38473

SEQ ID NO: 170699 - DNA, 601 bp, Human; identical to SEQ ID NO: 38474

SEQ ID NO: 170700 - DNA, 601 bp, Human; identical to SEQ ID NO: 38475

SEQ ID NO: 170701 - DNA, 601 bp, Human; identical to SEQ ID NO: 38476

SEQ ID NO: 170702 - DNA, 601 bp, Human; identical to SEQ ID NO: 38477

SEQ ID NO: 170703 - DNA, 601 bp, Human; identical to SEQ ID NO: 38478

SEQ ID NO: 170704 - DNA, 601 bp, Human; identical to SEQ ID NO: 38479

SEQ ID NO: 170705 - DNA, 601 bp, Human; identical to SEQ ID NO: 38480

SEQ ID NO: 170706 - DNA, 601 bp, Human; identical to SEQ ID NO: 38481

SEQ ID NO: 170707 - DNA, 601 bp, Human; identical to SEQ ID NO: 38482

SEQ ID NO: 170708 - DNA, 601 bp, Human; identical to SEQ ID NO: 38483

SEQ ID NO: 170709 - DNA, 601 bp, Human; identical to SEQ ID NO: 38484

SEQ ID NO: 170710 - DNA, 601 bp, Human; identical to SEQ ID NO: 38485

SEQ ID NO: 170711 - DNA, 601 bp, Human; identical to SEQ ID NO: 38486

SEQ ID NO: 170712 - DNA, 601 bp, Human; identical to SEQ ID NO: 38487

SEQ ID NO: 170713 - DNA, 601 bp, Human; identical to SEQ ID NO: 38488

SEQ ID NO: 170714 - DNA, 601 bp, Human; identical to SEQ ID NO: 38489

SEQ ID NO: 170715 - DNA, 601 bp, Human; identical to SEQ ID NO: 38490

SEQ ID NO: 170716 - DNA, 601 bp, Human; identical to SEQ ID NO: 38491

SEQ ID NO: 170717 - DNA, 601 bp, Human; identical to SEQ ID NO: 38492

SEQ ID NO: 170718 - DNA, 601 bp, Human; identical to SEQ ID NO: 38493

SEQ ID NO: 170719 - DNA, 601 bp, Human; identical to SEQ ID NO: 38494

SEQ ID NO: 170720 - DNA, 601 bp, Human; identical to SEQ ID NO: 38495

SEQ ID NO: 170721 - DNA, 601 bp, Human; identical to SEQ ID NO: 38496

SEQ ID NO: 170722 - DNA, 601 bp, Human; identical to SEQ ID NO: 38497

SEQ ID NO: 170723 - DNA, 601 bp, Human; identical to SEQ ID NO: 38498

SEQ ID NO: 170724 - DNA, 601 bp, Human; identical to SEQ ID NO: 38499

SEQ ID NO: 170725 - DNA, 601 bp, Human; identical to SEQ ID NO: 38500

SEQ ID NO: 170726 - DNA, 601 bp, Human; identical to SEQ ID NO: 38501

SEQ ID NO: 170727 - DNA, 601 bp, Human
atttatatgaggctgttgtcttttccttctgagcctgcctttctccccccacccaggagtatcctcttgccaaatcaaaagacttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatscctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccaca

SEQ ID NO: 170728 - DNA, 601 bp, Human; identical to SEQ ID NO: 38460

SEQ ID NO: 170729 - DNA, 601 bp, Human; identical to SEQ ID NO: 38461

SEQ ID NO: 170730 - DNA, 601 bp, Human; identical to SEQ ID NO: 38462

SEQ ID NO: 170731 - DNA, 601 bp, Human; identical to SEQ ID NO: 38463

SEQ ID NO: 170732 - DNA, 601 bp, Human; identical to SEQ ID NO: 38464

SEQ ID NO: 170733 - DNA, 601 bp, Human; identical to SEQ ID NO: 38465

SEQ ID NO: 170734 - DNA, 601 bp, Human; identical to SEQ ID NO: 38466

SEQ ID NO: 170735 - DNA, 601 bp, Human; identical to SEQ ID NO: 38467

SEQ ID NO: 170736 - DNA, 601 bp, Human; identical to SEQ ID NO: 38468

SEQ ID NO: 170737 - DNA, 601 bp, Human; identical to SEQ ID NO: 38469

SEQ ID NO: 170738 - DNA, 601 bp, Human; identical to SEQ ID NO: 38470

SEQ ID NO: 170739 - DNA, 601 bp, Human; identical to SEQ ID NO: 38471

SEQ ID NO: 170740 - DNA, 601 bp, Human; identical to SEQ ID NO: 38472

SEQ ID NO: 170741 - DNA, 601 bp, Human; identical to SEQ ID NO: 38473

SEQ ID NO: 170742 - DNA, 601 bp, Human; identical to SEQ ID NO: 38474

SEQ ID NO: 170743 - DNA, 601 bp, Human; identical to SEQ ID NO: 38475

SEQ ID NO: 170744 - DNA, 601 bp, Human; identical to SEQ ID NO: 38476

SEQ ID NO: 170745 - DNA, 601 bp, Human; identical to SEQ ID NO: 38477

SEQ ID NO: 170746 - DNA, 601 bp, Human; identical to SEQ ID NO: 38478

SEQ ID NO: 170747 - DNA, 601 bp, Human; identical to SEQ ID NO: 38479

SEQ ID NO: 170748 - DNA, 601 bp, Human; identical to SEQ ID NO: 38480

SEQ ID NO: 170749 - DNA, 601 bp, Human; identical to SEQ ID NO: 38481

SEQ ID NO: 170750 - DNA, 601 bp, Human; identical to SEQ ID NO: 38482

SEQ ID NO: 170751 - DNA, 601 bp, Human; identical to SEQ ID NO: 38483

SEQ ID NO: 170752 - DNA, 601 bp, Human; identical to SEQ ID NO: 38484

SEQ ID NO: 170753 - DNA, 601 bp, Human; identical to SEQ ID NO: 38485

SEQ ID NO: 170754 - DNA, 601 bp, Human; identical to SEQ ID NO: 38486

SEQ ID NO: 170755 - DNA, 601 bp, Human; identical to SEQ ID NO: 38487

SEQ ID NO: 170756 - DNA, 601 bp, Human; identical to SEQ ID NO: 38488

SEQ ID NO: 170757 - DNA, 601 bp, Human; identical to SEQ ID NO: 38489

SEQ ID NO: 170758 - DNA, 601 bp, Human; identical to SEQ ID NO: 38490

SEQ ID NO: 170759 - DNA, 601 bp, Human; identical to SEQ ID NO: 38491

SEQ ID NO: 170760 - DNA, 601 bp, Human; identical to SEQ ID NO: 38492

SEQ ID NO: 170761 - DNA, 601 bp, Human; identical to SEQ ID NO: 38493

SEQ ID NO: 170762 - DNA, 601 bp, Human; identical to SEQ ID NO: 38494

SEQ ID NO: 170763 - DNA, 601 bp, Human; identical to SEQ ID NO: 38495

SEQ ID NO: 170764 - DNA, 601 bp, Human; identical to SEQ ID NO: 38496

SEQ ID NO: 170765 - DNA, 601 bp, Human; identical to SEQ ID NO: 38497

SEQ ID NO: 170766 - DNA, 601 bp, Human; identical to SEQ ID NO: 38498

SEQ ID NO: 170767 - DNA, 601 bp, Human; identical to SEQ ID NO: 38499

SEQ ID NO: 170768 - DNA, 601 bp, Human; identical to SEQ ID NO: 38500

SEQ ID NO: 170769 - DNA, 601 bp, Human; identical to SEQ ID NO: 38501

SEQ ID NO: 170770 - DNA, 601 bp, Human; identical to SEQ ID NO: 170727

SEQ ID NO: 170771 - DNA, 601 bp, Human; identical to SEQ ID NO: 38460

SEQ ID NO: 170772 - DNA, 601 bp, Human; identical to SEQ ID NO: 38461

SEQ ID NO: 170773 - DNA, 601 bp, Human; identical to SEQ ID NO: 38462

SEQ ID NO: 170774 - DNA, 601 bp, Human; identical to SEQ ID NO: 38463

SEQ ID NO: 170775 - DNA, 601 bp, Human; identical to SEQ ID NO: 38464

SEQ ID NO: 170776 - DNA, 601 bp, Human; identical to SEQ ID NO: 38465

SEQ ID NO: 170777 - DNA, 601 bp, Human; identical to SEQ ID NO: 38466

SEQ ID NO: 170778 - DNA, 601 bp, Human; identical to SEQ ID NO: 38467

SEQ ID NO: 170779 - DNA, 601 bp, Human; identical to SEQ ID NO: 38468

SEQ ID NO: 170780 - DNA, 601 bp, Human; identical to SEQ ID NO: 38469

SEQ ID NO: 170781 - DNA, 601 bp, Human; identical to SEQ ID NO: 38470

SEQ ID NO: 170782 - DNA, 601 bp, Human; identical to SEQ ID NO: 38471

SEQ ID NO: 170783 - DNA, 601 bp, Human; identical to SEQ ID NO: 38472

SEQ ID NO: 170784 - DNA, 601 bp, Human; identical to SEQ ID NO: 38473

SEQ ID NO: 170785 - DNA, 601 bp, Human; identical to SEQ ID NO: 38474

SEQ ID NO: 170786 - DNA, 601 bp, Human; identical to SEQ ID NO: 38475

SEQ ID NO: 170787 - DNA, 601 bp, Human; identical to SEQ ID NO: 38476

SEQ ID NO: 170788 - DNA, 601 bp, Human; identical to SEQ ID NO: 38477

SEQ ID NO: 170789 - DNA, 601 bp, Human; identical to SEQ ID NO: 38478

SEQ ID NO: 170790 - DNA, 601 bp, Human; identical to SEQ ID NO: 38479

SEQ ID NO: 170791 - DNA, 601 bp, Human; identical to SEQ ID NO: 38480

SEQ ID NO: 170792 - DNA, 601 bp, Human; identical to SEQ ID NO: 38481

SEQ ID NO: 170793 - DNA, 601 bp, Human; identical to SEQ ID NO: 38482

SEQ ID NO: 170794 - DNA, 601 bp, Human; identical to SEQ ID NO: 38483

SEQ ID NO: 170795 - DNA, 601 bp, Human; identical to SEQ ID NO: 38484

SEQ ID NO: 170796 - DNA, 601 bp, Human; identical to SEQ ID NO: 38485

SEQ ID NO: 170797 - DNA, 601 bp, Human; identical to SEQ ID NO: 38486

SEQ ID NO: 170798 - DNA, 601 bp, Human; identical to SEQ ID NO: 38487

SEQ ID NO: 170799 - DNA, 601 bp, Human; identical to SEQ ID NO: 38488

SEQ ID NO: 170800 - DNA, 601 bp, Human; identical to SEQ ID NO: 38489

SEQ ID NO: 170801 - DNA, 601 bp, Human; identical to SEQ ID NO: 38490

SEQ ID NO: 170802 - DNA, 601 bp, Human; identical to SEQ ID NO: 38491

SEQ ID NO: 170803 - DNA, 601 bp, Human; identical to SEQ ID NO: 38492

SEQ ID NO: 170804 - DNA, 601 bp, Human; identical to SEQ ID NO: 38493

SEQ ID NO: 170805 - DNA, 601 bp, Human; identical to SEQ ID NO: 38494

SEQ ID NO: 170806 - DNA, 601 bp, Human; identical to SEQ ID NO: 38495

SEQ ID NO: 170807 - DNA, 601 bp, Human; identical to SEQ ID NO: 38496

SEQ ID NO: 170808 - DNA, 601 bp, Human; identical to SEQ ID NO: 38497

SEQ ID NO: 170809 - DNA, 601 bp, Human; identical to SEQ ID NO: 38498

SEQ ID NO: 170810 - DNA, 601 bp, Human; identical to SEQ ID NO: 38499

SEQ ID NO: 170811 - DNA, 601 bp, Human; identical to SEQ ID NO: 38500

SEQ ID NO: 170812 - DNA, 601 bp, Human; identical to SEQ ID NO: 38460

SEQ ID NO: 170813 - DNA, 601 bp, Human; identical to SEQ ID NO: 38461

SEQ ID NO: 170814 - DNA, 601 bp, Human; identical to SEQ ID NO: 38462

SEQ ID NO: 170815 - DNA, 601 bp, Human; identical to SEQ ID NO: 38463

SEQ ID NO: 170816 - DNA, 601 bp, Human; identical to SEQ ID NO: 38464

SEQ ID NO: 170817 - DNA, 601 bp, Human; identical to SEQ ID NO: 38465

SEQ ID NO: 170818 - DNA, 601 bp, Human; identical to SEQ ID NO: 38466

SEQ ID NO: 170819 - DNA, 601 bp, Human; identical to SEQ ID NO: 38467

SEQ ID NO: 170820 - DNA, 601 bp, Human; identical to SEQ ID NO: 38468

SEQ ID NO: 170821 - DNA, 601 bp, Human; identical to SEQ ID NO: 38469

SEQ ID NO: 170822 - DNA, 601 bp, Human; identical to SEQ ID NO: 38470

SEQ ID NO: 170823 - DNA, 601 bp, Human; identical to SEQ ID NO: 38471

SEQ ID NO: 170824 - DNA, 601 bp, Human; identical to SEQ ID NO: 38472

SEQ ID NO: 170825 - DNA, 601 bp, Human; identical to SEQ ID NO: 38473

SEQ ID NO: 170826 - DNA, 601 bp, Human; identical to SEQ ID NO: 38474

SEQ ID NO: 170827 - DNA, 601 bp, Human; identical to SEQ ID NO: 38475

SEQ ID NO: 170828 - DNA, 601 bp, Human; identical to SEQ ID NO: 38476

SEQ ID NO: 170829 - DNA, 601 bp, Human; identical to SEQ ID NO: 38477

SEQ ID NO: 170830 - DNA, 601 bp, Human; identical to SEQ ID NO: 38478

SEQ ID NO: 170831 - DNA, 601 bp, Human; identical to SEQ ID NO: 38479

SEQ ID NO: 170832 - DNA, 601 bp, Human; identical to SEQ ID NO: 38480

SEQ ID NO: 170833 - DNA, 601 bp, Human; identical to SEQ ID NO: 38481

SEQ ID NO: 170834 - DNA, 601 bp, Human; identical to SEQ ID NO: 38482

SEQ ID NO: 170835 - DNA, 601 bp, Human; identical to SEQ ID NO: 38483

SEQ ID NO: 170836 - DNA, 601 bp, Human; identical to SEQ ID NO: 38484

SEQ ID NO: 170837 - DNA, 601 bp, Human; identical to SEQ ID NO: 38485

SEQ ID NO: 170838 - DNA, 601 bp, Human; identical to SEQ ID NO: 38486

SEQ ID NO: 170839 - DNA, 601 bp, Human; identical to SEQ ID NO: 38487

SEQ ID NO: 170840 - DNA, 601 bp, Human; identical to SEQ ID NO: 38488

SEQ ID NO: 170841 - DNA, 601 bp, Human; identical to SEQ ID NO: 38489

SEQ ID NO: 170842 - DNA, 601 bp, Human; identical to SEQ ID NO: 38490

SEQ ID NO: 170843 - DNA, 601 bp, Human; identical to SEQ ID NO: 38491

SEQ ID NO: 170844 - DNA, 601 bp, Human; identical to SEQ ID NO: 38492

SEQ ID NO: 170845 - DNA, 601 bp, Human; identical to SEQ ID NO: 38493

SEQ ID NO: 170846 - DNA, 601 bp, Human; identical to SEQ ID NO: 38494

SEQ ID NO: 170847 - DNA, 601 bp, Human; identical to SEQ ID NO: 38495

SEQ ID NO: 170848 - DNA, 601 bp, Human; identical to SEQ ID NO: 38496

SEQ ID NO: 170849 - DNA, 601 bp, Human; identical to SEQ ID NO: 38497

SEQ ID NO: 170850 - DNA, 601 bp, Human; identical to SEQ ID NO: 38498

SEQ ID NO: 170851 - DNA, 601 bp, Human; identical to SEQ ID NO: 38499

SEQ ID NO: 170852 - DNA, 601 bp, Human; identical to SEQ ID NO: 38500

SEQ ID NO: 170853 - DNA, 601 bp, Human
ccggcggcttcggccgccttgccctccctttgggcccctggccctcgggcctgccgggccctccgctgcccttcgcctcttgtctcagcagctgcagggcgagtctggtccggaccaagactcagccggtccagtccttgggcaatctctggcctggcgctgggctgcccggagtggggtggtggggggcgggtggcgttcacaacctcatgccacgggccgcacgccccggcgcctgttccgggcttccccaggtatctcgggtggctgctggcctcggcgctgcggagcggctttcccyggtggcggaggcgccggcactttcccccactttcaagcggtccggatcctcatctttgtctggtcgccgcgtaattcgcgcatccttattcagatttggtgacgtggcgctgcacgtagggggcccagcggccaatgggcgcaccgtggccatggcaacctcttaaatttatagcatatctaaattggctacagcgttgctgtccggacagagcaaaaaaaacaaggcatcagtattgttgagtattagcttgtacctggttcggaggctaagtaagtatttaccttccagtttggggct

SEQ ID NO: 170854 - DNA, 601 bp, Human
agggcattagaagccataagtcacttttggccttatccggcagcgtaattggccatatgcaccttatcaaaaatcattaggcactttgcaagcactgctacattaggggcatcgggcctccgggtccagggagttaacacgtgtaaaggagcggctgacattttctcccattcaaattctcagtgcggagtcgctggggccggcaggctgcctttctctgtggcgtgattcacgcccccattcctcagcgcggggaattcctgttcacaaagccggctctgggtgcccagaggaaacaggyagggctcagctgccccaaactccagtggcttccaggctggggaaactgaggcccagagaggtgatctgccctggccagccacagggcccacaggggtaggggggctggggaggtgccacagcccagtctagaccccagaggtcctgattctcagcctcgatttcgtttctacttttcaacatgggaggaaatgtttaaggggttgggaggtgggtgggggaggttctctcctcccatcaccaggggagaccttcctcgctgggccccctctggagctgagaagtttctgtttgggattgc

SEQ ID NO: 170855 - DNA, 601 bp, Human
gggcctcatagtgatggaccctagagagcagggatgagtttcagcccccctaaacctctggcctggcaggcagcaggggaatgtgaatagaggacaatcatagatcctgcaaggccaggacaggaatctctcaaatccccgctttcccgcgttcctgatctcattccttttctttcttctttgagctcagggagaaagccagcctcccccgaaataggagatgggtgaggctcaggttgggggtggggtgggggaggacccaggactctagggaccccacatctactcacacccatgtctstaaacagggcgaatttgggtgacattgatgtagtgagggcattagaagccataagtcacttttggccttatccggcagcgtaattggccatatgcaccttatcaaaaatcattaggcactttgcaagcactgctacattaggggcatcgggcctccgggtccagggagttaacacgtgtaaaggagcggctgacattttctcccattcaaattctcagtgcggagtcgctggggccggcaggctgcctttctctgtggcgtgattcacgcccccattcctcagcgcggggaattcctgtt

SEQ ID NO: 170856 - DNA, 601 bp, Human
cccgctggattccctcccaaacctgcgacagcccctcccccagggacccggtgcccgcccactctctccaggcggggctgggcctttggaggggcgctcttaagccctctccgcgcgtctcagctagtacctgggtaagggtagggggacgcgtaccctctggagaactcccactttcaaggagaggggacaaggagggcacagattcccttggggcttggatcttcctctctcttccctcctctctccagacctcaattaatgtccttccagtgcatcaagaaattacctggagctcaartgacacataagggggaattgtgcgcttccaaattaggggaggagggcaacttggaaaaggctcctgaattggaggagggtgaggcagagctggcaggtctcagatcccctgtaaaacctgctccaaagccacttctcttctctagcctctaacccccttgccttgccctagaactgcctggggctgatgagctccaagctcagcacagacagcacaccgggggccaagtagggagtgccaggctgggcacggtgggagggtgctaaggcctaaggctagtgaggggcccaggcttcctac

SEQ ID NO: 170857 - DNA, 601 bp, Human
tgaacccaggatcaggagtgtcctctccccccctcttctcccttccctgactgggctgcccctgctgggtccttgcgcctcttccgcaccaggactcccccgaggcggggccgggccggattaggccgggaggggtggagagaggcttcggcgaaccagccaagggtgaaggatttcgcggacccgtggggcgactcataaagacttgggcttcctggtccccggctcgcccgcggcctgacggctctataaaggcctccctcccggcacggctctcgcctcggcccctcggctccggagycagcctctggccgtttgtctgcccgcgcttcggcgcagggagggagggggcatcgcctgtttctctgctcgaaaggtggaggtaaagagggatcccggaccccagagaggcttacaaccttccataagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagcca

SEQ ID NO: 170858 - DNA, 601 bp, Human
caccccaggcccaagcctggtaccaccatctgaagccctttgtaaactggggctcctcgctctctgcagccccaaagacggtggaaatctggggttggcccaacacttgtgcccccagtctgtaggaaccccaggggtctcggggctggagggtggactacagtcctgcccagagcaactgccggcatttgggctaacactgccagatgctgtgcgcacacaccccgccacatggaacaggagttgctgccttcgatgctagtgagcaggcggcttggaatgaatccagacccccatcccstcccctcacactaccctccagcgctcggaatccacctcatgccaagtacaccaggcacagggcggcaggaaggctgtgcgtctgtccgtgggggccgcatgcatgtggatttgccagtactggcctcagtgtgactggtgggagtgtgcgcgtctgtggagttgtgtctccgtgagtgtacctgtgtgtgagagggtggaatttacctatacgtgatcgtgcgatcgtgtctagacgtgtgtccctggagtctctgaacgcaagtgtgagtgcaccttgtgccctgcgtgggtgaatgtg

SEQ ID NO: 170859 - DNA, 601 bp, Human
gagtcttccccaccattacggggaacgaggggcccccagtatccagctccccacctcatccagcgcgcagggagaggaggcggtgggataggtcggggcgggggcgaagtggtcctcggggaaaccttggttaattatccaggcggggaaaaattccgggccggtaccgcccccactacctcgctgctccgggcccagattttgtagggaaagaggcaaatttaggtggagagagtcggtgagtggagactccggaagacacgcccaccatccgggctctccagggttgggggtctgtccrgggttgggggtctgtccagggttggggggctgtccagggttgggcggctggggcgctccagcctgagccctgccactgcctggggtctctgccctgaaaagcacagcctggcattttgcccacaatttctaggggccccggtccggtctcaaggtctaatcccccctcaggcttccggatgtgctgaggttagtgatggggttatcttcccttcccttctgcgtctacctgggtgcctagctcctgccttgctaacactgccactgaacccactttctaagagaaattgcctcttcctaa

SEQ ID NO: 170860 - DNA, 601 bp, Human
gcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcrgtgggataggtcggggcgggggcgaagtggtcctcggggaaaccttggttaattatccaggcggggaaaaattccgggccggtaccgcccccactacctcgctgctccgggcccagattttgtagggaaagaggcaaatttaggtggagagagtcggtgagtggagactccggaagacacgcccaccatccgggctctccagggttgggggtctgtccggggttgggggtctgtccagggttggggggctgtccagggttgggcggctggggcgctccagcctgagccctgccactgcct

SEQ ID NO: 170861 - DNA, 601 bp, Human
ggcaggcctggctcggggctcggtgtgtccgggtgcgagatcatgtcggtgaacctggggttgtccgcggcgtgcgggccggcgagcggcggttccagcgctcccagcggcgtcgagccggggccagaggccgccaggaagctggagtcggccggggactgcgcctgcgaaggcgggccgtgcgcgaagaagtcgtagttgcttcccggcgcgtagtagtcgccttggtagtctgcggagggggagcgggaaggagacagggcgcggtgagagaaggcgaagtaggcgggggacccgggayccggggaggggacccgggcgggcgagagaggggagcgcgcgacaccgacccaaggttagagagacctgcggaggccggcgccccttgagacggtggacgtcgcaggctcacggggagggttggggagagagacaatgagagatctcgaaagggcaagagactcagactgccagagaccacacacagagacgggagagactccgagaccgtgggggacacacgcggcaaaaactcggagacttcagtcacaggttccctgacacctagagatggagagagacagaggcggccagagacgca

SEQ ID NO: 170862 - DNA, 601 bp, Human; identical to SEQ ID NO: 29321

SEQ ID NO: 170863 - DNA, 601 bp, Human; identical to SEQ ID NO: 29322

SEQ ID NO: 170864 - DNA, 601 bp, Human; identical to SEQ ID NO: 29323

SEQ ID NO: 170865 - DNA, 601 bp, Human; identical to SEQ ID NO: 29324

SEQ ID NO: 170866 - DNA, 601 bp, Human; identical to SEQ ID NO: 29325

SEQ ID NO: 170867 - DNA, 601 bp, Human; identical to SEQ ID NO: 29326

SEQ ID NO: 170868 - DNA, 601 bp, Human; identical to SEQ ID NO: 29327

SEQ ID NO: 170869 - DNA, 601 bp, Human
aagatagacaactataaaaattctaactatgcaaggtaataattctatgctgggaaacaggacgcatgtgaatatgtgatacatgggagcctttcctggctgaatccaaggtcaatcattcattcggtgaaaagctgaaccttaatggattagtttctttcttagaatgaacttttacagacatgtttttcaaactcaagtccaatgggctatgataatccactgtcccataacactgtcccatgtcccaagtcacggcaagtggaaacacctaccccaacaacaagcccaagacaaaatrgcagcaaagactgttactacctacctgattgaggacagggaaggaggtatgcagcgactagattctgtcctgttgcactgacccaagcaatcagactcttgcagcagatctcctcccaataaaactttcatgccatagaccaggggtgacccaatccaacaacagcagagacaggttttaggttacatttctccctcaccgggacggccttactatttcttctcactcctgaccacataccacaatcctccacctccaccaccacattcctcctggcctggaaagatggagacccgcctt

SEQ ID NO: 170870 - DNA, 601 bp, Human
cctgacaccacacatatacatatattggtccctcctccaaactctccaggatcccaattcatatataacactttgaaagacttaggtctgatggagagacccctttgcccacaatggggaagcaggaaatctgggactgcagataatgactctgtgttctagtaatatttttctttttgggtcttaagtttccattatctatgcctattctgtgcctcttaggaaggcagagacacaaaaacttcttaattacaaaggctaagggtctttgtacccttgctaagctatttccaggcacttytgctgacagccaagccatctcttgccctttccttaaactacagttagaaagcttgttgagttctatctatttacattctaaattcatcatgggtacctactgtttgcatgggcattgtggaagaggagacgaaatccagttcctgcagtcgaaaagcgtctagtctctttggaaaagcaagatagacaactataaaaattctaactatgcaaggtaataattctatgctgggaaacaggacgcatgtgaatatgtgatacatgggagcctttcctggctgaatccaaggtcaatcattca

SEQ ID NO: 170871 - DNA, 601 bp, Human
agtacaggatggcttgaggccagctcgaggctgcagtgagttatgatcacaccactgccctccagcctgggtggataaaaataaaggtatatagggaagcagattctacaatttccttcagttacatactcaactttaaccaacctggttttaaagaagttcctccttctaaccaataaatcccaccctctatcctgagtccacttcctcttattatgactctagtgtaaaagagtagggtgaacacacactacaatatgactctttgtgcacttagtatttcactcacttccactctttscagtctgctctcctttatacttgcattcagtataataatagcagctaccattcactggtaccaattctgtacctgacaccacacatatacatatattggtccctcctccaaactctccaggatcccaattcatatataacactttgaaagacttaggtctgatggagagacccctttgcccacaatggggaagcaggaaatctgggactgcagataatgactctgtgttctagtaatatttttctttttgggtcttaagtttccattatctatgcctattctgtgcctcttaggaaggca

SEQ ID NO: 170872 - DNA, 601 bp, Human
aaaagtaaaaaaaaaaattcgctgggcatggtggcacacgcatgtggtcccagctacttgagaagctgaagtacaggatggcttgaggccagctcgaggctgcagtgagttatgatcacaccactgccctccagcctgggtggataaaaataaaggtatatagggaagcagattctacaatttccttcagttacatactcaactttaaccaacctggttttaaagaagttcctccttctaaccaataaatcccaccctctatcctgagtccacttcctcttattatgactctagtgtaaamgagtagggtgaacacacactacaatatgactctttgtgcacttagtatttcactcacttccactctttccagtctgctctcctttatacttgcattcagtataataatagcagctaccattcactggtaccaattctgtacctgacaccacacatatacatatattggtccctcctccaaactctccaggatcccaattcatatataacactttgaaagacttaggtctgatggagagacccctttgcccacaatggggaagcaggaaatctgggactgcagataatgactctgtgttct

SEQ ID NO: 170873 - DNA, 601 bp, Human
atccctactttagtcagttctttaccagactataatatgaaaccttcaaacatctgtgggaccctttccaaacgctcctcatgtcttttcattatcaaatagttttattagcactctatctatatttgcaacagatgttcaagtgaagaaggtacggtagacagataattctacagatatcacaatttctaggccatgatattctgaaacagatactcaaaagcagacattttttattaagattggactaaatgaaaagagtggactaaatgaagatccccatatactgactgagacctamaataagggcatctaggaatctaaatccctgacctaggtcatcagggtgctcttttctggaagagtgaaccattatctcagagtcacactgacttttctaatatgaatactattcttgtgcccccatatcttcaccctacatccaaattgatggttcagggcccctgccttgctccagcttcacctcccactcaggcagcaggagctgtctctgcgatgctgatgctgaagctgaaaaaagatttcgctgctcataagcctacgaccagcacagaaactcatggtaacaatcatccctcta

SEQ ID NO: 170874 - DNA, 601 bp, Human
attcacgcttgacactcctgtgcataagctaataaaggaaggattatgccaggctttcagcagtaatgggagaactaaaaggtaccaagagacctgccacacccagtcatctcaactttcttcaggaatatggtaataatggtggatctctaacattctgagccatttcctttctggtccacatggtgtggcagatcctttgcataagtccatggtaaagctctaacacattcatgaaatccctactttagtcagttctttaccagactataatatgaaaccttcaaacatctgtgggacyctttccaaacgctcctcatgtcttttcattatcaaatagttttattagcactctatctatatttgcaacagatgttcaagtgaagaaggtacggtagacagataattctacagatatcacaatttctaggccatgatattctgaaacagatactcaaaagcagacattttttattaagattggactaaatgaaaagagtggactaaatgaagatccccatatactgactgagacctaaaataagggcatctaggaatctaaatccctgacctaggtcatcagggtgctcttttctggaag

SEQ ID NO: 170875 - DNA, 601 bp, Human
ataaataggccgggcgcggtggctcatgcctataatcccagcacattggaaggccaaggcgggcgggtcacctgagatcgggagttcgagaccagcctaaccaacatggagaaaccctgtctctactaaaagtactaaattagccaggcgtggtggcgcacgcctgtaatcccagctactccataagctgaggcaggagaatggtttgaacctgcgaggtggaggctgctgtgagccaagatcgtgccattgcactccaggctgggcaacaagagcgaaactccgtctcaaaaaaaaaaaytaattaaaataaataaataaataaataaaatagcgggcagaaaagcaggccaggaaagaataagaagcaaccagagaggcagaagggaaatcaagagagcaagacatcatagacaccaatggggatagaacatacaaaagaaaagagggaggatccaaagctagagttttggtgtaaactaaaacgtacctaactaaataagttcctattagctcaattagtggtgtttaggctcaggccagaattgttatgccagcttcccatctaggcaaagaacaatcctggaaaagactccaggac

SEQ ID NO: 170876 - DNA, 601 bp, Human
aaataaataaataaataataaataggccgggcgcggtggctcatgcctataatcccagcacattggaaggccaaggcgggcgggtcacctgagatcgggagttcgagaccagcctaaccaacatggagaaaccctgtctctactaaaagtactaaattagccaggcgtggtggcgcacgcctgtaatcccagctactccataagctgaggcaggagaatggtttgaacctgcgaggtggaggctgctgtgagccaagatcgtgccattgcactccaggctgggcaacaagagcgaaactcygtctcaaaaaaaaaaactaattaaaataaataaataaataaataaaatagcgggcagaaaagcaggccaggaaagaataagaagcaaccagagaggcagaagggaaatcaagagagcaagacatcatagacaccaatggggatagaacatacaaaagaaaagagggaggatccaaagctagagttttggtgtaaactaaaacgtacctaactaaataagttcctattagctcaattagtggtgtttaggctcaggccagaattgttatgccagcttcccatctaggcaaagaacaatcct

SEQ ID NO: 170877 - DNA, 601 bp, Human
caagagatcctcccacctcaacctcccaagtagctagaactacaggtgtgcatcaccatgcctggctaatttttaaagtttttttgtagagacaaggtcttgctatgttacccaggctggtctcgaactcctgacctcaagcagtcctcccacctcagcctcccaaagtactgagatgacaggcatgagccattgtgcctggcccctcaatcttagaaaaggacctatggcaatgttctcttgtccagcctttggatgttgatgatgtagaaggatgagaagctagaataatctggagacyataaagagagggagacagacattaaaaactccaggatgtcagagcagaaaaatgggaaaaactcagttgggtccttaattacagtatcaagctggtaaactaaactttttcttttttagagatggggtcccactatgttgcccacgatgaaatacaatggctattcacaggtgccctcatggtgcgctacagcctcaaattcttgggctcacgcaatcctgagtaactgggactataggcatgcaccaccacgcctggcatctttcgttttctgagatgggtcttgctctgtcacccaag

SEQ ID NO: 170878 - DNA, 601 bp, Human
aaaaaaaaaaagctgggtgtggtggtgcacgcctgtagtcccaactactcaggaggctgagacaagagaatcacctgagcccaggaagttgtggctgcagtgagccatgatcacgccactgcactccagcccaggtgacagagtgagagaatatgtctcaaaaaaaaagaaaaagaaaaaaagacctaagtttcagatagcactttaaaaaaatttatatgatctttttttttttttttaaagagatgaggtctcactctgtcacccaggctcactgcagcatccaaatcctgggctcaarcaatcctactgcctcagcttccccagtagctaaaaagacctacgggcccaaatcatcgtgacgcagctaacttttttatttttatttttggtagagatagagtctcactttgttgaccaggttggtctcgaacttctgacttcaaacgatcctccagtctcagcctcctaaagtgaagagtacaggcaaggtgtggtagctcacgcctgtaatcccagcactttgggaggccgaggtgggcggatcacaaggtcagaagatcaagatcagcctggccaacatggtaaaaccccgtctcta

SEQ ID NO: 170879 - DNA, 601 bp, Human
gccaggagttcaaggccagcctgggcaacatggcaaaagcccatcgctacaaaaaaaaaaaaaaaagctgggtgtggtggtgcacgcctgtagtcccaactactcaggaggctgagacaagagaatcacctgagcccaggaagttgtggctgcagtgagccatgatcacgccactgcactccagcccaggtgacagagtgagagaatatgtctcaaaaaaaaagaaaaagaaaaaaagacctaagtttcagatagcactttaaaaaaatttatatgatctttttttttttttttaaagagwtgaggtctcactctgtcacccaggctcactgcagcatccaaatcctgggctcaagcaatcctactgcctcagcttccccagtagctaaaaagacctacgggcccaaatcatcgtgacgcagctaacttttttatttttatttttggtagagatagagtctcactttgttgaccaggttggtctcgaacttctgacttcaaacgatcctccagtctcagcctcctaaagtgaagagtacaggcaaggtgtggtagctcacgcctgtaatcccagcactttgggaggccgaggtgggcggat

SEQ ID NO: 170880 - DNA, 601 bp, Human
gattctgaattaaatttatgccacacatttatcttgctgtcctttatgactgaaactattgctgattaaatgcttaccaactgtgagtatagtggtggctgaaaaagatataactagccaatatgccttgccccagaacacaggtacactgtcctttgatttgcttctttgctcggctgtcatgctgaagtcctggttcaaaagctgatcccagtgttacacctattatttcctggcatgccacatcaaggccttactttgaatgaccttaaccactcaatgtggcacttactaccttgtsgagtttttcttcttttataagtctgtgtatttactgcttcccacgttaagctgtgtattccctatgtgcaaagactatgtctacttattttgaatctgtcctccctctagtgccaagtagattgtgggagttcaattaagcacattggctgatttaagcctcatctgaggatgtccttatattatttcttctgtccagtaggatttggtatctctgtgtaatgcacagcgagttgcttagctatcctgtccattctcagccattttccacacatatttgacgcaggactggtttgggaac

SEQ ID NO: 170881 - DNA, 601 bp, Human
acacacacaccccaaactcagcagccaaagggacaggtcaagacaaagtgcgcccaaacccaagaatgtgaaaggtggacggggaggaatcctatttacaagctaacgcatgggggtttggtgggagtttggttgtttttacaaaaacttctgacatttcccccaccacccttctcagtttgcagcaaattccagactagtgcaactgagccagatcaacagtccctgaagaccaaagtactagtttgtccgaaaaaacagaaacaatgagtgcttatgaagtgtttcatcttcaaaaggsctccccagacagccactaatgagccaggcgtggcactctcagtaggttccccagatgagccctacccctgacctagagggttcacacaccaggaagaagggctagctcaaccttagggttcaacttcagtcaagccacccgctagccttcctccctactcttcctgcctcaacccacccaggtggacagactcctgaggacccctgagcgacctacccagctaagaacagctctcaccaaccttggcaatttgtagtagtgacttttggtcatactactaacacctcatgaaatttaaac

SEQ ID NO: 170882 - DNA, 601 bp, Human
ctcaccccagccattgccccaacagacagaatcagattcattcattcattccctttcttcttccctctcttctctatggcacaggatagccacagaaatgcatctttgaaacaataataaaatgaggattcagaatcacccatacaaaccagttctctgtgcctgcaggaggcatgtgtcagcgggcagcttattcagcaatcaccatatgccagctgctggcattctctagagtctgggaaccagagacacacacacaccccaaactcagcagccaaagggacaggtcaagacaaagtgygcccaaacccaagaatgtgaaaggtggacggggaggaatcctatttacaagctaacgcatgggggtttggtgggagtttggttgtttttacaaaaacttctgacatttcccccaccacccttctcagtttgcagcaaattccagactagtgcaactgagccagatcaacagtccctgaagaccaaagtactagtttgtccgaaaaaacagaaacaatgagtgcttatgaagtgtttcatcttcaaaaggcctccccagacagccactaatgagccaggcgtggcactctcagtaggttcc

SEQ ID NO: 170883 - DNA, 601 bp, Human
aaaactgaactaatccccagggtctctactgactttactgaaagctcactcagactggatgctatgcctggcatatggtaggcacataacaaatacctgctgaggccgagcgcagtggctcacgcctgtaatcccagcactttgggaggcccaggcgggtggatcacctgaggtcaggagtttgagaacagcctagccaacatggtaaaaccccatctctactaaaaatacaaaaactagccgggcatggtggcacactcctgtagtcccagctactcggaacgttgaggcaggagaatcrcttgaacctggaaggtggaggttgcagtgagccgagatcacgccactgcgctccagcctgggtgacagggcgagaatccatctcaaaataataataataatagtaataacaacaacaaatacctgctgaaaggatgaacaggaccaaaagaatcattatgaaggtataaaatgtctatctgctcaccccagccattgccccaacagacagaatcagattcattcattcattccctttcttcttccctctcttctctatggcacaggatagccacagaaatgcatctttgaaacaataata

SEQ ID NO: 170884 - DNA, 601 bp, Human
agcacacagtacttcaaaaactgaactaatccccagggtctctactgactttactgaaagctcactcagactggatgctatgcctggcatatggtaggcacataacaaatacctgctgaggccgagcgcagtggctcacgcctgtaatcccagcactttgggaggcccaggcgggtggatcacctgaggtcaggagtttgagaacagcctagccaacatggtaaaaccccatctctactaaaaatacaaaaactagccgggcatggtggcacactcctgtagtcccagctactcggaacgytgaggcaggagaatcgcttgaacctggaaggtggaggttgcagtgagccgagatcacgccactgcgctccagcctgggtgacagggcgagaatccatctcaaaataataataataatagtaataacaacaacaaatacctgctgaaaggatgaacaggaccaaaagaatcattatgaaggtataaaatgtctatctgctcaccccagccattgccccaacagacagaatcagattcattcattcattccctttcttcttccctctcttctctatggcacaggatagccacagaaatgcat

SEQ ID NO: 170885 - DNA, 601 bp, Human
aatcctcctgccttagcctcccagggcactgggattacaagcatgagccaccatgcctggcccaaagctttcatatttgctatcacctctgcctggaatgcttctcttccagataaccatcatagattactccttcacctccttcagttagttgtctgtttcaatgtcacctaccaaagaggcctcccacaaccacatgtataacacacacacacagacacacaccactccctaccccatttatcccactttacttttcttcacaacatttatcaccatctgatacattatatatttattkcttgctgattgttttattctgcctaagatatcagctccttatgtgttttgttcactgctctgtctccagtaccaagaatagtgcctagcacacagtacttcaaaaactgaactaatccccagggtctctactgactttactgaaagctcactcagactggatgctatgcctggcatatggtaggcacataacaaatacctgctgaggccgagcgcagtggctcacgcctgtaatcccagcactttgggaggcccaggcgggtggatcacctgaggtcaggagtttgagaacagcctagcc

SEQ ID NO: 170886 - DNA, 601 bp, Human
gacttctggcaagggtgggagaggagggagcggaataaggagtggctctctgtgactcctgacaaggttcaggcttgccagtttcccaaggtttatgctttctcctttaatcaagagactctgcctcttcccttcctatatttttgcaactccatctttcttccacaccaaaataaaggaggaataagaaagccgcactcttaaaagaagccgatcctttacactctgtggaatgccagctgctaatgttgtgccctgttcaaacaacagtgcactggcagtagagaggtggggtatggcrgggctacccctttactcctcagctaggtgcatccttggcttactgtggcccatccaaggagggggctgtcccacatggtcgctgcaatgaggcagtcatctcattggttctctgcttcttccctaagcctttcggcctattctccatatagcatctagggtggttttaaaaccaaactcaggtcatatgagtcctttgttcaaaacccactcgtggcttcatagctccttttcagtaaaacccaaggcccaaaccatggcttacaaggtcctacaagacctacactcccctacttctctc

SEQ ID NO: 170887 - DNA, 601 bp, Human
ctagacaaaggaaatgtaaaatcataccatcatttgcttgtcaggacttccaagtaaatagaatttcccaaggtcatggctagagttcattcatgacaaacggagagcctgaggggactataaataccaaggcccactcagatacatactgagtctttgggaacagagacaaagcagtaaacactaaggatccctgctctgccagtaatctaaccatgtgactctgggcaagttacttcacttttccatatctgcacctgtaaatggaagggggattgaactagatgatttctgaagtccyttcagttctgacattctaccctatacccaaaggcattgtaagatcattaatgcccctccctcccctaaccttacttaccctgagacttctggcaagggtgggagaggagggagcggaataaggagtggctctctgtgactcctgacaaggttcaggcttgccagtttcccaaggtttatgctttctcctttaatcaagagactctgcctcttcccttcctatatttttgcaactccatctttcttccacaccaaaataaaggaggaataagaaagccgcactcttaaaagaagccgatcc

SEQ ID NO: 170888 - DNA, 601 bp, Human
cctgcctcagctgccggcgtgaaagcccacatccaagctgtgctcttaccaatggtagggatggtggtgacgatctcccccagtttcagcttgtataggatggtggtctttcctgcggcatccaggcccaccatcaggatgcgcatctccttcttcccaatcaggctcttgagaaggtttccaaagatattgcccatgatcacagcagctgctttctggggacagtggggcccaagtaggggcagtggcagtctggttttggcctggtccctggtatggaagacttgatcctagacaaagsaaatgtaaaatcataccatcatttgcttgtcaggacttccaagtaaatagaatttcccaaggtcatggctagagttcattcatgacaaacggagagcctgaggggactataaataccaaggcccactcagatacatactgagtctttgggaacagagacaaagcagtaaacactaaggatccctgctctgccagtaatctaaccatgtgactctgggcaagttacttcacttttccatatctgcacctgtaaatggaagggggattgaactagatgatttctgaagtcccttcagttctg

SEQ ID NO: 170889 - DNA, 601 bp, Human
aggcagagccagctgacaatgctgactggagcccccatctacatagcaaatgtagggagacctcccttcagcaaactgtaaccaagattggccaccaaagatctaaacccaagtaattccaagcctttggcaggaacatcaaagccttttacctgctttccaaacaacacagagaagaaaccaactccgtgcctgagggcagctgttgagtgccaggccatggaagttcccgcatcagggagagccaggttaggtgggcaaacagcagcctcagcacctggtagtaagctaaacaacaccrccctcttttctgaaccccacaaattgtatggacttgcctggggagaagaggccaggttggggaaccaggaataggtccctgccctgcctcagctgccggcgtgaaagcccacatccaagctgtgctcttaccaatggtagggatggtggtgacgatctcccccagtttcagcttgtataggatggtggtctttcctgcggcatccaggcccaccatcaggatgcgcatctccttcttcccaatcaggctcttgagaaggtttccaaagatattgcccatgatcacagcagctgctttctg

SEQ ID NO: 170890 - DNA, 601 bp, Human
aaggcagagccagctgacaatgctgactggagcccccatctacatagcaaatgtagggagacctcccttcagcaaactgtaaccaagattggccaccaaagatctaaacccaagtaattccaagcctttggcaggaacatcaaagccttttacctgctttccaaacaacacagagaagaaaccaactccgtgcctgagggcagctgttgagtgccaggccatggaagttcccgcatcagggagagccaggttaggtgggcaaacagcagcctcagcacctggtagtaagctaaacaacacygccctcttttctgaaccccacaaattgtatggacttgcctggggagaagaggccaggttggggaaccaggaataggtccctgccctgcctcagctgccggcgtgaaagcccacatccaagctgtgctcttaccaatggtagggatggtggtgacgatctcccccagtttcagcttgtataggatggtggtctttcctgcggcatccaggcccaccatcaggatgcgcatctccttcttcccaatcaggctcttgagaaggtttccaaagatattgcccatgatcacagcagctgctttct

SEQ ID NO: 170891 - DNA, 601 bp, Human
tcatacccaaccaacccacgctaggcctgagcataccttgggtgttctggaagtagtgtctccagaggggtcgaatcttgtcctggccacccacatcccacactgtaaagctgatgttcttatactccactgtctccacattgaaccctttggaaaaaaaacaggcaatggccacttggcctcaaacactagccccgcaaacaccaccacaatgagtttggttctgctttcccccagtggtggccataacaccaacaatggaacaaaagctaaggcttcctcagacctgataatcgttaasctagcagcctgaaggccaaaatgaaaacctaagagaagtcaaagaggatgaggaagttggttgagaggttcacagttgcctgggtaacgtgggccaactttcctgacttttccactcagtctttggtgctccctcctacaaaatgactcagccctgctctggtactttggctaccagagtcggcctcagctaagatgtggggcctgagaggcagagtgaagaaagggaagtaagctggcatcctggagccccaaaggcagagccagctgacaatgctgactggagcccccatctacatag

SEQ ID NO: 170892 - DNA, 601 bp, Human
caggtaaccccctccccccaaccaaaagaccacacctgcctgacaccctccaaatatttgctccctttcctccctttcttctgcccccaggagctgcagcagggtaacagttggccacccattaacaaagacagccacactctctgctcatacccaaccaacccacgctaggcctgagcataccttgggtgttctggaagtagtgtctccagaggggtcgaatcttgtcctggccacccacatcccacactgtaaagctgatgttcttatactccactgtctccacattgaaccctttggaaaaaaaacaggcaatggccacttggcctcaaacactagccccgcaaacaccaccacaatgagtttggttctgctttcccccagtggtggccataacaccaacaatggaacaaaagctaaggcttcctcagacctgataatcgttaacctagcagcctgaaggccaaaatgaaaacctaagagaagtcaaagaggatgaggaagttggttgagaggttcacagttgcctgggtaacgtgggccaactttcctgacttttccactcagtctttggtgctccctcctacaaaatgactcagcc

SEQ ID NO: 170893 - DNA, 601 bp, Human
ataacattcattttttttctttgccagattacacaactgaaaatagatcacaacccttttgcaaaaggatttcgggataattatgacacgtaagtaactttgtatcttccttttcaaatagctgtggaattgggctttaggtcaaaggtgtattattatgtacaaggattttgaaagctggaatgtgtgaagacaaggttgttttagaggacttcttcttcttcgtctttcttctttcttcttcctcttcttttttttttttttttttttttggttggctccccttctctctggtgacctygtggcttggtacttgcgtggtttttggtcagaggtttcctccacctaattttaactttcctgtggattacaaagttgttggtgggcctctggggctggctggctggctggggaggctgccctggttctcgggtgcgagtactgtatgtggcgctgcagatgctcagctcagattgtctatgtctgtctgaaacgggcaattctgcctaaaagtgcatgtggctcctctggcagttgttaacagtctccttagcatatgcgacctttatttacccatttccaagttttgtataatagcatt

SEQ ID NO: 170894 - DNA, 601 bp, Human; identical to SEQ ID NO: 24069

SEQ ID NO: 170895 - DNA, 601 bp, Human; identical to SEQ ID NO: 24070

SEQ ID NO: 170896 - DNA, 601 bp, Human; identical to SEQ ID NO: 24071

SEQ ID NO: 170897 - DNA, 601 bp, Human; identical to SEQ ID NO: 24072

SEQ ID NO: 170898 - DNA, 601 bp, Human; identical to SEQ ID NO: 24073

SEQ ID NO: 170899 - DNA, 601 bp, Human; identical to SEQ ID NO: 24074

SEQ ID NO: 170900 - DNA, 601 bp, Human; identical to SEQ ID NO: 24075

SEQ ID NO: 170901 - DNA, 601 bp, Human; identical to SEQ ID NO: 24076

SEQ ID NO: 170902 - DNA, 601 bp, Human; identical to SEQ ID NO: 24077

SEQ ID NO: 170903 - DNA, 601 bp, Human; identical to SEQ ID NO: 24069

SEQ ID NO: 170904 - DNA, 601 bp, Human; identical to SEQ ID NO: 24070

SEQ ID NO: 170905 - DNA, 601 bp, Human; identical to SEQ ID NO: 24071

SEQ ID NO: 170906 - DNA, 601 bp, Human; identical to SEQ ID NO: 24072

SEQ ID NO: 170907 - DNA, 601 bp, Human; identical to SEQ ID NO: 24073

SEQ ID NO: 170908 - DNA, 601 bp, Human; identical to SEQ ID NO: 24074

SEQ ID NO: 170909 - DNA, 601 bp, Human; identical to SEQ ID NO: 24075

SEQ ID NO: 170910 - DNA, 601 bp, Human; identical to SEQ ID NO: 24076

SEQ ID NO: 170911 - DNA, 601 bp, Human; identical to SEQ ID NO: 24077

SEQ ID NO: 170912 - DNA, 601 bp, Human
ggaaggctactttcagagacctggcctggatgcctgtcatgatggtcatgctgccttggtttctgatggggggagggtccctaactagtctccggcaggcagagagcagctggaacactaaacaactccagtcccaggaagcccggcatgggcaaggtcagctgttggccaagaccagcatgcctagctgaccaactgtcagccaactgcccgtggccacagaacaggggctcaagagagagggatggtgtctcaggagctcagtgatacatcaccacctccttggaggggacacagcccwtgcctactgccccgagaatgacatcaaagatgctgctgcagagaaaagacaaccagggcaaaggagacacaccaagagccttggggagccaggaaggggtgggacaccagtgggaagggggcagggaacacagctcagctaacctcccttcccattcatctccctggccctttagggaaggaagcaggctctggcccagggctgcctgctccaggcacacagatggattacccagtcatggcagcccggagcaggggtggctgcatctgtgctgccacccccccaccccacaacctgaag

SEQ ID NO: 170913 - DNA, 601 bp, Human
ggttgaggcatggggcttcctgcgagcagggcctgcaacccaaagggaggggaaggctactttcagagacctggcctggatgcctgtcatgatggtcatgctgccttggtttctgatggggggagggtccctaactagtctccggcaggcagagagcagctggaacactaaacaactccagtcccaggaagcccggcatgggcaaggtcagctgttggccaagaccagcatgcctagctgaccaactgtcagccaactgcccgtggccacagaacaggggctcaagagagagggatggtgkctcaggagctcagtgatacatcaccacctccttggaggggacacagcccttgcctactgccccgagaatgacatcaaagatgctgctgcagagaaaagacaaccagggcaaaggagacacaccaagagccttggggagccaggaaggggtgggacaccagtgggaagggggcagggaacacagctcagctaacctcccttcccattcatctccctggccctttagggaaggaagcaggctctggcccagggctgcctgctccaggcacacagatggattacccagtcatggcagcccgga

SEQ ID NO: 170914 - DNA, 601 bp, Human
cccactgatttcaccaaggcaaggtaggtatagtggtggggctgcctgtaagagactaggattccagtttcattgacagtgggagttagaggcggcactgatcaccaacagaagacactgaggatgaccctccaatgatggcacagactctacaggaaggcacacagcagaggctgctgtgggttgaggcatggggcttcctgcgagcagggcctgcaacccaaagggaggggaaggctactttcagagacctggcctggatgcctgtcatgatggtcatgctgccttggtttctgatggsgggagggtccctaactagtctccggcaggcagagagcagctggaacactaaacaactccagtcccaggaagcccggcatgggcaaggtcagctgttggccaagaccagcatgcctagctgaccaactgtcagccaactgcccgtggccacagaacaggggctcaagagagagggatggtgtctcaggagctcagtgatacatcaccacctccttggaggggacacagcccttgcctactgccccgagaatgacatcaaagatgctgctgcagagaaaagacaaccagggcaaaggagaca

SEQ ID NO: 170915 - DNA, 601 bp, Human
gcacacacctggatgtgccctgccgtgccctcagggatcagccagaccagtggtggaggcagaagggtcaacaggtaacaacagtcaaaaaagagctggcttggggaccctacaagagtgcaggctgcccttgaccacactgtcaccctcacagtctggatgtttgtttgggctggaagtggatgtgggaaggccgggggtgaagggtggatgcaagatacgggcccttcttcctacgccaggacgccaggactctcccagcctcccagcacagctcctgccatccttgctcaggaaacgycttcctgtagccacagggaaactggaattgccctattacccactgatttcaccaaggcaaggtaggtatagtggtggggctgcctgtaagagactaggattccagtttcattgacagtgggagttagaggcggcactgatcaccaacagaagacactgaggatgaccctccaatgatggcacagactctacaggaaggcacacagcagaggctgctgtgggttgaggcatggggcttcctgcgagcagggcctgcaacccaaagggaggggaaggctactttcagagacctggcctggat

SEQ ID NO: 170916 - DNA, 601 bp, Human
ccttcaagaaaaagctccagacaggccagacacatgcaccctgcctgagacagcatcggggactcagcccaggaggcactgggcctgtgtccaggcaggatttgatgaatgagtgatggcagagaacaaacaacacaaatcaatccaccatcagcctgcgtcaggcccaaatcccttgttcaaaaacattcactaagcaccgactggggccaggtaacatcctcaatgcacacacctggatgtgccctgccgtgccctcagggatcagccagaccagtggtggaggcagaagggtcaacasgtaacaacagtcaaaaaagagctggcttggggaccctacaagagtgcaggctgcccttgaccacactgtcaccctcacagtctggatgtttgtttgggctggaagtggatgtgggaaggccgggggtgaagggtggatgcaagatacgggcccttcttcctacgccaggacgccaggactctcccagcctcccagcacagctcctgccatccttgctcaggaaacgccttcctgtagccacagggaaactggaattgccctattacccactgatttcaccaaggcaaggtaggtatagtg

SEQ ID NO: 170917 - DNA, 601 bp, Human
tcccagcacacacagtgcaccccacgcattccgggggcagtggccagggggccaggagcaatggtgccatgctggaggccctggcaacccttccaatttattctcataccctcctcacaccaaggccacaggccatgggaccttcaagaaaaagctccagacaggccagacacatgcaccctgcctgagacagcatcggggactcagcccaggaggcactgggcctgtgtccaggcaggatttgatgaatgagtgatggcagagaacaaacaacacaaatcaatccaccatcagcctgcgwcaggcccaaatcccttgttcaaaaacattcactaagcaccgactggggccaggtaacatcctcaatgcacacacctggatgtgccctgccgtgccctcagggatcagccagaccagtggtggaggcagaagggtcaacaggtaacaacagtcaaaaaagagctggcttggggaccctacaagagtgcaggctgcccttgaccacactgtcaccctcacagtctggatgtttgtttgggctggaagtggatgtgggaaggccgggggtgaagggtggatgcaagatacgggcccttcttcc

SEQ ID NO: 170918 - DNA, 601 bp, Human
ctcactgtcagcccagcgtggtcagagaaaggcccagctccgtcaggccggctccatgaggactcccaagccgtgggccttcaggggccagcaggccagatccccaccccctcagctgtccttctccccaggcgccccatcccgcgaggggcccagcctgccaacctctaatcctccccgtcatctgacccaggctccaccctacactggctttgcctagccactcttctgaggcccaaaaatggacacaatcatttatagagggttcgacaagccaaacgcaatgggaagatgacctcayggcgcccacaggctcaagctcccagcacacacagtgcaccccacgcattccgggggcagtggccagggggccaggagcaatggtgccatgctggaggccctggcaacccttccaatttattctcataccctcctcacaccaaggccacaggccatgggaccttcaagaaaaagctccagacaggccagacacatgcaccctgcctgagacagcatcggggactcagcccaggaggcactgggcctgtgtccaggcaggatttgatgaatgagtgatggcagagaacaaacaacacaaatc

SEQ ID NO: 170919 - DNA, 601 bp, Human
ctcagacattcaaggacagaaggacagagatgggccccaagatggacagagatgggaatgtgggtagaggggggcatctttgtgctagggcctgggaagggggcgggacccctgcaaagtcagtggccaaggtgaggagaccagggcctctgggtgggctcccagtgccatcactgagggcctgggtgacttgggcaggtggctgggcctgcctatgcccccattgtcctttctattacagggaccatgcacccactctcaggtgtagcattgctgcttctgaggttgctgcaaatataasgcttggtgtacaggcctggctcctccggaggaggctaaggtggctactgcgtgaggagaccttgaccacgcagctgagcatagtgcaattcatggccatgcatcaaggctctaggaatcgccaccactgcaccttcctttagcgagcctcttctcggcatgtcagcgctgtgctgggcactgacaaccctgggccctccctctgcccagctggccctccccactatccagcctgcacccctccagcatgctcaggacctgccgggagggagggacagcatgcacactcccaccctgccag

SEQ ID NO: 170920 - DNA, 601 bp, Human
tgggctggacgctgagtccagggacaaggacctggtcagatgccagtgagaagggagccccgatgtggtgatcttgaagagggcgcagagagttcaagcctcagcttctccaagaatccttgcgatccatagatcttcctggccttcacaacttcatgaaatatggagggaatctaccacccaggcaccccttctcttcagagagctggcatcctcaatgtcctcacacctctctccacaccttggaccatgcctgcacctcctggaatgccttctccttccccatgccccatgcagcctmccaagtaggctgtgcctggacaagtagcctgtgcctggcttggtccctgcatgagccagaaggctgtactcaggccatccagggcccctgggggattggggaagtctggaagccatgcttccaacctcccatgcccacacgcctttaccgaacacccaagaacccacacacacctgggcccacccacagaagatgcccagctcagaagccttccctgcagggtgagatgaaccatctacataagtaactcgggtccaggggaagctgagactggagagatacaggaagagcctgaacagg

SEQ ID NO: 170921 - DNA, 601 bp, Human
ttgacaccctcctcctctcctttagcagcccctcctgcctcccccatcctccatcctggacaggtacccctgcccacctgccctgcacaaacacccagcgaggctgcacatctgcactcttaatcctaaaaggaggcttgccaaacaggcagctttaggaaaacacaacaaaccagggtggcatccaaaaggaagccatcctcccgtgggtgcccctcacctgggacgggagctgcccacctgactctctccacccaatccacttgctgtgtgagctcccacagtcacgtccacatctcartcctcaacctagcacactcctcccgcacgggacacatgcagaaagtcctgagggcaggtgagtccctgcctcaccacccctctaagcacctgccactatacttggtggtttcttcaccatctcccctggtgagaatgtcagctccaggagagcaggggcttggttctgctgactcctgggtccccactccctagaacagtgcccagtatatggtggtgctcaatatttgttgcatgaataaaggaatgaacacacaaacttcatcatatgccagtggtgaaaagttaagcccagagacag

SEQ ID NO: 170922 - DNA, 601 bp, Human
gggcagcctctccagcacatttcgatttcgtcttcaccacagccccagcggcagagatcatgacccctgtttcagatgaggaaaccgggattccaagaattcagtgagacttgcccaagggtaggaatgtgcggggggtggggatagactcaaactcagctgtctagagctttctaccgcacccagagttgctgcctggcatgagaatcttacaagtggccctgggcagcagaggccatctttgacaccctcctcctctcctttagcagcccctcctgcctcccccatcctccatcctggrcaggtacccctgcccacctgccctgcacaaacacccagcgaggctgcacatctgcactcttaatcctaaaaggaggcttgccaaacaggcagctttaggaaaacacaacaaaccagggtggcatccaaaaggaagccatcctcccgtgggtgcccctcacctgggacgggagctgcccacctgactctctccacccaatccacttgctgtgtgagctcccacagtcacgtccacatctcaatcctcaacctagcacactcctcccgcacgggacacatgcagaaagtcctgagggcaggt

SEQ ID NO: 170923 - DNA, 601 bp, Human
cccctgtcagcccttggcaggtccacaaccctgcggcctctttaggaggtggcagcctctcagaagcccgggtgctgggcctcttccacagcacaagaacagcagtaggctgagtccctccagtggtctccgcaggagcagaacctggagccccacctgagtgggcagcctctccagcacatttcgatttcgtcttcaccacagccccagcggcagagatcatgacccctgtttcagatgaggaaaccgggattccaagaattcagtgagacttgcccaagggtaggaatgtgcggggggkggggatagactcaaactcagctgtctagagctttctaccgcacccagagttgctgcctggcatgagaatcttacaagtggccctgggcagcagaggccatctttgacaccctcctcctctcctttagcagcccctcctgcctcccccatcctccatcctggacaggtacccctgcccacctgccctgcacaaacacccagcgaggctgcacatctgcactcttaatcctaaaaggaggcttgccaaacaggcagctttaggaaaacacaacaaaccagggtggcatccaaaaggaagcca

SEQ ID NO: 170924 - DNA, 601 bp, Human
tctaccacacactccaaagtgcaagcctagaccccaggtggagctgggggtccgacaggggccccaagtcttgggagggtcttggggaccaaagtctgtcacaatgacaccccttcaccatcagggctttatgcagggagtccgctggacgcctccatctcatttgcttgtctccaaggccttgccccaggccagaccccactactgatcctactgaccacaagggaggtagaagcccagacggcccactggggagtcacacaaccactccagcttcagtttcttcctttgtggatgggaygtataatactctcacctgtccacagtgatgatggcatgcagccagtatgcaggaaacaatgccattatgtttaagttaatatttgacaagggcttccctgtagcaggaagagcctgcctttctctcctcggctccccagccctgacccctgtcagcccttggcaggtccacaaccctgcggcctctttaggaggtggcagcctctcagaagcccgggtgctgggcctcttccacagcacaagaacagcagtaggctgagtccctccagtggtctccgcaggagcagaacctggagcccca

SEQ ID NO: 170925 - DNA, 601 bp, Human
ctggggattacaggcatgagccaccgcacccggccaagagtgttcttttagactggaataaactggagacaacttttactatttgggaaaaaacacacagcacagggtcctgtctgtcctcatttgcgtgcatgaacccccatctctggacttgcacctagaaaccccaggtgttcccatcaccccagagtctaccacacactccaaagtgcaagcctagaccccaggtggagctgggggtccgacaggggccccaagtcttgggagggtcttggggaccaaagtctgtcacaatgacacyccttcaccatcagggctttatgcagggagtccgctggacgcctccatctcatttgcttgtctccaaggccttgccccaggccagaccccactactgatcctactgaccacaagggaggtagaagcccagacggcccactggggagtcacacaaccactccagcttcagtttcttcctttgtggatgggacgtataatactctcacctgtccacagtgatgatggcatgcagccagtatgcaggaaacaatgccattatgtttaagttaatatttgacaagggcttccctgtagcaggaag

SEQ ID NO: 170926 - DNA, 601 bp, Human
ctgcctaaagaatccatgcagccacatgtgcaacaagtatgcacctactgtgagccaagctgaggggatgagatgccttggtgaccacagggaccagagacacatgggcctgcctgggtcaggaagcaaagcaaagtgcccagagtatgggattccccccaggaagtcttcccagggtgcatgtgtgtgtgtgtgtgtgtgtggtagcgggggcagtgtcggcagcatggttctttcccccccaggaacattaaaaaacaactagtatgaccatcatctcattaaagaaatactgtagcartaacagaaacaaaattagagggacgtaaactttatttttatttacttatttatttatttgttgagacagagtctcactctgtcaccaggctggagtgcagtgacacgatctgggctcactgcaaccgccgcctcccgggttcaagcgattctcctgcctcagcctcccaagtagctgggattacaggcgcatgccactacacccagctaatttttgtatttttagtagagacgggggttcaccatgttggccaggatggtctcgatctcttgacctcgtgatccgcccgcctcggcctcc

SEQ ID NO: 170927 - DNA, 601 bp, Human
cccactagcctagccccaacctaaatcctgcagacacagcatccctcccgctcccaccctgcaccctcaaacccagggagcctccagggcctctgccagccatcagtgctgtctccccactgcctaaagaatccatgcagccacatgtgcaacaagtatgcacctactgtgagccaagctgaggggatgagatgccttggtgaccacagggaccagagacacatgggcctgcctgggtcaggaagcaaagcaaagtgcccagagtatgggattccccccaggaagtcttcccagggtgcatgtgtgtgtgtgtgtgtgtgtggtagcgggggcagtgtcggcagcatggttctttcccccccaggaacattaaaaaacaactagtatgaccatcatctcattaaagaaatactgtagcagtaacagaaacaaaattagagggacgtaaactttatttttatttacttatttatttatttgttgagacagagtctcactctgtcaccaggctggagtgcagtgacacgatctgggctcactgcaaccgccgcctcccgggttcaagcgattctcctgcctcagcctcccaagtagctgggat

SEQ ID NO: 170928 - DNA, 601 bp, Human
ggcaggactcctcggctgggcctgggccaatcacaagaaccccatttgtgggcaccaagcattacagccaccagctcaggttaggccccaccacagccctgagcagctgaccacggctgctttatcacgggggagtgtgatgaggagcgatcctgggtccctccagggtggccggggcagggtgggatctgcacccactagcctagccccaacctaaatcctgcagacacagcatccctcccgctcccaccctgcaccctcaaacccagggagcctccagggcctctgccagccatcagtrctgtctccccactgcctaaagaatccatgcagccacatgtgcaacaagtatgcacctactgtgagccaagctgaggggatgagatgccttggtgaccacagggaccagagacacatgggcctgcctgggtcaggaagcaaagcaaagtgcccagagtatgggattccccccaggaagtcttcccagggtgcatgtgtgtgtgtgtgtgtgtgtggtagcgggggcagtgtcggcagcatggttctttcccccccaggaacattaaaaaacaactagtatgaccatcatctcattaaagaa

SEQ ID NO: 170929 - DNA, 601 bp, Human
gtgtcacctggcccctgtgtccccagccctaacaggggtggactccaggcccaagccctgccccagaccctgggcatggctggattctaatctggcccaggccactccttctggagactccaggctcatcccctcacccgcaacccaggacaattaagatacagtccttggctgaggccagaccaggagacagaagaaaggttcaggcaacacgtggggagggaagctgaagagcccagggcagggcccgcctcacccaagggccccgggctacagcccaggcccagcctctgcccatctyctcaaactcaggccctgaatgggccctgacaagcactgttcccgctgccatccaagcatctctccccacactaccacctgcctcctttgccctctgaacttggctcaggttctgaggaggcttccctgactgctggggcctgagggaaagcccctcaggctccagtgccctccccaacccacagtcctgggatgagtgctgtgtgcaaggctgggagctcctgagagcaggcacccacagtgggcaggtcacagatgacagaatgacttagggtgtaaatgcgaagccatcgctgcctct

SEQ ID NO: 170930 - DNA, 601 bp, Human
tgcccttccagcgacaggtgtcacctggcccctgtgtccccagccctaacaggggtggactccaggcccaagccctgccccagaccctgggcatggctggattctaatctggcccaggccactccttctggagactccaggctcatcccctcacccgcaacccaggacaattaagatacagtccttggctgaggccagaccaggagacagaagaaaggttcaggcaacacgtggggagggaagctgaagagcccagggcagggcccgcctcacccaagggccccgggctacagcccaggcycagcctctgcccatctcctcaaactcaggccctgaatgggccctgacaagcactgttcccgctgccatccaagcatctctccccacactaccacctgcctcctttgccctctgaacttggctcaggttctgaggaggcttccctgactgctggggcctgagggaaagcccctcaggctccagtgccctccccaacccacagtcctgggatgagtgctgtgtgcaaggctgggagctcctgagagcaggcacccacagtgggcaggtcacagatgacagaatgacttagggtgtaaatgcg

SEQ ID NO: 170931 - DNA, 601 bp, Human
acaggatgttttccacctgcccttccagcgacaggtgtcacctggcccctgtgtccccagccctaacaggggtggactccaggcccaagccctgccccagaccctgggcatggctggattctaatctggcccaggccactccttctggagactccaggctcatcccctcacccgcaacccaggacaattaagatacagtccttggctgaggccagaccaggagacagaagaaaggttcaggcaacacgtggggagggaagctgaagagcccagggcagggcccgcctcacccaagggcccygggctacagcccaggcccagcctctgcccatctcctcaaactcaggccctgaatgggccctgacaagcactgttcccgctgccatccaagcatctctccccacactaccacctgcctcctttgccctctgaacttggctcaggttctgaggaggcttccctgactgctggggcctgagggaaagcccctcaggctccagtgccctccccaacccacagtcctgggatgagtgctgtgtgcaaggctgggagctcctgagagcaggcacccacagtgggcaggtcacagatgacagaatga

SEQ ID NO: 170932 - DNA, 601 bp, Human
acataattagacagctcataccacttcaggccagagaaaaaaggggagctgccatgggccaaatggataggaggccaaagaccctcaaggggtctttcccacccaggcctctctgtgccagaagggcccctgcttgccctggactcaggcatcttggcctcagccccagagagatggtgagctgagcaaaggtccaaagaaagtagcagcagctgttggaaaaaagggctgggctggcaaaggctctcctggcacccactcctgccagccctgtggttccaacaaagcttctccagccacrggcctggtggaaacccctcgctgccagacactgcccccatctccatccacacaacagagactgaggcattattcacgttaccgtgcccactccccactcgggggtctgtcctggagccaggggtccccacagctggcaggaccactcctctgaggcccctccctagctctgacccagctctgcaacaaaaggacccctatggccatcccagtcaacggcctggccacacagggccgtgcatacaggggcgccctaaaaagggtgagcggatccactgatagacctcccagccgccagctc

SEQ ID NO: 170933 - DNA, 601 bp, Human
cttgcagggagaggggacacaaataaataaactcctggcttggtttatatttcagaaaaagaacaagatttgggtcctgtcccaggttcagcaaatgcatccaattaattgtggattctgtttctcagtttagaacaagagtcagctcattcctcgtcctggagtcccctcccaagccactaacatcccccaggatccctgcaactctttctttgtgggaggtgggaggtatgcttctcaggagcacagtcaggccagcttcattcaaatctgatcctcctaggtccctggattcctgtcrgtacccaggtcccctgcaccatgcctccctggcggggtcactggtggatcccggagtatggaaatcccaaggtgaagggcctggctctgtgggttcaccttccctttggtgtgccagcctcctggagccacccaggggccccactcccacccccaaacatatgccaggtgttccccaacaaaggcagcccccacactgattttcatttgaagacaatgaagacatctgcaccttaacagtcccttccaagctcttcttaccacctccttcccactccctggactcagggatgggggtggc

SEQ ID NO: 170934 - DNA, 601 bp, Human
tgccaattcacttggcactgtgtgcctactatgtgccagaagccaggaacacaggcacgatgggtctagcctcccccttcaggattgagaccagcaaacagggtttgctgttagcccgttttatggaagtcaaaaggagatgaggagggagagcaggagcaggaacctgggggggtcccgctgcctgctagccaggaggccagtgcaacctgggagctccggtccctctgtctctccccgcatggctcaggcacacagtctaagcactggagtggcgcggagccgactgcagactatgggraaggcctccctagtctctcgcagtgcagcaggcagggtgacccgcaagtgcagtggcacaaagccggacgctggcatcaggttctgtccttgctgtgatcagggctcccacagtgctgactcagctccccccgcccagccctgcagcccacacccattcctcagggaggcttctgaagttggccccaggccagaacagcccaggatcaacagaccctgcccaccagcccccgggtggtgctgccccgaatgccctcaggaaaggaccccctcaattggggaggttgaccccctcaaccat

SEQ ID NO: 170935 - DNA, 601 bp, Human
atattctttccaccttgctgcattgtgtaaggtgctttgcaaagccttatacaaaggcttttatcctccgaagcctcacatgccaattcacttggcactgtgtgcctactatgtgccagaagccaggaacacaggcacgatgggtctagcctcccccttcaggattgagaccagcaaacagggtttgctgttagcccgttttatggaagtcaaaaggagatgaggagggagagcaggagcaggaacctgggggggtcccgctgcctgctagccaggaggccagtgcaacctgggagctccagtccctctgtctctccccgcatggctcaggcacacagtctaagcactggagtggcgcggagccgactgcagactatggggaaggcctccctagtctctcgcagtgcagcaggcagggtgacccgcaagtgcagtggcacaaagccggacgctggcatcaggttctgtccttgctgtgatcagggctcccacagtgctgactcagctccccccgcccagccctgcagcccacacccattcctcagggaggcttctgaagttggccccaggccagaacagcccaggatcaacagaccctgcc

SEQ ID NO: 170936 - DNA, 601 bp, Human
aatcccctccccttccttccttcccaaggcctcaagccctaccatctggatcctgagctaggcctggactccctggactcctccagtgctgggggccccaggcctaaactcagacaggacggccctagaggatacacacggagggcatgggtgcagctagacaccccccactggcctaaggccctgctccctgccctggagcagggctggtccacgagccggcaccccgaccttcagggtcctcgtgtgtgaaatggagacacctgttctcccgtttaatcctcatgacaaccctcccacrcaggatactatcccacctcacaaaaggggacactgaaacttggagggggagtaacttgtccaaggtcaaagcactgaggaagagcagagctaggatttgaacctggggctctgagacttgaaaatcatattctttccaccttgctgcattgtgtaaggtgctttgcaaagccttatacaaaggcttttatcctccgaagcctcacatgccaattcacttggcactgtgtgcctactatgtgccagaagccaggaacacaggcacgatgggtctagcctcccccttcaggattgagaccag

SEQ ID NO: 170937 - DNA, 601 bp, Human
ctgacccgcagccccgggcaagtcaccagccttccagaggatccaccctgcagtcccagtcatcatctagaaaggtccccagagtgtgcccaggttccttcactaacacatccagtcctcctccaaagctcccggggaagggccaacacagtgcagtgcacttgggaaggggaggcagggaccccatgaaggagagaggacagaggtcccagaagccacagcccacgcctgcaccccctgtgcccgaaaggaagaggagctcctcctgcactgtcccctcctccccaagggctctctccaycaagagcagcacagttcaacagtaaggggctgagcagacagacagaggggccaatccctctaaaaaaaaaaaaaaatcccaggagggagccaaaggagtggggcacagcctgggggcccccccacagatgccaggtcagcccccagccacccccacgctagggctgtccacagagagaggggtcagggagggagggcggaaggggaagtgggggcttacagtatcacctggagcctggcccccacaaggccctgtcggggctcagaacacagcaccccaaagtgtggtgctgtggctcac

SEQ ID NO: 170938 - DNA, 601 bp, Human
gaatgttcaggggagcagaggggctccgggcttcctccccctaaccctgcccgtcctgtgctgtgtggtaaggaggagtggaatgacataaatgtgaagggctagagggacatggatgtgggggacaaatgcactgcccctccccacccgattaaggatgtcagcacacagtgggacagaagtggacatagcccagccccaccctaatgggctgtgtgacttcagcaggtgccatccctccctgggcataatccaggtcccactaaccttagagggaggtaacaggagcaacagggcccasagaggctgaccgctgctcagctggctgccccgtgtgggaggcagtgctgctgactaaaggccccaaacacctgcccgcagtccctagcaccaccaggctcagccctgaggccagccaccagctcaggggcatgctgcagggggcagcaagggcctcccactgacccgcagccccgggcaagtcaccagccttccagaggatccaccctgcagtcccagtcatcatctagaaaggtccccagagtgtgcccaggttccttcactaacacatccagtcctcctccaaagctcccggggaagg

SEQ ID NO: 170939 - DNA, 601 bp, Human
agtgggggaacagcctgtgctgggaggagcagagcaccagcccagccccagccagggcacagctgtgggtggggggcggtggcagctccccagcagccagggcaggggagggggaaggtctggccagcacccacctgccttggggccaagtgaaggtctgagctgggtgggaaggcaacagccacgggtcgccacacactcccacagtcttcattaggaaactttgcctccctagcaatgccaggctatgctggcccttcacatcacctcctccaggcagccttccccgactccactccakgcacaggagctgacttgttcttctggatgccttcaggttcttacacgtctgttcctgtctgagaagctcaacctatacatgcaaccaggctattcattccttaatcaaagtcctcggtttctatatccatgacactggaactagtaaatggtgcctacgggaggtatgtgtttatctcaaacacatcattggtattacttcaaacagtattgttgtcatttctgctattcaaaggagtgaatgcccagagtcagctttagatagcgcccacccagaagtgcccactgaggcaccaacagg

SEQ ID NO: 170940 - DNA, 601 bp, Human
ccctgcaagccaccccattacgctgggcccctttgggaaaagggtaaaccgacaagaggccccatggaaatcaaccaaacagctgaagacagtggccatcgcagcaaggccagcctggtgcaacccgctgtggccacatgaggagccctgatgggccttgctactactccacatcccagtgccacccccgcaggcaggcagcaagggcatggccgcggggcatcagtgacacagggcgaccctccaccacttcagttgtgctgggtggggctcgctgaggacagcctgtctccacaggcaygcaccccacccttggccccagccctccgcccatctgtccctccacacaagtgcgggtgctattctcagcccagctccaggacactggccataaacacacggtggaatctgcttctccagcccacccgcctcccaccctcatcacctgcttcctgagctcagtgggggaacagcctgtgctgggaggagcagagcaccagcccagccccagccagggcacagctgtgggtggggggcggtggcagctccccagcagccagggcaggggagggggaaggtctggccagcacccacctgcctt

SEQ ID NO: 170941 - DNA, 601 bp, Human
cagtccactgcagcatggccagttccttggaacagcatataccaaccaccccccttcctctctccaatcaagctcccctctgcagcctccttgcctgcagctctgcaaggaccctgcaagccaccccattacgctgggcccctttgggaaaagggtaaaccgacaagaggccccatggaaatcaaccaaacagctgaagacagtggccatcgcagcaaggccagcctggtgcaacccgctgtggccacatgaggagccctgatgggccttgctactactccacatcccagtgccacccccrcaggcaggcagcaagggcatggccgcggggcatcagtgacacagggcgaccctccaccacttcagttgtgctgggtggggctcgctgaggacagcctgtctccacaggcacgcaccccacccttggccccagccctccgcccatctgtccctccacacaagtgcgggtgctattctcagcccagctccaggacactggccataaacacacggtggaatctgcttctccagcccacccgcctcccaccctcatcacctgcttcctgagctcagtgggggaacagcctgtgctgggaggagc

SEQ ID NO: 170942 - DNA, 601 bp, Human
caacccccagctcacataagccttccccgcacctgccgcccagtgcacctgctcctgcggctcacagtccactgcagcatggccagttccttggaacagcatataccaaccaccccccttcctctctccaatcaagctcccctctgcagcctccttgcctgcagctctgcaaggaccctgcaagccaccccattacgctgggcccctttgggaaaagggtaaaccgacaagaggccccatggaaatcaaccaaacagctgaagacagtggccatcgcagcaaggccagcctggtgcaaccygctgtggccacatgaggagccctgatgggccttgctactactccacatcccagtgccacccccgcaggcaggcagcaagggcatggccgcggggcatcagtgacacagggcgaccctccaccacttcagttgtgctgggtggggctcgctgaggacagcctgtctccacaggcacgcaccccacccttggccccagccctccgcccatctgtccctccacacaagtgcgggtgctattctcagcccagctccaggacactggccataaacacacggtggaatctgcttctccagcccacc

SEQ ID NO: 170943 - DNA, 601 bp, Human
aggtgaagtatgatcatgtaggtaagagggcccagcagagccgctagcactggattcccccctgctccccccacccagggctgaaagttcctgcagtcttcccaccctagtccccaacgccctactcccccaacccccagctcacataagccttccccgcacctgccgcccagtgcacctgctcctgcggctcacagtccactgcagcatggccagttccttggaacagcatataccaaccaccccccttcctctctccaatcaagctcccctctgcagcctccttgcctgcagctctgcmaggaccctgcaagccaccccattacgctgggcccctttgggaaaagggtaaaccgacaagaggccccatggaaatcaaccaaacagctgaagacagtggccatcgcagcaaggccagcctggtgcaacccgctgtggccacatgaggagccctgatgggccttgctactactccacatcccagtgccacccccgcaggcaggcagcaagggcatggccgcggggcatcagtgacacagggcgaccctccaccacttcagttgtgctgggtggggctcgctgaggacagcctgtctccaca

SEQ ID NO: 170944 - DNA, 601 bp, Human
gactctggcccttaaaacccagcatggaacgtggaaccctggaaagctctgagccaagacttgattttgcagcctgcaaagctcccaggctggcgcgtgtacacacttcaggagcgcagtggggcagggtgcctgttcagaagctgactgcactgacccaggtgggaggcaaggggactctgtgatctgagctactagagggaaggggtggtcatcacctgagatggggacacgtgttggggtaacagctgggggtcacagtgagtttgcagtgcccagagatgtccaggaggaaggtgcrgacacaatggccaggaaccctggggtggactggacacaccccaccgtcaggtttctatcacaccccggccccacccacctgcccctcagtccctcccactgcccactctggatgaccagctcagggcatctagtctgggcagctggccaggaaccccttctggtaggagacactgctggggcagaaggtgctgggagcaggcccaggctgtgcagccctgggcaagtaagctcacctccctgacctgctgggtctcatcacttagagccaagaactccctcaagggtgtttaaaggtgaa

SEQ ID NO: 170945 - DNA, 601 bp, Human
accgcaccactgcactccagccagggcgacagagcaagaccgtatctcttaaaaaaaaaaaaaaagagagacactgaagggctgggggtgaggggagagggcggctgctcttaggaaggaactcagggaagtgacagctgagcagagacctgatgaaggagcaagacaccaggccaggaaggaagaagaaggtagaactcactggacagagaactcagtgagtgcaaaggccctgaggtggacgggagggatgccacaggacagcaagaccggcgtggctgagagtggcagggggcagggmggaccaggaggccctgaaacaccaggtgccaggcttcatgctgagcccttgggcatgattccatagcctcatggtggacccctccataacctcatgaaggaaatactattatattctcactttgcaggtgaggaaactgaggcactgccttaacaactccccagggtcacgcagccaggcccaggatcccaaccccaggcctgggtccatcggtgaggagctttaaccactgcacatgcggcctcggcccccaggaccacagaggcccctggaagactctggcccttaaaacccagcatg

SEQ ID NO: 170946 - DNA, 601 bp, Human
tggggaggctagggcaggaggatgccttgagttcaggagttcaaaaaatgcagtgatccaggaccgcaccactgcactccagccagggcgacagagcaagaccgtatctcttaaaaaaaaaaaaaaagagagacactgaagggctgggggtgaggggagagggcggctgctcttaggaaggaactcagggaagtgacagctgagcagagacctgatgaaggagcaagacaccaggccaggaaggaagaagaaggtagaactcactggacagagaactcagtgagtgcaaaggccctgaggyggacgggagggatgccacaggacagcaagaccggcgtggctgagagtggcagggggcagggaggaccaggaggccctgaaacaccaggtgccaggcttcatgctgagcccttgggcatgattccatagcctcatggtggacccctccataacctcatgaaggaaatactattatattctcactttgcaggtgaggaaactgaggcactgccttaacaactccccagggtcacgcagccaggcccaggatcccaaccccaggcctgggtccatcggtgaggagctttaaccactgcacatg

SEQ ID NO: 170947 - DNA, 601 bp, Human
ccaccccggctctgggacgtggcctctcggctgtagggcctggtggctgtggtggtcacactgtgggtgagctggccagacgcaggagggatcttctcataactcagttccttgagaggggtgccaagagcaggacaggcacagaatcagagcctcccctgccaacgcccacccaaaaacgaaggtggcttcctcttctgcactatcacctcacaacaggcatttgaagactcagcaacgtgccctggtggcagtgtgcctggccatgctctatgggaagccaagcaaggtctctgccctggaggagccagcactctaggagggaggcaatgttgaaaggtgctgtgagcctccgaacaaaaatgcagcagggggacgggtgcggtggctcacacctgtaatcccagcactttgggaggctgaggggggcaaatcacctaaggtcaggagttccagaccagcctgggcaacatagtgagatcctacccctaccaaaaatagtttttaattagctgagtgtgatggtgtgcacctatagtcctagctactggggaggctagggcaggaggatgccttgagttcaggagttcaaaaaatgcag

SEQ ID NO: 170948 - DNA, 601 bp, Human
gggctacgcccacccagaccatcatcaagcgcccagccagctgcccaggcctcaccctccagcttcttccccacccagccagcacttagtggaagaaaggaaccttccaccagacccaccactgtgaagagtccccaccccggctctgggacgtggcctctcggctgtagggcctggtggctgtggtggtcacactgtgggtgagctggccagacgcaggagggatcttctcataactcagttccttgagaggggtgccaagagcaggacaggcacagaatcagagcctcccctgccaackcccacccaaaaacgaaggtggcttcctcttctgcactatcacctcacaacaggcatttgaagactcagcaacgtgccctggtggcagtgtgcctggccatgctctatgggaagccaagcaaggtctctgccctggaggagccagcactctaggagggaggcaatgttgaaaggtgctgtgagcctccgaacaaaaatgcagcagggggacgggtgcggtggctcacacctgtaatcccagcactttgggaggctgaggggggcaaatcacctaaggtcaggagttccagaccagcctggg

SEQ ID NO: 170949 - DNA, 601 bp, Human
ccccacatggcgatccacctttttgacaagcccccatgctccgtcccctgacaccagtccacaaagactcatcacacttttccgtggtcccctgctcagaaaggctgactgaggaagctgcctggcctctcttgggaggccgtcactctaaaatgatgatctccttcctctttttggtgattttccctttcctttgtgaaatactggtgagagcaaaaagtggtgttgggttttctcttttacatccttaactgacaataaaaacttgaccaactacgtcagccccaccacaatgctttgmtggtcaaaaacgaaaacacagagagccctcccagcccggccggcccctggaggtcctgtctgcatcagagctggcagcccagccccgcccctgagaaagaagggggaggggaaggaagttgcagggtctcctcctccacactcatctctgcagctggaagggaaggctcccgccccagagaacgagtgtccagttgactccaggccaggaaggccccctccccgtcctctctctcatccctcccagggtgcctgaaattccagccggttctgtagataagcctatggcctgcagccaggg

SEQ ID NO: 170950 - DNA, 601 bp, Human
agaatctcgctctgttgcccaggctggagtgcagtggtgcaatctcggctcaccgcaacctctgcctccccggttcaagcaattcccctgcctcagcctccagagtcgctgggactacaggcgcacgtcaccacgcctggctaatttttgaatttttagtagagatggggtttcaccatgctggccaggctggtttcgaacccctgacctcgtgatccacccgcctcgacctcccaaagtgctaggattacaggcatgagccaccgcgtccagacagtgatccgtctttttaacaagtccrtgacccccaggaagcgcctggcctcacccccacatggcgatccacctttttgacaagcccccatgctccgtcccctgacaccagtccacaaagactcatcacacttttccgtggtcccctgctcagaaaggctgactgaggaagctgcctggcctctcttgggaggccgtcactctaaaatgatgatctccttcctctttttggtgattttccctttcctttgtgaaatactggtgagagcaaaaagtggtgttgggttttctcttttacatccttaactgacaataaaaacttgaccaa

SEQ ID NO: 170951 - DNA, 601 bp, Human
tcgcccccacatggtaatccatctttttttcttttttttttttttaagacagaatctcgctctgttgcccaggctggagtgcagtggtgcaatctcggctcaccgcaacctctgcctccccggttcaagcaattcccctgcctcagcctccagagtcgctgggactacaggcgcacgtcaccacgcctggctaatttttgaatttttagtagagatggggtttcaccatgctggccaggctggtttcgaacccctgacctcgtgatccacccgcctcgacctcccaaagtgctaggattayaggcatgagccaccgcgtccagacagtgatccgtctttttaacaagtccatgacccccaggaagcgcctggcctcacccccacatggcgatccacctttttgacaagcccccatgctccgtcccctgacaccagtccacaaagactcatcacacttttccgtggtcccctgctcagaaaggctgactgaggaagctgcctggcctctcttgggaggccgtcactctaaaatgatgatctccttcctctttttggtgattttccctttcctttgtgaaatactggtgagagcaaaaagtgg

SEQ ID NO: 170952 - DNA, 601 bp, Human
gagcgggcgtgtgtctggagcttgctgaagaagattcacactccatcttgctttgatccaaagatcgaactggtaaagaaaacacttttgtgacataaccaacatagacagcttgtggattagaacgcaaagctgacaaagattttcacgatgaaatacaaaaccgggaagacattcctcccaggaaggcctggcctcgcccccacatggtaatccatctttttttcttttttttttttttaagacagaatctcgctctgttgcccaggctggagtgcagtggtgcaatctcggctcaccrcaacctctgcctccccggttcaagcaattcccctgcctcagcctccagagtcgctgggactacaggcgcacgtcaccacgcctggctaatttttgaatttttagtagagatggggtttcaccatgctggccaggctggtttcgaacccctgacctcgtgatccacccgcctcgacctcccaaagtgctaggattacaggcatgagccaccgcgtccagacagtgatccgtctttttaacaagtccatgacccccaggaagcgcctggcctcacccccacatggcgatccacctttttgac

SEQ ID NO: 170953 - DNA, 601 bp, Human
agggagatgctgccagctcagctctcacttcagaggggactccctccccatcaaattccttccctatggagcccagttgaggcccccacatgtgcccctctaggtaagctccacaaagctcacagtgcaaagcatgaccaccagggaatctctcctccaaggactcaccttgggggacacaccacccttgaaccccctcccgttgggttcatatccctaggccaccctgaggtgatgaccgttggtcctattttacagatgaagaaatcgagggtcagggcggtcactcagctaatgagcwctagagccaggatgccacacctgatcagttccaaagcccagactcaacttttgactcccaaactggggcacacagacactggggggagcgggcgtgtgtctggagcttgctgaagaagattcacactccatcttgctttgatccaaagatcgaactggtaaagaaaacacttttgtgacataaccaacatagacagcttgtggattagaacgcaaagctgacaaagattttcacgatgaaatacaaaaccgggaagacattcctcccaggaaggcctggcctcgcccccacatggtaatc

SEQ ID NO: 170954 - DNA, 601 bp, Human
cttccctagctcctctgtgcccccatacctggggcccccatgtcccctgggctggatatgaggtggtggcaggaggggctggctctagggacaggcatctgtcaacctgccctccctcgagggagatgctgccagctcagctctcacttcagaggggactccctccccatcaaattccttccctatggagcccagttgaggcccccacatgtgcccctctaggtaagctccacaaagctcacagtgcaaagcatgaccaccagggaatctctcctccaaggactcaccttgggggacacaycacccttgaaccccctcccgttgggttcatatccctaggccaccctgaggtgatgaccgttggtcctattttacagatgaagaaatcgagggtcagggcggtcactcagctaatgagctctagagccaggatgccacacctgatcagttccaaagcccagactcaacttttgactcccaaactggggcacacagacactggggggagcgggcgtgtgtctggagcttgctgaagaagattcacactccatcttgctttgatccaaagatcgaactggtaaagaaaacacttttgtgacat

SEQ ID NO: 170955 - DNA, 601 bp, Human
ggcattccacaaacacgagcctcccctggtcttgcctttgcgaggagggtggtgaggatatcgtgagtccttcgttttgcgttcgtgattcattttgatgctcaaacatcccaagtgcgaccagtgggaggtttcggacacgtcctcattcatctccaggcgcttccttactttctggcactagcagattctccaggctcagcctgcactgtccctgccccagccctggcatcagccatttctccaaggaaccctgatttccttcggtggagaggcatgctcattgctcttaggcatttcrgcgttccctcatgctcagagccgcagattattacccctgctttagagataagaaaggaaaggctgcggcactgaaggatttggctctgcagcgaagaagcgaccgagctcagattctgtggctttgtggtggtggtgaacaagcatcatcactcaggtctgtctgcttcaagaagtgagaaaggagacagacccatggcctagcagctgccctctgagcccattgcagtgttccttaggaggccacactgactgtgggctgtggcacctgccccaggctggtgactgcacaaggggcagc

SEQ ID NO: 170956 - DNA, 601 bp, Human
agggaggctgagccttcccaccgcaccacagctgtgttaggcttgaccgccgggtctgagtcgtgtttgccagatctcttggaaaggaaggtcacttttctcttagtcatctgcagggcaatcacggtcactgtggcaaggcaaaaagttgttgaaatttttgcacagtgcctttactatccatcattctttgctattcagtgtgaggtctgtgggcagctgcatgacagtcttccaagagcctggaggagaaaaaaaactgcagacctgctgaaccagagtgttccctttaacaagtccycctggcgcaccgtatgcgcagtgaagtctgagaagcactgcaatagcatcttggctggaacccgctgttacccaatctcctccacgtgacccggcattccacaaacacgagcctcccctggtcttgcctttgcgaggagggtggtgaggatatcgtgagtccttcgttttgcgttcgtgattcattttgatgctcaaacatcccaagtgcgaccagtgggaggtttcggacacgtcctcattcatctccaggcgcttccttactttctggcactagcagattctccaggctcagcctgca

SEQ ID NO: 170957 - DNA, 601 bp, Human
gaaaggatactacagggactatcatctacccttcacccagattcaccaatcaactgttaccacttggccacactcatttgcttttttctttttttttttttctttttttttgcttttctcttttcttgctatgtcgtccaagctagagtacatggcgcaatcatggctcacagtagcctagactttctgagcttaaacgatccgcccacctcagcgtcccgagtagctgggactacaggccactgcacctagctagtatttttactttttgtagagacagggcctcgctatgttgcccagktttgtctggaactcctagcctcaagtgatcctcccacctcagcaccctcaaggtgctgggattgcaggtacaagccaccgtgcccagtcacttttctctatatataaaccgttcctgcatttgtatgtttgcccagccaacagaaggtaagcagcagaagggtcactgggatgaccttcgctccacaatacttcacccctaaatactccaacagatttcctaagaacaagaacatgctccaaaatgcccatgataccataagcacccccaatacatccaaaatgtattttaaaataccat

SEQ ID NO: 170958 - DNA, 601 bp, Human
cctcccagcagagcctgcggtcgggggccacggaggcaggatgcacaccctcgtgccccggcgttctcacaccgaggctccccaggcaggcagacacagacagaggacaggcaggcgggcagggggaaggccactgtcagacacccggccaggctttctctgggcccagtcccgagggagacaccccaagaggcgaaagggaggagggcccctagaacaggacaaaggcgagccttctccccacccccgccccccacctctgggtccaggctcgctcactgactcccgggggctgtccctmtgtcaatctttccttgcccctcctcctccgtcgtctcccacacacagctcgggtcagccaagctggggagctgtggatgatgacacagggctggcctcggggatctttccgccctcatgctccaggggcccctgcaggggagacagagggcaggatggccagctgaaggcctccgtggtcacaagctctgaggccttgcaggcactcagctggggataccagggacatcgcaggacaagtctgcaccgagaccagggttggcgtgggcaggccatggtgggcgcccaggcaggggaaggg

SEQ ID NO: 170959 - DNA, 601 bp, Human
aaagctaggggctcctccaccagccagcggcacccctcgtccctgcagtggcagcagagttcccaacaccccacccccacacacacatggaagggggacctcatccagcaaatctccctcccaggcacccaccacccagctgctgagaccccagaaaacgcataaggccctcaccttccgcatcatctcctccccacctgcctgcacaggaagggcgggctgagaagtgagccctgtctcgccccttcctcccagcagagcctgcggtcgggggccacggaggcaggatgcacaccctcgygccccggcgttctcacaccgaggctccccaggcaggcagacacagacagaggacaggcaggcgggcagggggaaggccactgtcagacacccggccaggctttctctgggcccagtcccgagggagacaccccaagaggcgaaagggaggagggcccctagaacaggacaaaggcgagccttctccccacccccgccccccacctctgggtccaggctcgctcactgactcccgggggctgtccctctgtcaatctttccttgcccctcctcctccgtcgtctcccacacacagctcggg

SEQ ID NO: 170960 - DNA, 601 bp, Human
aaggaaggaggggtgagggccgcgttcccagtcactctggtcctggccagggccaggcagaaagctaggggctcctccaccagccagcggcacccctcgtccctgcagtggcagcagagttcccaacaccccacccccacacacacatggaagggggacctcatccagcaaatctccctcccaggcacccaccacccagctgctgagaccccagaaaacgcataaggccctcaccttccgcatcatctcctccccacctgcctgcacaggaagggcgggctgagaagtgagccctgtctcrccccttcctcccagcagagcctgcggtcgggggccacggaggcaggatgcacaccctcgtgccccggcgttctcacaccgaggctccccaggcaggcagacacagacagaggacaggcaggcgggcagggggaaggccactgtcagacacccggccaggctttctctgggcccagtcccgagggagacaccccaagaggcgaaagggaggagggcccctagaacaggacaaaggcgagccttctccccacccccgccccccacctctgggtccaggctcgctcactgactcccgggggct

SEQ ID NO: 170961 - DNA, 601 bp, Human
ccatcagaaggaccagcccaggggcccaggagggaagcctaaggaaggaggggtgagggccgcgttcccagtcactctggtcctggccagggccaggcagaaagctaggggctcctccaccagccagcggcacccctcgtccctgcagtggcagcagagttcccaacaccccacccccacacacacatggaagggggacctcatccagcaaatctccctcccaggcacccaccacccagctgctgagaccccagaaaacgcataaggccctcaccttccgcatcatctcctccccacctgyctgcacaggaagggcgggctgagaagtgagccctgtctcgccccttcctcccagcagagcctgcggtcgggggccacggaggcaggatgcacaccctcgtgccccggcgttctcacaccgaggctccccaggcaggcagacacagacagaggacaggcaggcgggcagggggaaggccactgtcagacacccggccaggctttctctgggcccagtcccgagggagacaccccaagaggcgaaagggaggagggcccctagaacaggacaaaggcgagccttctccccacccccgccccc

SEQ ID NO: 170962 - DNA, 601 bp, Human
agcaggccctgaaccggcaggagccatcccggaacaaggagggcagcgagcggtggccaggagctgccgggggccacgcagagtctgcttctgatctgactgggtttttagatgtgacctgccccaggcactctgctctgcacagcccacacacacacacacacacacaaaacacacaagggcacacacatgagctcacagctctgctcccaaccatgagtctcagaggtggactccccctcaaccccccacgatgagtggcagggggagatgaaggatgggtgggcaagggcagagaagmggagccacaccaggagaggggaaagctctaggaaaggagggcgctggccaggaccctgagaacatatgctgaccatcacgctctcccagacttccctctctgggccctgctcctccaatcccagagctccacatgacggagagagaggtgggagcagggagacaaaatacagaggcaaggagcggtggtggggcacggtaggaaagagcaggagaagaaaaagacaaagagctggggcacagaaaagggatgaggagtgccagatgggtttgcaggagagcagaggggaagaccagggtg

SEQ ID NO: 170963 - DNA, 601 bp, Human
aattttcacaaactccctaaggccaagggccacccacactcaccagctgcttgttgaaattctggacgcactgctcaaactgctcatccttggtctcatctgccttccccagcttctggagaacctgccgaagccaagagagaaggggagagtgttaccttggaaaggagagtggtcaaaccaagagtgctcagtcaccaacagcacagaccaggggctgggaagtctctagccaacatcacccagcccagggtgcccacccagggctgcaatcccagggcatggctgggtccatcaggtyttcaggcctccccaccctctacccagggctcgacaataggccaaaaatggagcttaggacaggcttgacgtagtgaccacagccaggaggagggaggcttcaaagatggcaagaaggatcgggcaccctcctagctgatctcacactgcacccctgggtgctccgcccccaccctggaagctgaaaagtgagccacgcaggggaggggccaagcaggagcagcctcacttctccgcatgactctattccctgggcccaggcccatgaatgccacaggcaacagcagagcaggccctgaac

SEQ ID NO: 170964 - DNA, 601 bp, Human
gaggaagggtccacctcactcctgacacagccaccctaagtcttcacaattaaaggctttgttggtcgagacgaggattaaagtgtgttcatgatgggatgctatcgtgtcctctgatgtcacagaatcttccagatccagcttctctccctgccaggcctccaccatcccagccacacctctcacgccgtccccacctcccccccacagcaggggtccccatggggtgggtcgttgtgctcccccgggcttcaggccgtaccagggctccttgtgtttcccaaacaacgctgggctgtgygccggcacgtggcacgcagatgtgcaaggggccggccagagcactgcctccctgtgcccactgcagctggcttcctaagctcctcatcagtccccagggtagacacagccctcccccgacggaggccccagccagctaccctccgcagggcagcgtccaggccagtacagagcagtgtgtgtttgcttccaagtggctccctcagcccctaaacagggatctgagaaagaattctctggaggtcccagagttcacagagcccagctgggggaagataagattcgggagccactgcccacc

SEQ ID NO: 170965 - DNA, 601 bp, Human
ctgagtgaagaaacagaagactgctccacggacactgagacctccctggaattccatcagggggtcggatggagaccccgcggggccggggaatgaggaagggtccacctcactcctgacacagccaccctaagtcttcacaattaaaggctttgttggtcgagacgaggattaaagtgtgttcatgatgggatgctatcgtgtcctctgatgtcacagaatcttccagatccagcttctctccctgccaggcctccaccatcccagccacacctctcacgccgtccccacctcccccccrcagcaggggtccccatggggtgggtcgttgtgctcccccgggcttcaggccgtaccagggctccttgtgtttcccaaacaacgctgggctgtgcgccggcacgtggcacgcagatgtgcaaggggccggccagagcactgcctccctgtgcccactgcagctggcttcctaagctcctcatcagtccccagggtagacacagccctcccccgacggaggccccagccagctaccctccgcagggcagcgtccaggccagtacagagcagtgtgtgtttgcttccaagtggctccctcagc

SEQ ID NO: 170966 - DNA, 601 bp, Human
tcctgccctgaaggaggggcagctggccatggtcccaggagacccagcatgcctgcagcgctccagtctggccagcttcatgcttgcgcaagagccggaaggtgggccccatccattcaggtccacctccaggtgaaggccagcagggacccggccacatccacaggctcacccccagcaccctgaaaccctcttctgtctccccactacaggcctctccctgtccttagccggggctgctcttcctgccctggtgccctaggggccagcaccttccaggcagtcttctcaacaccactgycccacctgacagcaaagaagcggacagagggtcagcgaccggcccagtcacacagagactcggagagcccatgagaccctccaagcctgggcacgcagcccgcagggtgttttgtgggtaatgggtagtgatgcggccctgagaacccacagatctgcctattatgatgaatgcttccgtgtgacagtagagacatccacagggggagcttcagagcagcacataagatgtataatttaaagagagcatgtgtgaaaaaaaaaaaaatctctaaaattcctttaatcccccatagagtag

SEQ ID NO: 170967 - DNA, 601 bp, Human
ctaaggacaggaacacaaggcagagaggggactcgggagagcggcagtggctgaggctgaccttcgtagtagaagggcaccctcctggcctcccctgcctgctgccagcccaagcctcagggacacccatgttccagtcgcctcctgccctgaaggaggggcagctggccatggtcccaggagacccagcatgcctgcagcgctccagtctggccagcttcatgcttgcgcaagagccggaaggtgggccccatccattcaggtccacctccaggtgaaggccagcagggacccggccacmtccacaggctcacccccagcaccctgaaaccctcttctgtctccccactacaggcctctccctgtccttagccggggctgctcttcctgccctggtgccctaggggccagcaccttccaggcagtcttctcaacaccactgtcccacctgacagcaaagaagcggacagagggtcagcgaccggcccagtcacacagagactcggagagcccatgagaccctccaagcctgggcacgcagcccgcagggtgttttgtgggtaatgggtagtgatgcggccctgagaacccacagatctgc

SEQ ID NO: 170968 - DNA, 601 bp, Human
gatcactggcccagctgacagcagggacataggatgtagagggaaaaggctgaggggacagtgggctgggtggtgaagctccctgagcagggagagtgtcctccaggggcttcctgagacagcaggaccagcagagacagtagaagcatgggccaggcctcaagtccctctgggacatcaaaaccagagccaggaaagctgagtggagaactccaggttccaggaggggtgaacaataggtgaggccagcactgaggtctgagaccatgctcagtgagctgcagaagtttccagaagccaygtgcaaagagtgggctgcacacgggctttgaggccatgcagacccagctgtgtcccttactagccacacagccctaagtaagctagtgagcctctctgaacctcagtctcctcgtctttcagtggaaggcgaataatccctgcctggcactcctcagatccagtgagctaggccaggccctggagcttgaaggcaggcctcaggagatggccttcatgctaaggacaggaacacaaggcagagaggggactcgggagagcggcagtggctgaggctgaccttcgtagtagaagggcaccc

SEQ ID NO: 170969 - DNA, 601 bp, Human
agtttgaagggactcgtagtggtgccgggcactgtcgtagtccaccagcttgcgcccccgcttggcaatgcgtgactggggcagacagaggagggcactaagcggggcctggcacccctgctgagactccaggtccagtggatcctggagggacccgcagggcgggcaggagaccccagctccacaggaacccttgagcccttgttgctggaaccctcctcgtggcagagagctcaccccctcctggccgtccagccccactgtgtgaaaccacttccttgcacatgagcccatgtgtccrtgtccaccagctggtgacgtgtcagccaagtcttttccttggcctggcccctggcttctcatctccacagccaccaacatcagactcagggagcttgaggcatctgcactggggacccctgaggctagcatgagcatgacacccccatcctgcccaccaaggggatctcgtccaacccaatggtcaacccaggcttccatgtgcacgttaccggggaccactcgcctcggtggataccagagacactgccagctccgagcaccaacccaggcctggcagagacagcaggctttgcgaatg

SEQ ID NO: 170970 - DNA, 601 bp, Human
cccaggaggcccattctcaggctggcaggtggcctggatcagggctgaggggccagggtggcacggggggcaggaatgggcctagggtggacctcacccaggcacccacaagggcctctcactcaccggcctgggccctgtatcgtccccacccccagttcagccacctggggccaggcaggaggaagcctccaccctcggggtcctagacacccgccctctctcagccccctgcagacgctgccccgacccgcctccagcccttaccttggcaattttggcttcatccttctttttggcrgtttgaagggactcgtagtggtgccgggcactgtcgtagtccaccagcttgcgcccccgcttggcaatgcgtgactggggcagacagaggagggcactaagcggggcctggcacccctgctgagactccaggtccagtggatcctggagggacccgcagggcgggcaggagaccccagctccacaggaacccttgagcccttgttgctggaaccctcctcgtggcagagagctcaccccctcctggccgtccagccccactgtgtgaaaccacttccttgcacatgagcccatgtgtccg

SEQ ID NO: 170971 - DNA, 601 bp, Human
cagcctctcgggaatatggagaagtgtgagggccacatccaggctgtgactacactgacctgaaatgtgcctcagtttcattggcgagaaaaccacatgacccacctctcacagggcactgcatccagtggtccctggccacactgtaacccatttggagggcagggggctgagaagaccatagcctctatggccaggatggtgagatggcccaggagttttgtaaaaaagcctcctccgggaagccccccaggaacactgtggtgctggtcacttgccctccatgaatccccaaaggccraggacccatgcttcccctccacgtctcagcatcccatccagactggagggtcctcccagtaactcctccagagtcaccacggggaccacaagtccgaggaaaatgacgcaggggcttcagtcaggagagccccaaccctgcccctaaccggctctggggccctgggaggaggctgtgatgtgcctctctgggcagctttctctgctcagtaaattcaagatgatctcagagttgtcatgtggcttgaaggacaggcatggcagtacaggggcctgatgatgtcgcctccctccccagagg

SEQ ID NO: 170972 - DNA, 601 bp, Human
ccgggcccctatcgccagcctctcgggaatatggagaagtgtgagggccacatccaggctgtgactacactgacctgaaatgtgcctcagtttcattggcgagaaaaccacatgacccacctctcacagggcactgcatccagtggtccctggccacactgtaacccatttggagggcagggggctgagaagaccatagcctctatggccaggatggtgagatggcccaggagttttgtaaaaaagcctcctccgggaagccccccaggaacactgtggtgctggtcacttgccctccatraatccccaaaggccaaggacccatgcttcccctccacgtctcagcatcccatccagactggagggtcctcccagtaactcctccagagtcaccacggggaccacaagtccgaggaaaatgacgcaggggcttcagtcaggagagccccaaccctgcccctaaccggctctggggccctgggaggaggctgtgatgtgcctctctgggcagctttctctgctcagtaaattcaagatgatctcagagttgtcatgtggcttgaaggacaggcatggcagtacaggggcctgatgatgtcgc

SEQ ID NO: 170973 - DNA, 601 bp, Human
gaagatgatgaaatcaagaggaggctccgaaaaaatggggcagctgcccagagagaaacccaacctccggggccgggcccctatcgccagcctctcgggaatatggagaagtgtgagggccacatccaggctgtgactacactgacctgaaatgtgcctcagtttcattggcgagaaaaccacatgacccacctctcacagggcactgcatccagtggtccctggccacactgtaacccatttggagggcagggggctgagaagaccatagcctctatggccaggatggtgagatggcccrggagttttgtaaaaaagcctcctccgggaagccccccaggaacactgtggtgctggtcacttgccctccatgaatccccaaaggccaaggacccatgcttcccctccacgtctcagcatcccatccagactggagggtcctcccagtaactcctccagagtcaccacggggaccacaagtccgaggaaaatgacgcaggggcttcagtcaggagagccccaaccctgcccctaaccggctctggggccctgggaggaggctgtgatgtgcctctctgggcagctttctctgctcagtaaa

SEQ ID NO: 170974 - DNA, 601 bp, Human
cctactgaagtccccctaggcatcacccccagcccctggttccccatgggcaccctgacctcaggatgaggctgtcaacactcagtgtctccaaagtcagccttggcctaaaataaatcaggcagcagatcaggtgagaaactggacagccaggccaggagcagtggctcaggcctgtaatcccagcactttgggaggccgaggcaggtggatcgctcagccccaggagttcaagaccagcctgggcaacataatgaggcacagtctctacaaaaaacgtaaagattagccaggcacggcratgcgtgcctgtggtcccagctactcgggaggctgaggcagaaggattgcttgagttggggaagtcaaggctgcagtgagtcatgatcacaccactgcactccagccaggggaacggagagaaacccgttcaaaaaaaaaaaaaaaatagaaaaagaaattggacagcaagccatgccaagcccacccagagctctccacgtcacaggcactcaatgaagatgatgaaatcaagaggaggctccgaaaaaatggggcagctgcccagagagaaacccaacctccggggccgggcccctat

SEQ ID NO: 170975 - DNA, 601 bp, Human
ggcgtctgagctgtgtgaaggtgtttgctggaggccaccacagcctggactggacagccttccctacaggcgaggctctgtgtgggaagggtcctggcctacccacaggaggaaggctgaggccttgagggctggacttgaggaggcagtcagctctcggggagtgcggggaaggccggccacctctgggcaaatctgacaacacgtcagcccactccagcactggcaagatgcgcttccagcacaggtactccagcccgacctccaccatgaaggacgtaagacctggggctgtgggccrggctccccagaggcacctccacggctgagccaagagcccactgggagagacccaagaccctctgcgtggctccttgctgagccaagggcccgtcgggagagacccaagcccccctgggtggctccctgctgtatctgggcattccacgcctcttagggagtgtgcacacggcagttctgccctgcagcctggccgctgcccccgccctcgaggggctgacagcagctgtgggagctgaagtccaggtgcttcagccattccaggaccttccaactctccctggccctggaagccttccct

SEQ ID NO: 170976 - DNA, 601 bp, Human
caccatgaaggatgtgagacctggggctgtgggccgggctccccagaggcacctccatagctgagccgagggcccattgggagagacccaaggtcctcagtcctaagaggacccagctgtcctgcagctcaggggacaaggcgtggagcagttccacatggccaagccaaggtgtcagacagctcaggccaagtggactcacttcctagaaccaggggccctaggccccaagccctgccctgggccaatcccagcagctgactttcctttaggtccagccctgtctggggaacccagggcagggaggtcactgctctgccccataaccggccgtctctgaaggagccctgaggacgccggtgcacagcctcgaggtgcctcccaccagcgggcggccagcatctctccccagtggcccccaccctgccccagcaacacccctccctcctgtctcagaaaagtcagccaacccaggcagcaatatccgtcatgtgctgaggggagggtcatccgccagagagctgaccatcccttcgctgtgctgccccggcaggtggcacctcgccatgcaggcccgggactgtccctccatgcagggaca

SEQ ID NO: 170977 - DNA, 601 bp, Human
cacaccaggaggacgaccccagtgcccgcctcaaactcccagtcataggtccgcccgtggccgccaccccgcagggccagcaccaggccccagctctcttccgccaccatccacagactggtgggcccctccccaccaatgcccgaacctcctctccgctccctgcgccaagagttctgctgatcttgctaccccccagtggcgagagtaacaccatgccacagccaccctcagtgctcccgactgggaaagttccaaaggcagagacttcacactggcttttcctccaccccagacaggsaggtcactctctggcgacaccaccagccgtcagctccagggacggagaaagagtggagccagccacaaagcccaacaggccaagcttcaaagtggggtcttcaacattcgggggcttcagaaccacccggggcacttgggttaaaactgcaggcccctgacccctcccagcagcccctcgccaagatctccttccagtgagcccaggaataggcatgtgacaggcatggccccagggatgggacacggtggccctggccacacagggacaagcctccccataagctgggccagactagca

SEQ ID NO: 170978 - DNA, 601 bp, Human
gcaacatgagcccagggttgggcacctggaagctggtgggcccatgggcagtggtgggcacaaccaacctgaccagagggcgtgggtgccttcacagggctcgtcacgggcgggagggggtcaaagtccaggtccagcagactggcctgctccgagaaaggccccggggcctcaaacttggcagcagcagcagcagcagaggaggaagcagttagtgttaagctgggagccctcaccccaggcagacactgcaggcacaggcacacgcgtggacacacacacatacacacaccacgcatgcagagcaagcgcacatacacgcacacacgctggcacacagcccaggcaccaactcatccacctcacacacgggagcactgcccaaagccacgcgccccggcacaggctcccgcccacaccaggaggacgaccccagtgcccgcctcaaactcccagtcataggtccgcccgtggccgccaccccgcagggccagcaccaggccccagctctcttccgccaccatccacagactggtgggcccctccccaccaatgcccgaacctcctctccgctccctgcgccaagagttctgctgatctt

SEQ ID NO: 170979 - DNA, 601 bp, Human
cacggcggtgccagccgcagccaggatgcctgtggtccccctgcgctctggcggccccacccagccctcacctgctcttcagggttctggaaggggatcaccagcaccacatcaccagccttgagctgcagctcgtctgtgtcagtggccgtgtagtcgtgctgggcctgtacctgcagaggatgcggatcgcaagtcagaccttccgtcccacctccagccctgcacagagcacgggccttgcgtgtgggaggtgcaggtggcagtatggagaccaggagtgctcaaaagcagcaggacwgtatggggctcagatgccaccttgctggctgggagtgacctagtagcgcctgcacaactttgggcaaaccacagagtctcctgaggctcagggttctcatctgcccaccagggcaccgagggactgcagcagtcagaggctgtgggctcaccttgaacatgaaacctgggggcaggtccaagcgcccggccccactgccgccctccacggtgccattcacagttgctgggaaggtctccaccacgacagcaggaagagagctctggtggcagaggtacgggtcagctgagcagggaggtg

SEQ ID NO: 170980 - DNA, 601 bp, Human
agagaggaaaaagcccgacgtggagggcggggaggagcagttggcgcgggagccctggtgctcgcgggcctctgctgccccctgctggcctgtctccgccacggcggtgccagccgcagccaggatgcctgtggtccccctgcgctctggcggccccacccagccctcacctgctcttcagggttctggaaggggatcaccagcaccacatcaccagccttgagctgcagctcgtctgtgtcagtggccgtgtagtcgtgctgggcctgtacctgcagaggatgcggatcgcaagtcagascttccgtcccacctccagccctgcacagagcacgggccttgcgtgtgggaggtgcaggtggcagtatggagaccaggagtgctcaaaagcagcaggacagtatggggctcagatgccaccttgctggctgggagtgacctagtagcgcctgcacaactttgggcaaaccacagagtctcctgaggctcagggttctcatctgcccaccagggcaccgagggactgcagcagtcagaggctgtgggctcaccttgaacatgaaacctgggggcaggtccaagcgcccggccccactgccgc

SEQ ID NO: 170981 - DNA, 601 bp, Human
agaggagagggagagaggaaaaagcccgacgtggagggcggggaggagcagttggcgcgggagccctggtgctcgcgggcctctgctgccccctgctggcctgtctccgccacggcggtgccagccgcagccaggatgcctgtggtccccctgcgctctggcggccccacccagccctcacctgctcttcagggttctggaaggggatcaccagcaccacatcaccagccttgagctgcagctcgtctgtgtcagtggccgtgtagtcgtgctgggcctgtacctgcagaggatgcggatsgcaagtcagaccttccgtcccacctccagccctgcacagagcacgggccttgcgtgtgggaggtgcaggtggcagtatggagaccaggagtgctcaaaagcagcaggacagtatggggctcagatgccaccttgctggctgggagtgacctagtagcgcctgcacaactttgggcaaaccacagagtctcctgaggctcagggttctcatctgcccaccagggcaccgagggactgcagcagtcagaggctgtgggctcaccttgaacatgaaacctgggggcaggtccaagcgcccggc

SEQ ID NO: 170982 - DNA, 601 bp, Human
ttcttatcagacttctatcccagaacccaactgagtatttttttcctttttctttctgcttttcctctttcctttatcctcccctatatccttcccttttcatctctgtccttagaatgccttatatttccatattagtttatggttctcaaattgctttcatatgccattaataaaaacaactactttctgaagtaagtagggttactactcttaatattgttttattaatgagcacgacagaggggaggcaatttccaaaagattttagagatggcatgatatggaattaagtaatttrttagatttaccaaataaaaatttacattatagaaactttaaaatactgtttttaaataaagaacactatttacatggttaaaaatatacatgcactaagaacaaatatataatgaagagtacagtctcttttccttaccacccattccctgaagacctctgttctatttcttagacatactgttaaacatttttcagtatcttcccataaatgttctatgcatatgcaagcacacacaatcttttaaagcaaatgataacttactcctctacatcttgttcatttttcttttatcagtgc

SEQ ID NO: 170983 - DNA, 601 bp, Human
ctcaggaggctgaggcaggagaattgcttgaacctgggaggcagaggttacagtgagctgagatcatgccaccgcactccaaccagggcaacagatcaagactccatcttggggaaaaaaaaaaaaattagccaggcttggtggtggatgcctgtattcccagcttcttgggagactgaagcaggaggatcgcttgaacccaggaggcagaggttgcagtgagttgagattgtgccactgtactccagcctgggcaacagaaacaatactccgtctcaaaaaaaaaaaaaaaaaaaaaaaatcaagacaccaaacacacacaactaattagctctataaattgaattaaaagaaaatccatactgacttgctttcccatctgtccatatttgtctatccaaatgattaagggctagagaaaatacagatgatgatggctgagatgggataaaactataaattgacttggttccatttacctcccagaatcagcatacagtgacaaagtagagagaaaaggtctgggcaccacaaacttgtacttgtgctagaaatgtaggtgccttttcatttgcccagcagggctagtttaacagccagg

SEQ ID NO: 170984 - DNA, 601 bp, Human
ttaacagactgtggtttttagatggctttccatatctacaagaactatttagttctcaaaactgggaagaaatgtttcagaggcatcattaattcataatctaaaaatttatcttgggtttccttttttcccccagattctgtatcctccatagtcctattcatgacatgggtcgttcatctctgtattctaaaccctcaatgaactgtagacagtaataaatatttattggatgaatggtctctcatcagccaccttttctttttttttttttgagacagagtctcactctgtcactcargctggagtgcagtggcgcgatctcggttcactgcaacctctgcctcccgggttcaagtgattctcccacctgagcctcccgagtagctgggattacaggtgcacgccaccttgtctggctaatttttgtatttttagtagagacagggtttcaccgtgttggtcaggctggtctcaaacgcctgacctcaggtgatctgcccgacttggcctcccaaagtgctgggattacaggtgtgagccaccgcacctggcctccagcctcttttcttttttttttttgagacaagtctaactctgt

SEQ ID NO: 170985 - DNA, 601 bp, Human; identical to SEQ ID NO: 32384

SEQ ID NO: 170986 - DNA, 601 bp, Human; identical to SEQ ID NO: 32385

SEQ ID NO: 170987 - DNA, 601 bp, Human; identical to SEQ ID NO: 32386

SEQ ID NO: 170988 - DNA, 601 bp, Human; identical to SEQ ID NO: 32387

SEQ ID NO: 170989 - DNA, 601 bp, Human; identical to SEQ ID NO: 32388

SEQ ID NO: 170990 - DNA, 601 bp, Human; identical to SEQ ID NO: 32389

SEQ ID NO: 170991 - DNA, 601 bp, Human; identical to SEQ ID NO: 32390

SEQ ID NO: 170992 - DNA, 601 bp, Human; identical to SEQ ID NO: 32391

SEQ ID NO: 170993 - DNA, 601 bp, Human; identical to SEQ ID NO: 32392

SEQ ID NO: 170994 - DNA, 601 bp, Human
gaaaataatatagtgactgtcattggaagaattacatgaaacagtagtttagatcttttgtgtgaaaccttttggtctacttttgtaggtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtgagtcctccacacttttccagacatgtgttttttctgaaagttattataggtacaagagaagyttacctctcctgaatgagaatttgatctactgttagcttctgtggttactgaccaactggtggcgtttatttaccttcttccacatccacgctttctgtcttgggttttccttttcagagagaactgagctgcttttcccaggcaagacattagacaaattcaagtcctctgtataatgcagggaacacagcaacagtaatacttgaagcagcagtactcttgaccttgttagatcacactgctcaaaaggaaatcagacaacctgagcttgctctgtgctctgagcttccccattttac

SEQ ID NO: 170995 - DNA, 601 bp, Human
taacagtagctactcaccacttacaactttcctaggtggaaaaaaacaagttattgatgacttctagaaagagaaagataatgagagagttattttctaggatacttagaatgaaagcttttctgaagacagagtaaaaccttccaaagtccatttcagcctaggattctcttacttcagctaataaagcacaaaacccctcttgggatgctgcaaccatcacaaaaggaaatgccagtagaaaactaatttggtatttgttgttttgtttgtttgcttgggtttttggttttgtttttttgtttgtatatatgtttccttatgtttcttacctaataagctgaaatggagccttctccttttctttcacttaaagatctctcttagctgtaatggtttgctctccaggcattgtctatatctaaacagaacaattgaattgatttgcttttctatgctttgggggttttgtctgattaccccatttaaatggaactgtttgatcacaaattggaagttttgaagcctgcaaactgggagatcttctgctatctctaaatagcaagccactgatttccaatttaatatggttacttcattt

SEQ ID NO: 170996 - DNA, 601 bp, Human
atgtttcttacctaataagctgaaatggagccttctccttttctttcacttaaagatctctcttagctgtaatggtttgctctccaggcattgtctatatctaaacagaacaattgaattgatttgcttttctatgctttgggggttttgtctgattaccccatttaaatggaactgtttgatcacaaattggaagttttgaagcctgcaaactgggagatcttctgctatctctaaatagcaagccactgatttccaatttaatatggttacttcatttacacagggttcttgccctcayagaaatcacactctcatccccatcacttctctcttctccagggcatttgccccctcgagatcagagagacagagtggggaactgtcagcgaatgttcatttgatgcaaaatatgcacatcttcaaatatgctcataatacacattcaaatggtctataacctccccagacacagagcttgacttctaaatgttcaacaaactttggatggaaagaaagaaatacactgaaagatctttctttctttctttctttctttggctaggcctgaaacatggtgtatgaaaaagtgcttcactag

SEQ ID NO: 170997 - DNA, 601 bp, Human
tcaaatggtctataacctccccagacacagagcttgacttctaaatgttcaacaaactttggatggaaagaaagaaatacactgaaagatctttctttctttctttctttctttggctaggcctgaaacatggtgtatgaaaaagtgcttcactagccataaagtgttataggaaattaaataatatcactaagttgaattttaaattttgtcaagtggatttaactcacgagaagcggattcccaaattggggaaagagattattgacaaaagactggagagaggtcttggagttttttstgttttgtttttttttttcttaaaacaaactattgctaaatatcattttaaatggctggggtataaagaactgcaaaatatgtagatcaaatttcctctacaggacacttgggtgtaaaaagtaggcagatcggtggttggaaaaatattaagctttatgaaattcaaaatatttacaaaatagctcaatggtggcttcccacaaatgtactccccagtatcctgtgggaatagtttgccccaagcctctctctcagcaaaattttgaagagggccaaacctgggagtgctcccttctca

SEQ ID NO: 170998 - DNA, 601 bp, Human
attcccaaattggggaaagagattattgacaaaagactggagagaggtcttggagttttttctgttttgtttttttttttcttaaaacaaactattgctaaatatcattttaaatggctggggtataaagaactgcaaaatatgtagatcaaatttcctctacaggacacttgggtgtaaaaagtaggcagatcggtggttggaaaaatattaagctttatgaaattcaaaatatttacaaaatagctcaatggtggcttcccacaaatgtactccccagtatcctgtgggaatagtttgscccaagcctctctctcagcaaaattttgaagagggccaaacctgggagtgctcccttctcaccagccatccacacatctcctccctcaatattctggcccctttattagttgccatgtcaaatataaaaggaaattgataaaaaatgtcctgtacaaacttattttcagcattttaacttaccagaagcaaaactctcaccagctgttgtaccctgttctcctgattctctcccaggcccctctcacagagcacttcctcctgccccaacctgcctagcaagttgttagatggaaccttc

SEQ ID NO: 170999 - DNA, 601 bp, Human
ccaaaacatttcaaaggcaataactagccgagtaaattagtaaaagacgaaagaaacccagacattttttcagcatccctcccttagtgagaatccaccctccatacctctcatttgtacctcatagccttctttgtgtgagtcatttaggcacgtgcccacctttctgttagagcattcatcctgaagatttttatgtcatccttctcctacaaagttttgggtttagtgggtatgttgaatttgaattcaaatcaatcctaggaaatccagtccacatcctatgagaaatttccacccsgtcctgattttgcaataggcaaacttttcaacaaatagagctggaattcccaaaataaataaaaataaactcttttggtagaaaccaaaaagtggtcattccaggcagtcacagctctgccataagcaaacccactctaccacaggcatttgccattttcaaatctgaaacaatcatgtcttcctttttctgtatgtttctgtgctctttgtaacttttattaatctttattaatctatatgcatgagtatgtgtgtttttactgcaatctactttggtagcttttccaagtagcaaaga

SEQ ID NO: 171000 - DNA, 601 bp, Human
cgtgcccacctttctgttagagcattcatcctgaagatttttatgtcatccttctcctacaaagttttgggtttagtgggtatgttgaatttgaattcaaatcaatcctaggaaatccagtccacatcctatgagaaatttccacccggtcctgattttgcaataggcaaacttttcaacaaatagagctggaattcccaaaataaataaaaataaactcttttggtagaaaccaaaaagtggtcattccaggcagtcacagctctgccataagcaaacccactctaccacaggcatttgtcattttcaaatctgaaacaatcatgtcttcctttttctgtatgtttctgtgctctttgtaacttttattaatctttattaatctatatgcatgagtatgtgtgtttttactgcaatctactttggtagcttttccaagtagcaaagaaatagttacatgtaaacaaacaaatacaattaaaagatctgaggtggacttcataaagatagacactgtaatggaatgtatctgtagtatacaaatggctctacggttctgccaaaatctccaaaaaattatttctactttatcactgctgta

SEQ ID NO: 171001 - DNA, 601 bp, Human
tcattccaggcagtcacagctctgccataagcaaacccactctaccacaggcatttgccattttcaaatctgaaacaatcatgtcttcctttttctgtatgtttctgtgctctttgtaacttttattaatctttattaatctatatgcatgagtatgtgtgtttttactgcaatctactttggtagcttttccaagtagcaaagaaatagttacatgtaaacaaacaaatacaattaaaagatctgaggtggacttcataaagatagacactgtaatggaatgtatctgtagtatacaaayggctctacggttctgccaaaatctccaaaaaattatttctactttatcactgctgtaaatgtaattttatccaacaaagagtaaatcagatcaattgtggcactgttgaaacactggtactagaactgtgtatgaccagagatttaaaaagcaaaccttgccaggcacagagactcacgcctgtaatcccagcactttgggaggctgaggccagtagatcacctgaggtcaggagattgagaccaccctggccaacatgatgaaattccgtctttactaaaaatacaaaaattagccagg

SEQ ID NO: 171002 - DNA, 601 bp, Human
gtcacagctctgccataagcaaacccactctaccacaggcatttgccattttcaaatctgaaacaatcatgtcttcctttttctgtatgtttctgtgctctttgtaacttttattaatctttattaatctatatgcatgagtatgtgtgtttttactgcaatctactttggtagcttttccaagtagcaaagaaatagttacatgtaaacaaacaaatacaattaaaagatctgaggtggacttcataaagatagacactgtaatggaatgtatctgtagtatacaaatggctctacggtwctgccaaaatctccaaaaaattatttctactttatcactgctgtaaatgtaattttatccaacaaagagtaaatcagatcaattgtggcactgttgaaacactggtactagaactgtgtatgaccagagatttaaaaagcaaaccttgccaggcacagagactcacgcctgtaatcccagcactttgggaggctgaggccagtagatcacctgaggtcaggagattgagaccaccctggccaacatgatgaaattccgtctttactaaaaatacaaaaattagccaggtgtggcggcaca

SEQ ID NO: 171003 - DNA, 601 bp, Human
tatgatatattttataagggcccatgttattccatatactgtcttgaaagaaacaagaatttatcacaaatgcaccagggctgtgtttatacaaggaaaagcaactctgatactcaacatatgtaggaggggaacatcttaacaggcccaaggatccacactgaaagcttttctcccaaatgcttttctcattagcaagtaaaaaaatacaacagttgtttatacaacagagccaaccaagtgacttcgggggctcagcagtgagttacagcttagtctagaccacacttaatttagtccraacttggtctagaccatactcaagggtcctatccggcaggaagcagcccagccctcaaagtcatgacctatggatgttattccacacaaaaccatccaatgcagggcaaaggccagtttgctcgagactgaacaaattcctgctctctataagctcccgccccaagcctcagtgagctcctcggggagtagagagcatggtcagaaaagcaacaaccacaaatgcagctgcaggccaccaccaaagtagatcccagaacagggacgcccgcctaagacagagggaccacacatacgacgc

SEQ ID NO: 171004 - DNA, 601 bp, Human
caccacctcctaatactctcaccttgggagtgaggattgcaacatatgaattcggaggaatcagactttcagaccataccactgactaacaaaaaggaacaaaaggccgggcatggtggctcacacctgtaatcccagcactttgggaggccaaggtggatggatctgttgaactcaggagtttgagaccagcctgggcgatatggtgaaaacccgtttctacaaaaaatacaaaaattagccaggtgtggtggcacacgcctgtagtcccacctactcaggaggctgaggggggaggatsacctgagcccaggaggttgaggctgaagtgagccgagatcttgccactgcattccagtctgggtgacaaaatgagaccctgtcttaaaagaaaaaaaggaacaagagtcattatgtttttcaaaatcatttgtttattgagatggtaaggaaaaaaataggtgttcatgtttgtatgaactatactaatatatagcacaaatgaattactaattttttaaaaattagaatacagtattcatctcatactatattaagtataattgggggagaggatatgatgacttcaaatgtcttgtgc

SEQ ID NO: 171005 - DNA, 601 bp, Human
caattaaagttaaataaaatctcaaattagttcctcagttgcactagccacatttcaagtcctcagtagccacatgtggctagtgcagattcatagaacatttcatcataaaaatatgctctactggaaagcactgttctaaggtctttttcttttattttttaattatttactttttattgacatataatagttgcacatatgttggggatacatgtgatcatttaagtgagactaatctcagctgatgtaatggaaaagaggcagtgtgcataatctggttggtgtagtttatactagrttatgaatgatagccttaatccaatcatcagtacatcagaaagcattttgattttgataaccaaaatgaacctttaagagaaaaaaagactcctggacccctccttcagaccaccatcccttcaacacactcaatgccaagcacactcaatgccaagcaaatagggtcctccatggggcaatctgtttctgaaagttttcccatttgagtttgttgttttcttgaaaagatcccttcagtgcattactttacaactattggctgctttttgcttctgtctctggactactgagatctttg

SEQ ID NO: 171006 - DNA, 601 bp, Human
caataaccagggaagagccaacaaaacagataatgcttgttaagaaagagtttccctatccatgctatgacccagccacacgcgaaggtgaccttaaacttttacaggtacgtatctttgattgtcttctcaaaagtcatagaaccttctacaatctggccgccgacgtgaaaacctttccttggtgcccctgttgtaaaaactcacaataaagaggatcctgaaattttggactataatttaaaatgtaaatatttatcttatcccattaacactttatgtttttcttccaacagctgacggaaaaagcaaaaattaacaaatatgtgactatccttcatctacctaaaaagggggatgatgtgaaaccaggaaccatgtgccaagttgcagggtggggcaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatgtaagtaaaataagatcccacgtttcagctattga

SEQ ID NO: 171007 - DNA, 601 bp, Human
actggcttctacaggatcctagagctttttgaaataagtttaataaaaccccagtcaaataaatgaatgctcgcagctcaagtgagtcattaatcaaaaataagaagttcactgctagtgcatggggtgacctactacatatttttgattttttacaaaaattactaagaagcaatgtttggtctcatttttcatgttaacatacgtagatctaaacttgaagatatacaacacttatgagagctgaagtcagggttcctcaaggccactcagtactctttccccatttcagtacattccctctccttccccactacgttcctctgccatttaacatcggcatgtctgaaatgtctgtcaagcctggctgaatatttccagccagaccccatagcttcctagagcttagtttaatctgcagcaaacttcaaagcatgactcataccagaaaatgtgtaagcttccatcctagaaccccctgagaagaggtgggatagggccatgcttaaagatgagaatagaagaaacattttgcagatttttaaactgagtactaccttgcatttctcatttgtcccaaagaccctatagagccttacct

SEQ ID NO: 171008 - DNA, 601 bp, Human; identical to SEQ ID NO: 21779

SEQ ID NO: 171009 - DNA, 601 bp, Human
tggggcaacatggtggtactccatctctacaaaaattagctatgcacctgtagtcccagctactcaagaggctgagatgggaggacagcttgagcctcggaggtcgaggctgcagtgggctgtgtttgtgccactgcactccagactgggtgacaaaacaagaccctgtctctaaaagaaaaaaaaaaaagaaaaaaaagaaaacaaaacccaaacccataaagccttcttacaaatgtttacacaaagtagctctttaacgttaatatattttacaaataattactacatatctacaacrttccagatacagaagaaatggccaaagaaggtattttaggagatccagattataatgaactatgccatttattaatttagtcacttctttaatatctgaggatgagcaaatcaaatactgataatggctgcagaaggacacaggctcttatataataatcttacttccattccagaataaaagggctggagaaggggggcaggattattctgttgaaggacaatggcatcctcagcaactcacagggatgtgcaggtgaacatcagaccaggatgggaaccttataatatctatgatata

SEQ ID NO: 171010 - DNA, 601 bp, Human
atgaaaacctgcaaatcatatctttttgatgatcttctcagacctgtaatcccaacactttgggtggctgaagcaggcagagtggttgagcccaggggttcgagaccagctggggcaacatggtggtactccatctctacaaaaattagctatgcacctgtagtcccagctactcaagaggctgagatgggaggacagcttgagcctcggaggtcgaggctgcagtgggctgtgtttgtgccactgcactccagactgggtgacaaaacaagaccctgtctctaaaagaaaaaaaaaaaaraaaaaaaagaaaacaaaacccaaacccataaagccttcttacaaatgtttacacaaagtagctctttaacgttaatatattttacaaataattactacatatctacaacgttccagatacagaagaaatggccaaagaaggtattttaggagatccagattataatgaactatgccatttattaatttagtcacttctttaatatctgaggatgagcaaatcaaatactgataatggctgcagaaggacacaggctcttatataataatcttacttccattccagaataaaagggctgga

SEQ ID NO: 171011 - DNA, 601 bp, Human
aggacggggaagttcaatttaatattccttggacctagtactattgacaattaaagttacttaataaatactacctgtactaagaatagatgggaggaaggaagaaatgctactggaatctggtaacaatgggccagggatcaaaatattcataacctgagtgcttatgagtaactagatgttagaagttactacctatttgaagtaattaacactaagatgtgattagagcttaatcctgccagaggccagtagttttccaaattgctaactggactgacaaagacgtgtatgagtataytacaagactgtacagtgacaaaagcaaaatttatgcatgactggaatttctgctccatccctacaagctgtgtaaccctgggcatgttacttagcctctatgtctccattctcaaagattgggataacactgacctcacagagctgtttatgaagattaaagggcaataacatacatcaagtgccagacaataaatgctagtttccttccgtgttctacttcccttttcccaataagacagttttgccccagcaaacctcgactctctcatttggccagaggagtcctggggcagggtct

SEQ ID NO: 171012 - DNA, 601 bp, Human
tagatcatggtacctcctcctgtaagttccaagattcttcaccctccacagactattaatacctacttggaagtatcactctctccagcccacagatgaatcctgaatgttcttccttcctctcattcccatcccatattttttgggtaaaagttgtacccatctttttttgggaaaagctgtagttaaaaattttctattttcccctacttttaaaactgatctgtccctcccaaccctatccccactggaaagagaacatctccctaaaattctagatctcaagggataactttagttrtaacattttgcacaattttccaatttttttgtaaatacataaatttattaatttttaaaataaaaatgggcccaggctaggtggctcatacctgcaaccccagcactttgggaggctgaggcaggtggatcacttgagttcaagagttcgagcccagcgaacgagttcaaggttcgccagtcaacatggcgaaaccttgtctctactaaaaatacaaaaattagctgggcgtggtagcaggcgcctgtaaacccagctacttgggaggctgcggcaggagaatcacttgaacctgggagg

SEQ ID NO: 171013 - DNA, 601 bp, Human
agccttaattcagcctcttgtaatttctcacctggatgactataaaaaatctcccaggcagtcttcccctgcctccaggaatacccatgtcaatctactatcctcagagatattagaatatgaagataagagcatgacagtctccgcttaaaatcttccaatggctcccatagctttcagaatacagtccagaattcactgggtaatcataagaaaatgccttgtctttttctgctcctgtgcaggaactctcacaatgaacaatgaactcttaacagaaccctgaaaatgccatattttytccatatttttctttgcacatattgcttcctccaattgaaacaaactttgccttcccgccacatctcccctaattaagaaacagctctattttccttttaggaaacttttctgttattccccccctctttcctaagaaaccctcctatgtgatcatgcagcaatgtatacatacatttttcaaaacacttttcttaagatatgctgtttatttgtctatctcctcacctaggttgtgagttcctcaacaggagggaccaatctcagtgtctttgtattcccagtgcctgacacacagcag

SEQ ID NO: 171014 - DNA, 601 bp, Human
ttctggttttgctgctgccaagctgagcaagtctcagggctcccatttccttccctgtaaacaatggcagggtgggaccagattccagctactcctcttcagatctaagaccttgtgattccatagacagataatacactccagggtcccattccaggaccacagcctgctacctctgcagctcactcatctccctgctttcatgtaaacctactcttctctttgggttcactgaaaactttgtatctttttttaaaatcaaaacagttgtataggcctggtgcggtggctcaggtccatratctcagcactttgggaggctgaggcaggcggatcacttaaggtcgggagttagtgaccagcctggccaacacggtgagaccctgtctctactaaaaatacaaacaaattagctggtcatggtggtgggccctgtaatcccagctactcaggaggctgaggcaggagaatcacttgaacccaagagacggaggctacagtgagcagagactgcaccactgcaccccagcctgggcaatagagtgaaactgtctcaaaaaaaaaaaaaaaaaaaaaaaaaagagtagtacatactggttaa

SEQ ID NO: 171015 - DNA, 601 bp, Human
gatatttggctaagtctgtatctaggcaccaaatgccttctcagtaaacccagaagaagggcaagggccaatagtttagccagtaaactcattttctccagaaataatgtagttctaaatatttcactactatttatctttttttttgcatgtatctatttcttttgttatagttttccttttaaaaaaacctttccaattacatgtctttagcaagagctggacagacagtgtctgtggtagcatcattccccctgcccccagctacctgtcccctgctggcacctagaacatcagcccrcagactctcctactgcttcccagagcccctgactagggcagcagcagttgctgatgctgcacagggtaaaacctgtcaacttccagggacaattccacagagacgggaaaacacgccaattgttcccataaaaaaagcttcctggctgggcgcggtggcacacacctgtaatcccagaactttgggaggccgagatgggtggatcacttgaactcaggagttcaagactggcctgggcaatatggtgaaatcccatctctactaaaaatacaagaattagctgggcatggtggcaggcac

SEQ ID NO: 171016 - DNA, 601 bp, Human
ctcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctgagaagagacccagctatagggagctgaggtgtggtggacagcaactgccccagaaggactcccctagtccactgacactgtctcctagagtctagcaaggcccacacacaggtatgttraacccagagtattgtatgttctcaacagctggggcccctcttctggaaaccctgcagaagccccatgaaaattatcagagtccccagtttcaaagtgaaagaatccatgagacctcagcagtcactcagcacctgatttgagcagactgctagtgtactgttttggcttctccccactctgactctgacacccagcattctggagttccaggtcctcccttacctctagcctgactcaccatcagcacctgcatgaaaggtacaagagggcaggaaggggaggcagcatgctgttgctcc

SEQ ID NO: 171017 - DNA, 601 bp, Human
gggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagacaactcagcctgcaagagttggacttttcatggataacccctatcaggagctaaragagctgagaaaaggggtcccagaataaattgtgagaaagtgatcataagcttgggtttccaaggagcctgggttcatggctggacctagaagataaaaaaaatcatccactcttcctcttcagagtctgagaagagacccagctatagggagctgaggtgtggtggacagcaactgccccagaaggactcccctagtccactgacactgtctcctagagtctagcaaggcccacacacaggtatgttgaacccagagtattgtatgttctcaacagctggggcccctcttctggaaacc

SEQ ID NO: 171018 - DNA, 601 bp, Human
atgtctctatttggaaggttctcaatgtagcagagcataacatttgggtacacagggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagamaactcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctgagaagagacccagctatagggagctgaggtgtggtggacagcaactgccccagaaggactcccctagtccactgacactgtctcctagagtctagcaaggcccacacacaggtatg

SEQ ID NO: 171019 - DNA, 601 bp, Human
aatcacagttcatgcatccttgatctccccaggctcaggtgattctcccatcacagactcctgagtagctgggactacaggtttgcgccatcgcgcctggctaattttttgtattttcagtagagatggggtttcaccgtcttggccaggttagtctcaaactcctgagctcgggcaatccacccgccttggcctcccagagtgctaggattacaggtgtgagccactgcacctggccccaagttaaggctttgaacgtctctctcctatgaccttgttctaactaaagttagctctgccrgccaggtgtagtgactcatgcctgtaattctaccactctggcaggccaaggtgggcagattgcttgagcccaggagttcaagaccagcctgggtaacatgacgaaaccccagctctacaaaaaatacaaaaaaaaaaaaaaaaaattgagacgctgtctcaaaaacaaatatagttagctctgccaatgaagccaattcccctaaacatttgtatccctggaaacagcctgaacattgatctacagtagcctgtaaggtagatttaagtcactctgttattttttgagtcttggagcagc

SEQ ID NO: 171020 - DNA, 601 bp, Human
aggacccctgaaaggcacaagacacccttcaggttcacacttcctgaaagctagcagagtagaagatactcaaaatgcccacaagactccccagatatcagaaaacctgcccatagccctttggtgtcagggactatcttcaaaaaacttgatcataatttcccagaagttatcacatctgttttatctgagtatcataatgccagtgagataatcatggtaggtattaatactatgtccatttaacagaatataaatacataaaaagggaataaggccagaagagattctctcctgaagktcacaaggcaaattatcggcaaagttttggacttgaactcaagtctcctgactccaaatccagtgtccttcccctatattggtctaaaactggctggttaggatgagagaccctgttcttgccagcagggccacagccagattcagacattgacccataaacttggtctgagtgaaacgggaacatacctttctcatgagctctggaaaagtgaagctctcatatgggaaggaaggatcatctaccagatgccagtggaacacgttcaatttattgtacgccatgacatcctgtaggtta

SEQ ID NO: 171021 - DNA, 601 bp, Human
agagagagcctaatccagccaaactggcaaaatctttcttctctatctcctcctgtaggtggggtcaaccatcacccagaatctttttacatttgctaagggatatctcccttggcccagagactacttcctgacgctgaggtcacaagatatcttcagggtttttttttgattgttgttgtttgtttgtttttgagacagagtcttgctctgtcgcccaggctggagtacagtggcatgatcttggctcactgcaacctctgcctcctgggttcaagcgattctcctgcctcagcctccygagtagctgggattacaggcgcctgccaccacgcctggctaatttttgtatttttagtagagatggagtttcaccatgttggccaggctggtcttgaactcctgacctcaggtgatccacccgccttggcctccaaaagtggtgggattacagacatgagccaccacgcccggccaatatcttcagttttctatcaggccagtagcccttttcaactgtcatttaacctgtgttgggggctcacactggagggctgagggtatacagaagaaagggagcaggggtactgactgactctga

SEQ ID NO: 171022 - DNA, 601 bp, Human
cacaatcataggcagaggctaagttccagccagacaactgtcagtgcgcacactcttgcctggacacactgcttctagcaggtgctacccttgctcccaaggctgctctcctcacaggccttgaggcagagagagagcctaatccagccaaactggcaaaatctttcttctctatctcctcctgtaggtggggtcaaccatcacccagaatctttttacatttgctaagggatatctcccttggcccagagactacttcctgacgctgaggtcacaagatatcttcagggtttttttttgrttgttgttgtttgtttgtttttgagacagagtcttgctctgtcgcccaggctggagtacagtggcatgatcttggctcactgcaacctctgcctcctgggttcaagcgattctcctgcctcagcctcccgagtagctgggattacaggcgcctgccaccacgcctggctaatttttgtatttttagtagagatggagtttcaccatgttggccaggctggtcttgaactcctgacctcaggtgatccacccgccttggcctccaaaagtggtgggattacagacatgagccaccacgccc

SEQ ID NO: 171023 - DNA, 601 bp, Human
atccaaaccaggaggatcagtctctgtagaggcagggaggagctggggagaccagagggaggcactgctggtggcttcttctcttctctgccccggctcacctttactttattatcaaacacctcctgccacaccacatagcccttgccataagaagagacgatgtccagcagcctggagaggagaggagtgtctagtaagtgtctgcttagctcagatgggttctagactgtttgtgccagtgctctaggggttgagcctggccaggggcctattcctcattaagcagtgtctttccccwgggctgaaaaccaaccactccaaatctgaaaggatgggacaaaggacaagggaaccctgcagggaccagacagtggccaagcagggcctgactcggtatggaaagggaggaccccacaggaggacccccaagggaccccacccaccctccttccttcctcacgtctggatgtagaaggactccagctgcttgaagtcctcaccgaagcctttcttcctcataaagtcctggatctctgggttggacttcctgaatcccaagagaaaatgaagattaatctttcaacatcctgaaagccta

SEQ ID NO: 171024 - DNA, 601 bp, Human
agaaaaggagagtgctccgaccattaaagcccaatccaaaccaggaggatcagtctctgtagaggcagggaggagctggggagaccagagggaggcactgctggtggcttcttctcttctctgccccggctcacctttactttattatcaaacacctcctgccacaccacatagcccttgccataagaagagacgatgtccagcagcctggagaggagaggagtgtctagtaagtgtctgcttagctcagatgggttctagactgtttgtgccagtgctctaggggttgagcctggccagkggcctattcctcattaagcagtgtctttcccctgggctgaaaaccaaccactccaaatctgaaaggatgggacaaaggacaagggaaccctgcagggaccagacagtggccaagcagggcctgactcggtatggaaagggaggaccccacaggaggacccccaagggaccccacccaccctccttccttcctcacgtctggatgtagaaggactccagctgcttgaagtcctcaccgaagcctttcttcctcataaagtcctggatctctgggttggacttcctgaatcccaagagaaaa

SEQ ID NO: 171025 - DNA, 601 bp, Human
gatgagggctgactataagcctctgtaagtgttagctattgttaattattgtcttcctctctctaaggggttccccagccctggatctggcctgctccgccttgcgaaggccccacagcttgcttacctcagcaactcacagcggaagtgtgacaaacgttcataggcaaatgtcaggtcagatgtcaacttgttgctccacagcctttcggcaacagcccctgctctgggcctggaggaaaaggggcatgtgccagattgggccctgtattccctgcaaaggtgctggacatccacaggytgctacctcttgtctaggcaccctggactcactcaggccaaaggaagtgatcaataccttgttatgagccacagccaggttggatggctcccagagagttctacggctcagctccaccttcattaaaatgtgggtagcaatcccactctcttcctctctcaaagatacgggaataagaataaaccttaaagccatcattaaccacaatgacagtggcagcagcagaggtccttaaaatgtaaactttgcacacccaaccatacttggtaaggctgcagtgaaaacagcagagggaagcct

SEQ ID NO: 171026 - DNA, 601 bp, Human
aatggcaagataagcccctcagaaggggccccagcaacacttttcacaccagtcaacagtctctccttccccatttcggtgactctcaaactgtcactgtacaccaaatgcacctgggaatctcaattccagagattctcacctggggtggggcaaagtattggcaagaatctgcaagctgaacaggtgcctcaggtgattctgatacaggtcttggagatccagaaacgttggcgacatctatttatatcctgcccatctctgtaccctaaccccaaataactcaatccctttagaatayagatggatgtctgaaaggcagccaatgctcttggtctacttagccctctgttcctgactctaaaatgctgtaaatatggtggcactgggggacttaggtgctgtcctgtccatgaacatggatgcgaaatcctgtccttgggtctcagtctataacctgaccaatctccttaggggacctctaggcatgcttcccttatcatccaagtaagcaacatgcttagagaaccagctggaagttacccagtgaatgacataattgaggcttagacaccatcatgcttgactctcagcccaggac

SEQ ID NO: 171027 - DNA, 601 bp, Human
cacgtgcctattaattccagttactcaggaggctgatgcacgagaatcgcttgaacccaggaggcagaggctgcagtgagccaagattgtgccactgcactgtcagcctgggcgacagagtttttgagacagtctcaaaaacaaaaacaacaaaaaaacccactaccacagtgcctagagaacaatatgtgtttaataatatttaaataatggttgtataaaattgaagcagcaagaaacccaaaggagaatagctctaggggagggaggtggatgagtatgcatgggggagaggctcttytgtgaccaggttgggtctggagccctccccactgtccagaacacctccaagcccctacatctttttccatataccaacgccttggagatataatgcagaagtgaagtgagcaggctgaggattagggcaggtgtctggaatatggtcaggagtgggaggggagtgacatagctcacaggcaaggcagaacagcacaaaggctataggtttcattcccagccctcaacttaaaagacctcaggggcagacactgactccagcctggctgtgcccttaccctaacgccattcacactttttt

SEQ ID NO: 171028 - DNA, 601 bp, Human
tccagcctgtgtgacagtgagactccgtctcagaaaaaaaaaatatatatatatgaattagatggacatggtggcacgtgcctattaattccagttactcaggaggctgatgcacgagaatcgcttgaacccaggaggcagaggctgcagtgagccaagattgtgccactgcactgtcagcctgggcgacagagtttttgagacagtctcaaaaacaaaaacaacaaaaaaacccactaccacagtgcctagagaacaatatgtgtttaataatatttaaataatggttgtataaaattgmagcagcaagaaacccaaaggagaatagctctaggggagggaggtggatgagtatgcatgggggagaggctcttctgtgaccaggttgggtctggagccctccccactgtccagaacacctccaagcccctacatctttttccatataccaacgccttggagatataatgcagaagtgaagtgagcaggctgaggattagggcaggtgtctggaatatggtcaggagtgggaggggagtgacatagctcacaggcaaggcagaacagcacaaaggctataggtttcattcccagccctcaa

SEQ ID NO: 171029 - DNA, 601 bp, Human
ggaggtggagcttgcagtgagtcgagatcgtgccactgcactccagcctgtgtgacagtgagactccgtctcagaaaaaaaaaatatatatatatgaattagatggacatggtggcacgtgcctattaattccagttactcaggaggctgatgcacgagaatcgcttgaacccaggaggcagaggctgcagtgagccaagattgtgccactgcactgtcagcctgggcgacagagtttttgagacagtctcaaaaacaaaaacaacaaaaaaacccactaccacagtgcctagagaacaayatgtgtttaataatatttaaataatggttgtataaaattgaagcagcaagaaacccaaaggagaatagctctaggggagggaggtggatgagtatgcatgggggagaggctcttctgtgaccaggttgggtctggagccctccccactgtccagaacacctccaagcccctacatctttttccatataccaacgccttggagatataatgcagaagtgaagtgagcaggctgaggattagggcaggtgtctggaatatggtcaggagtgggaggggagtgacatagctcacaggcaaggc

SEQ ID NO: 171030 - DNA, 601 bp, Human
gggccaggaatgaagctgcacagacggcattagctgggcaccgggctctgccagtctacacttaagctcttaaggcagtacagagaaccaggtgacccggaccaatcattttttaattagttgtggcttttttttttttttttttttgagaaggagtctcgctctgtcgcccaggctggagtgcagtggcgcgatctcggctcactgcaagctccgtagttgaggcatttttaattaggggaaatgcatgcttcattatctgactcactgaaaggggagaagggactttttaagcctgcamgaaccacaatgtagtttccccactcacccagcgaagataattctctcaaaagcagaataattgaaaggttgagtcatcttccccacagagccccactcccccacagatttggtgatacgttacatttcccttccccacaagacagcccactcctgcccccacagcacctcaggccaccaaagggcaaattatttgctaacaacgctgcagcaggggagtcctgacctccatctcctctgtgacctagggagtggccacaccctcaagacggccaactgggggctactgaccctggctcca

SEQ ID NO: 171031 - DNA, 601 bp, Human
atctcaaaaaaaaaaaaaaaaaaaaaaaaaaaaacaaaaaactgaagcaaaataaactaaaacccaagtaaagtgagtttgtaatgtaagtgctgcattttcttctaccttcctgcccacggccgtttcctcatttcttccattgcctcaatattaagaaataaacagctttaggaaataaaatggtttttcctgtgaccccacatcagtgtcacaacattcaaggcacagaagcaactcccataaagtgctagctgtttagagtcaccgccaccaaatttgctaagtcactgggggtacrgttcttaaagagctaatgatgctctttgctaaaatatgaatacaacattatttctaatgcaatgcttaaaatgaaagcagttgtgctagacaggagaccaacatccatacattttggctcaagtcagtaactgagaaatgagttcaagaaccttctttaagtcatcattaatcaagtcccaggagaggcggctgtgcccgctacaaaagggccaggaatgaagctgcacagacggcattagctgggcaccgggctctgccagtctacacttaagctcttaaggcagtacagagaaccagg

SEQ ID NO: 171032 - DNA, 601 bp, Human
aaaatccttaagacctcataccaaataaaccaatctcacgaagacccttgaagttgcaataaaactctgctcacagggtcaacgcattcttgtgttataccagctaattgagatttgactgtggacttttggagtgattcagaaagaagggtaatgtcaaatgagtcattttcctctactccggtctcagtcttagctcttggccaagataacacatcctgacttgccttcataaaagctgaagcaggccaggtgcagtggctcacgcccgtaatcccggcactttgggaggccgaggccrgtggatcacctaagtcaggagttcaagaccagcctggccaacatggtgaaaccccatctctactaaaaatacaaaaatattagctgggcgtggtgcaagtgcctgtaattccagctacttcgggaggctgaggcaggagaattgcttgaacccaggaggtggaggttgcagtgagccgagatcacaccattgcactccagactgggcaacaagagcaaaactatctcaaaaaaaaaaaaaaaaaaaaaaaaaaaaacaaaaaactgaagcaaaataaactaaaacccaagtaaagtgagt

SEQ ID NO: 171033 - DNA, 601 bp, Human
tatcagaactgatgcttaaagggacaacttaaaatccttaagacctcataccaaataaaccaatctcacgaagacccttgaagttgcaataaaactctgctcacagggtcaacgcattcttgtgttataccagctaattgagatttgactgtggacttttggagtgattcagaaagaagggtaatgtcaaatgagtcattttcctctactccggtctcagtcttagctcttggccaagataacacatcctgacttgccttcataaaagctgaagcaggccaggtgcagtggctcacgcccrtaatcccggcactttgggaggccgaggccggtggatcacctaagtcaggagttcaagaccagcctggccaacatggtgaaaccccatctctactaaaaatacaaaaatattagctgggcgtggtgcaagtgcctgtaattccagctacttcgggaggctgaggcaggagaattgcttgaacccaggaggtggaggttgcagtgagccgagatcacaccattgcactccagactgggcaacaagagcaaaactatctcaaaaaaaaaaaaaaaaaaaaaaaaaaaaacaaaaaactgaagc

SEQ ID NO: 171034 - DNA, 601 bp, Human
tgcctcagcctcctgagtagctgggactacaggcgcccgccaccaggcccggctaatttttttttttttttttttttgtatttttagtacagacggggtttcaccgtgttagccaggatggtctcaatctcctgacctcgtgatccgcccacctcagcttcccaaagtgctgggattacaggcatgagccactgtgcccggccctctttactttctaaaaacaaaaacaagaattttaattttatacagttcattttttctccatccccaagctcctccaaccctttccacctccatcttaaacttttttttctattttatttatttaaatagagatgggaatcttgcgatgttgcccaggctggtctcgacctcctggcctcaagtgatcctcctgcatcagcctctcaaagtgctgggattacaggtgtgagccactgctcccagccacatcatgcattttgacacccaatcactgtcatgaactctatatccttccagttcactgaagtctatgtacagtgtatctatgtctatactgaaccctataatattgtggttttcttaatgccctaagtggtatactgtatatatcactgag

SEQ ID NO: 171035 - DNA, 601 bp, Human
aggaggtggtttgggggaagcattagttgtcctgggacatggtgcctccttactaggattaaaagtagggcggtgtttctgggtatgatatccacactctaaaatcagcaagggacctgggaccctgatttagggtcctcttaagtgcaactaaggtgggtgatggcctcagcaaagtgaggcactggctcaacatttactggaagggctgccctgcattctagtcggggggataaaggaggaaaggcagtgccaactctccaagagcactgaactagttactatgactggtcttcctacrgcagcctttataggtttgcttctatgttacgaattaaagaaaaaaaagttttaacatctgcctctctaccacccagaactgaccattaacactgagccatggctggctgtgttggctcacgcctgtaatcccaacagtttgaaaggctgaggcgggcagatcacttgaggctaagagttcgagaccagcctggctaatatggtgaaacaccatcactactaaacatacaaaaattagccaggcgcgcacctgtaatcccagctacttgggtggctgagacacagaattgcttgaatccag

SEQ ID NO: 171036 - DNA, 601 bp, Human
agatttgccctaatcaaactaggccagcaacatgatcaaaatgggtgacgggccagcagaacctagtaaggtctggaataggcactgttcatcttcatctatagttaagggtaatgacaataatgtatttgcatatgggtgcaggatacagaggataagatatcttctagctaagagacctgggtcttaagcccacactttaaccccaggaggccccacagcagaaagcagtatggtgttaccaggctacacagaacaaaatgagcccacttgtaggttctagtaaaattccctggctttaaaaaaaaaaaaaaaatcttggctcttttatttcttcggggctgaaagtaaatgacttgtcaacaggaacctaaggtcctatttccaactagagtgtggaatagggaagagcagctgatgctaaatgggcctacttccctcaaagaccactcaacttcaggtgaagaagccctaagtcagagaaccctcaatgtcctcagatgccgaggatttcctggttccatcccagctgctcagtgcagagaactggtttcagcctgaaggaggtggtttgggggaagcattagttgtcctgggacat

SEQ ID NO: 171037 - DNA, 601 bp, Human
ttgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtactgcagaacagtttcaacggcttaagaaggtcaaccttaatacattcagaacctcaaagcaaaaaaaaaaaaaaaaaagtccacaggataatcccatgcctcaaacctgttagytacatgcccaaatccagcaaactagtttgttctcaagctttacagtaaaagcttttgacaatgttctggtacagaagggctgcctccaagtccacgagatgccattagcagataaaattatattggcctcaaacacaaaccctatttcaactatctcaaattaaatctgatgcctataagctctaattttttgccaataagtacaaaaatgacaaatgaaaatttctatagtggatttacgcattagcagtcaaaaaaagcttgcttgtcagcaagttcatccagactccagatctcatg

SEQ ID NO: 171038 - DNA, 601 bp, Human
agtaagaaattatgtgtacctcttttggaaatatttatatgcatcctataaaattgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtactgcagaacagtttcaacggcttaagaaggtcaaccttaatacattcagaacctcaaagcaaaaaaaaaaaaaaaaaagtccacaggataatcccatgcctcaaacctgttagttacatgcccaaatccagcaaactagtttgttctcaagctttacagtaaaagcttttgacaatgttctggtacagaagggctgcctccaagtccacgagatgccattagcagataaaattatattggcctcaaacacaaaccctatttcaactatctcaaattaaatctgatgcctataagctctaattttttgccaataagtacaaaaatgacaaatgaaaatttctatagtggatttacgcattag

SEQ ID NO: 171039 - DNA, 601 bp, Human
tacggtgtgccctggagagctgcacaaggattaaggaaaaagctgagtgtaactaaagctctttggggtaatggaaaaattaccttaataaccaggtatccaggtgacagctgctctagagattccactgttatgtctctttaaacctgtgatttactaacattccactattctatacaagaacctggtccctccccttttgggagcggggaagggacaccaaattaaacatacctaaaagacctgggaggatatatactgaaattttaataggacgtcattggggtggtaggattacagaaaaaaaaaaatcctctttattaacaaatttactgatataaatataaaaatacttttatagtaagaaattatgtgtacctcttttggaaatatttatatgcatcctataaaattgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtact

SEQ ID NO: 171040 - DNA, 601 bp, Human
atggccacaagtcctcaaccacagattctaaaacttttaaaatggggaaataagataccggctaacggttcaacatggcaaatgcactcttcatttcgatgtgtatttcctaagcccctaatatctactacgtaccaaaatgaaaaaatcaatcctcccttccaggacctatatggttttgtatctcctagcacctagtatgtggaagcattccagtgtttgttaaatgacctttcagtctctctgaatgcctctttgtcagaatcaaagttatgcctctgctcccccttccctaaatctkaggaacttctgcattactgacaggaaagcctggggcccctggtccctttccctacactcatggttgagggagggctcgcataccttcagagctcccagctgggcttagggaagtctggctgttaagggaacattactgagagatggcacatcaggccaactggaacacaaaggctttgctgtggcctccaatgggcctacaatctagggactgtattgtgaacaaaataagatctgaataagtgggttggagtaactaattccactctttttaaaaaccatcagctggctcttcttagac

SEQ ID NO: 171041 - DNA, 601 bp, Human
tccttgagttctcagaccaagggctactctttctaaaacgcttgagcctaaatgcttcggccaagcaaggctcaggaacaagctcctctttagcccttccccacctcatcctaaatctcaaagttccaaatcaaggcatctcacacatatgacccttactcctttaccctgttccatctctgactttgtgggctctctgggtggctcgagtagagtatacatctaaatccatctctgccatctccaaagaaggcccgctgaggtccaaggagctctgaaggcagtagtgaacagtctgttrgctatggaaaactgatggccacaagtcctcaaccacagattctaaaacttttaaaatggggaaataagataccggctaacggttcaacatggcaaatgcactcttcatttcgatgtgtatttcctaagcccctaatatctactacgtaccaaaatgaaaaaatcaatcctcccttccaggacctatatggttttgtatctcctagcacctagtatgtggaagcattccagtgtttgttaaatgacctttcagtctctctgaatgcctctttgtcagaatcaaagttatgcctctgctccc

SEQ ID NO: 171042 - DNA, 601 bp, Human
cacatactaattctttactgcaacttcctatgacctgagtcctttcataagaatctgtgtagtatcccatgtagcacctaggtttgttaggacatttagttactcttttcaggagagaaaggtcactgcccatgaagcccttttttgggggaaggggcacacccactcaccaatggtacagatgatgccagtgttccgggctgtgatgggtggtgaatcaatgtccaggcggcacatgtgctccaggaatgtgtcagccatggctgcgtgcagctgctgggtctgaatgaaggcagtcccrgcttcactatggggcttcgacatggctgctgaggtcctgggtcgagacaaattgaaagagagtggtaagactgagaagtggttaatataccatttagcacagaaggctgtctcctgcttacacattaactcaataagcacgctttgtacacaagccacagggaagccagacatgatctggttatgtgggtgctcctcatgttagaaaaagggttcaccagattgtgaacaatggaaaggaccttactgaacaagttaaaacctcccacccactccacatagtcccaagcacccacagtaa

SEQ ID NO: 171043 - DNA, 601 bp, Human
ccagagggcaacctctgtaaggcaattggccttacaggatagcattttctttactctcaacaggaaatacagaagccaagacaggtgcaaagtttgcctcttctgtaattcctcttatcaatgccattacgaaatcccatgatctatgggaaacctatggttaagtctgaaggttttaaaaaggcacaatcccaggctgagcatggtagctcattcctgtaatcccaacatttgagagaatcacttgagcccaggagtttgagaccagccaaggcaatatagtgagacctcatttcccccmaaaaaatttttaaattagccaggtgtggtggtgcatgcctgtattcccagctactcgggaggctgaggcaagaggatcacttgaacctgggaggtcaaggatccagttagccataatcataccactgcagtccagcctggatgacagagcaaaattttgttttataaaataaaaaaataaataagtcatggtacctcagggaaccccaagctcctcagaatgggttaattctaaatctggcaatggaggcaggaatggagccatcccaacagctgctacctggctcctgggcaaggcctc

SEQ ID NO: 171044 - DNA, 601 bp, Human
gccagagggcaacctctgtaaggcaattggccttacaggatagcattttctttactctcaacaggaaatacagaagccaagacaggtgcaaagtttgcctcttctgtaattcctcttatcaatgccattacgaaatcccatgatctatgggaaacctatggttaagtctgaaggttttaaaaaggcacaatcccaggctgagcatggtagctcattcctgtaatcccaacatttgagagaatcacttgagcccaggagtttgagaccagccaaggcaatatagtgagacctcatttccccmaaaaaaatttttaaattagccaggtgtggtggtgcatgcctgtattcccagctactcgggaggctgaggcaagaggatcacttgaacctgggaggtcaaggatccagttagccataatcataccactgcagtccagcctggatgacagagcaaaattttgttttataaaataaaaaaataaataagtcatggtacctcagggaaccccaagctcctcagaatgggttaattctaaatctggcaatggaggcaggaatggagccatcccaacagctgctacctggctcctgggcaaggcct

SEQ ID NO: 171045 - DNA, 601 bp, Human
ctccttcccctgaatgcaggagcccatggcagactacagcagcagggatcaacagcgaacagacctccagcattgtcttcagctctctctaagctaagctaacacttaattctctaacaagtaattctcggtgactcctgctaaggaccccttgcttttggaaaactacagaattttccaaaaggtacagggacatgtcttaacctacatggtatgtctgctggacttggtcaggtccccatgacatttaagggccagccactagccaggccataggctgtttatgaacacaggttagggwatctatgatgaagagtcttgtgtttcccaaaaggaggaattcactcttggattgcatttcctgaggctttatttttagtccaaacttaataccaacttccaaatgccagagggcaacctctgtaaggcaattggccttacaggatagcattttctttactctcaacaggaaatacagaagccaagacaggtgcaaagtttgcctcttctgtaattcctcttatcaatgccattacgaaatcccatgatctatgggaaacctatggttaagtctgaaggttttaaaaaggcacaatcccag

SEQ ID NO: 171046 - DNA, 601 bp, Human
gggcgcggtggctcacacctgtcatctaaacactttggaaggccaaggcgggtggatcatgagatcaagagattgacaacaaccaggccaacatggtgaaacctcgtctcaacttaaaatacaaaaattagctgggcgtggtggcgtgcacctgtagtcccagctattcaggaggctgaggcaagagaaccacttgaacctaggaggcagaagttgcagtgagccgagatcgtgccactgcactccagcctgggcgacagacagagtgagattccgtctctaaaagaaaaaaaaaaaaaaagaatagtaatagttgttttcttttaaggggataggtggtgcctttccttcagagttgacgtgaggagtaaaagaatacatgaagtattaggacaaagtacatggtaattatctaataaatgttacctattatcatcttataatgataagactcaggtgtactgagttccactacagctgtggctttgttgggatgttatcacgtggataagagttccacacatcaatgctgtcctgcggaaggctctatatttagctatatttaggttgtttaaaagtcaaccttaactcaggccaggcg

SEQ ID NO: 171047 - DNA, 601 bp, Human
tctctaaatgaactgccctttattactccttgcttacaacaaatcctggcttcaatcttttttcttaagcctttcctcctttccatttaccattttgtttgtttaaaagagggactcaggctaagcacagtggctcatgcctataaaccaaacactttgggaggctaaggtgggaggacagtttgggccaggagtttgagatgagcctgggcaacatggcgaaacctcgtctctacaaaaaacacaaaaattaactgtgcatgatggtgcgtgcctggggtcccagctacttgtgaggctraggtgggttatgtctaggaggtcaaggctacagtgagccatgatcacaccactgcactccggcctggataacaaagcaacaccctatctcaagaaaaaaaaaaaaaaaagacgcagagccaagatgtcaaaagagctctaagatagtgtcatcaatatgacattagcggtaacaagggcacctaattcagcactttctgggccttgtcctttaaccaccactgtccaggaaagtggcacctgcaagtaagcctgcctgttattcacaggaggctggagggagctggagccagagcctagc

SEQ ID NO: 171048 - DNA, 601 bp, Human
tagtagagacggggtttcaccatgttagccaggatggtctcgatctcctgatctcgtgatccgcccacctcggcctcccaaagtgctgggattacaggcgtgagccactgcgcccggcctcaatcactttctagattctgattggagggggaaaggtggtcatatgcctttctctaaatgaactgccctttattactccttgcttacaacaaatcctggcttcaatcttttttcttaagcctttcctcctttccatttaccattttgtttgtttaaaagagggactcaggctaagcacagyggctcatgcctataaaccaaacactttgggaggctaaggtgggaggacagtttgggccaggagtttgagatgagcctgggcaacatggcgaaacctcgtctctacaaaaaacacaaaaattaactgtgcatgatggtgcgtgcctggggtcccagctacttgtgaggctgaggtgggttatgtctaggaggtcaaggctacagtgagccatgatcacaccactgcactccggcctggataacaaagcaacaccctatctcaagaaaaaaaaaaaaaaaagacgcagagccaagatgtcaa

SEQ ID NO: 171049 - DNA, 601 bp, Human
tttctcaatcgctttgttttttttttttttgagacagagtcttgctctgtcgcccaggctggagtgcagtggcactatctaggctcactgcaagctccacctcccaggttcacgccattctcctgcctctcagcctcccgagtagctgggactgcaggcgcccaccaccacgcctggctaacttcttcgatttttagtagagacggggtttcaccatgttagccaggatggtctcgatctcctgatctcgtgatccgcccacctcggcctcccaaagtgctgggattacaggcgtgagccrctgcgcccggcctcaatcactttctagattctgattggagggggaaaggtggtcatatgcctttctctaaatgaactgccctttattactccttgcttacaacaaatcctggcttcaatcttttttcttaagcctttcctcctttccatttaccattttgtttgtttaaaagagggactcaggctaagcacagtggctcatgcctataaaccaaacactttgggaggctaaggtgggaggacagtttgggccaggagtttgagatgagcctgggcaacatggcgaaacctcgtctctaca

SEQ ID NO: 171050 - DNA, 601 bp, Human
tgaagaccaggaggccataagctttaacatggacaccaggccctgaaattccacatggctccccaggaagggccaaaaagagccctttcttaagtgtctgctgtcatctttccccctggtccccccattccagcaaacactggtagtgtttctgatcaggaacagaacatcatggcccctggtcctgtgagcagtgaccctgttctctcaaatgttggtccccaggcccagggaacaatgtcaagctgccagcatctcaattacctgggaagcttttttttaaaaaaaacaaaaaaacaaraacaaaaaaacataatgccttctactctcctaagatattctgattcagcaggtttggaactggcttgggagtctacattctgatgggctaggggctgggaatcagacattcacaggatggaccatgcccttcggagagctgcgctgggactggagcagggacaacggggacttgcctccgaaccccctcatgattctcgattttgctgataatcttgatgttctttcccttctctcccaggaccttcctaacttcatggacatcagatgccttgcggatgaatgacgcaaacaccatatc

SEQ ID NO: 171051 - DNA, 601 bp, Human
gcagcccagaggacaggggacatgaacaggaaacagagccatacctggtactgctcttagttatgggtcataaactgcatcagttagacacaggagaaagcagtgaacagttaatggaaggaactgttggccagtgttaactggtgacacagaaaggaaaggtctagccacctggaggggcagctacagcctagcccagacctgtaacttatcttctgagcagtgccatgcaatccaaaccttgcagccctaaagtatctatctgttcataggaaacaccagggtatggaagaaaggatayggaatttagaccctgagcctgaatcttagtctctgaccccactgacaggctccaaatggagacctgttctcatctcctgctagacagagcatgatgttgcaggagagaagactggctttggaggcagtagacctagattcaaacccaggctttattggccatataaccctcatctataaatggaggtaatgggagttaggaagattacatccatgtacacagagacttatcagacacttaataataacagcaatgaatatttaatgctaaggctataattaaacatatctaatccatttt

SEQ ID NO: 171052 - DNA, 601 bp, Human
aaaacgtgggctaacttgtgagaggcacactgaacagccatgtgaagagacagatgcctgtggaagcatgcagatatatttaataagacacttgattaaaatctaataattaaaacagtcatgagaaagccactgagttatttatagatcacttgctcagataagaccaagaatcagaaagacaatgtaagctttagaggattataatgcaatcaccagcatctcagtaaatgatgggtgagggaagaatcggtaataccccctcatcaatttcacagtagaagcagatgtgtggcaggakgtactaggttaaaggtattctttctgtaagaacggaatgcatgcagcccagaggacaggggacatgaacaggaaacagagccatacctggtactgctcttagttatgggtcataaactgcatcagttagacacaggagaaagcagtgaacagttaatggaaggaactgttggccagtgttaactggtgacacagaaaggaaaggtctagccacctggaggggcagctacagcctagcccagacctgtaacttatcttctgagcagtgccatgcaatccaaaccttgcagccctaaagtat

SEQ ID NO: 171053 - DNA, 601 bp, Human
cagccccctgggaatcaacatcaggcttctctacttttgtgccctctccctgccccacatggcccctagctcctgaaacagtcccagcaactgggctataaaggcccagaatcaaatctgagtatctagatgaggcttagaaatctaggtgctactcagcaggcaagaacaggaaatgggagtgttgctgcaggagcagctctgcctgccaaagctcctttggaaggcaggggacccttctaaagcccctctgccaggcactttcttgaacactgacactgcacacttgtagctgcagctrtgtctcaggagctggggaggggcaccagaagggaagttatgaggacactcaacaggtgtcagggaaacttaagccacatcacagcagagaagtccctgcacttcacgcttggcctctatgcaaggccttcagagggaagcaattgctgaagccaggaccagctgagtgaaaccccagaagactagagcttaaaatagccaaacagcaagaactggaccttttaagaaaggtcaaccctacgggttggagctgttcagccaagagtgggaggctggagccctctgctgagggcatctgcac

SEQ ID NO: 171054 - DNA, 601 bp, Human
ggcagggtaaggtggcgggagaactaggctgccatcccaggtggctggcctaccagccagcgcggccggaggtacagaccatgtacagaccacggcgaggggtgttaggggcttctcgggataaaggcagcgagtggctgcgcattccctccccgactctttcagaggtaagccttctgtggagcagaccctaatcctccccctgattccttaggtcactcggcgatttacttccttcccccgcttcctcacagtcctccacagccctacgacttccgcttgcctcgtcgtctgggaaacmgccgacttccggccgcgcagcggtgggctgagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctgga

SEQ ID NO: 171055 - DNA, 601 bp, Human
atattatgcagtcattaaaaagaatgttacaactaattgcttttcctctcagaagcccctctctctcactagagaaagctgttctcctttctttcttctgcctattaaacctccattcctaaactcagaaagaaaaaaaaaaaaagagaatgttacgactaattgacttggagggacttccatggtgtacatttaaataaaaggtagatgtgaagtggggtatattatgtgatcttaatttcataacacaaaggaaaacatatagatccgtagataaggatatatggatatggaggagagmaaaggaaaagactcaaaactcacagaatttttgaagaaatgtatagctaaaaatctaagaaggctacagtcaaggccttgaggccagaagactccccatcaaaactgagtaaaactagcccagtgtgggacgcagaaattctaatatgctaccaaaattacttacggattgctaccagttccttagaaggaaaactgaggactaatatttgtattttcagtatagtttagaattcttaaaaaatgagcaaacaggctgtacttggtggctcatgcctgtaatgccaggacttgtggaaac

SEQ ID NO: 171056 - DNA, 601 bp, Human
tgagccatgatcatgccactggactccagcaggggcagagtgagactttgtctgaaaaaaacaaaaacaaaaaatgaatgagcaactaactctggctttcatgatttgtgcttataaatctttttatttatttatttatttatttatttatttatttatttatttattttgagacggagtcttgctctgtcgcccaggctggagcgcagtggcgcgatctcggctcactgcaacctccgcctcccgggttcacgccattctccagcctgagcctccggagtagctgggactacaggcgccygccaccacgcccagctaattttttgtatttttagtagagacggggtttcaccgtgttagccaggatggtttcaatctcctgaccttgtgatccgcccgactcagcctcccaaagtgctgggattacaggcgagccactgtacccagcctataaattttttttataatgccctgattcccattatttgatgtatttggataaatatgtcatcctgtaaattgaaggattaaactgataagagcagaaaacagaaattagtacactagttgatctggctcagatatagtgcctatgtatcag

SEQ ID NO: 171057 - DNA, 601 bp, Human
aataaaataatttgttctatataaatcctatgaatgagattgagtgggctaatagaatcctttccatctcaaaatgttctggaaagtcttgagtaaaagactcatcaaaaaaataattctgctttgtgcagaaagaagggttgctgacctttgaaggtgctttttgagtctttaacattctttagtagtatattccccaaagttaagaaattctagttagattttaaaaaattgagttaacatttaaaaaacagttttgttgaggtataatacacgtaccataaaatttactcaatttaartacaaagtttgatcagttttagtaaatttatatagttgcacagctgtcatcagaggctgcttttaaaacatgtccatcactccagaagggttcctgtgtcaatggaattgctgggttatattgtttaagtatttgtttaaaaaaacagaaacaaatctgcctaacttctgcaggctatatacgagttaacatttccatgagcaatgcatgagggttgtgatttttccacatccctgtcaacacttggtttgtcagtttgtttttatttagctgttgtagtggatgggtagtgatggtgta

SEQ ID NO: 171058 - DNA, 601 bp, Human
tacttgcttattttaccaattcctttgcttattccactcctttgttctgggattatttttctttttcctaatatattttcattaaaagtttatttggtgagaatctaaaaactctcaaattctgaaagttttaaaaatttgcctttgttgttgaaaattagttttgatgggtgagagaatctagatcaggtgttagcaaacctttttttgtaaagggccagatagtaaatattgtgggctttgtgggccatagagtctctctgacaactactcagcaatgctgttgtaggacaaaagcaaycatagacattatgtaaacatgagtgtgggtatgttctcacaaattttgtttatagacactgaaatttgactcaattttcatgtgttaaaaattattattttttgaatttttttaaccatataaaaatgtaaaaatcattcgtagcttgtagaccaaataaacaggatggatttgacctgtgggccatagtttgctgacctctggtctaaattaacattcattttacttagtacctgacactggagtaattattcttatgatgtcttattgtgatattgtcttccatttttaattgttgaa

SEQ ID NO: 171059 - DNA, 601 bp, Human
tgcctcagcctcccgagtagctgggattacaggtgcacgccaccacacctggctaacttttgtgttttagtagagatgaggtttcactgtgtttgccaggctggtctcgaactcctgacctcaggtgatctgcccaccttggcctcccaaagtgttgggattacaggcgtgagccgccacgcctggccagatttctctctcttgttgattcttttatctattctatattatttcaaaatgagtgttgggaaaagaagtaatagtctaaatgttctgtcacatctagcttttatttaatagmgttattagatattaggaggttggtttgacctggaaattatttaaatggggtttgattattatgtaagtgtgtactaattttctgcttctggaaaaaccactttgtgaagttccaggtatctttttgctttgttggtttctagtttaattctattgtgggtagagaacattctttatatggtttgttttatggcccacaatgtggcctgtgttggtgcatgtcccatgtacacttggaaataatgtgtattctgctcttgtaggatgtagcattctgtaaatgtcaattaggtcaagttgg

SEQ ID NO: 171060 - DNA, 601 bp, Human
gaagtcctcttccttttgccccatgatgtaaccttaggtgactttcttctggctttcagttgaagatcttacccatcattgaggtgagcgaactgatttactgcttgagtctattttcttccttaaaggagtcttcattgaaaactttacccattttggggtggccatagctgaggatgagttttgtccacaacctgagacaacatactcactatgtaaaaaacctgatctcagcttgatatctggttttagactaattgtttaatagaataatttattattgtaaaatatatataaaatktaccatttttaagtgtgtaagtcagtggcattaagtacatttacaaagttgtgcagccatcaccactgtccatttctagaagtgtttcatcattccaaacagaaacactgtacccattaaacaataaatctccacatccccttgcctccccagatcctggtaatctccattctattttctgtatctatgaatttgactattctaggtttttcatgtaaggtgaatcatacaatatttgcccttttctgcctggcttattccactcagcattttcaagattcattcatgttgtagcatgtg

SEQ ID NO: 171061 - DNA, 601 bp, Human
agcaacgtgtgaggattctgtttggctacattcttgccaacatttgttactatcagtctttttcatattagacttgctggtgggtatattgtgttttattgtgattttaatttgcattacactaatgactagtgatgttgaacaccttttcatatacttattggtcatatcttttgtgtagtgcctgctcaagttttttgcctatttttaaatttcttttttccttattattgatttgtgagacttcttaatatattctgaatgtacgtcctttgtctgttatatatgtggtaagtatttycccccagcctgtgttttactactttcattttattaaggtatcttttgatgatcaaaagttttaattttgatgaaggccaatttactattatttttcttttgttattaatgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataa

SEQ ID NO: 171062 - DNA, 601 bp, Human
tgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataattgtactgtgcagtgaatttttacaaagtaaacatatccatgtaatcaccatctagattaaggtatagaatattatcagtgccctccaggccgcctccttattccctaycagtcattaaccacccctcccaaaggtagtaacttgtatttaacttctatcttctacatcagttttgcctgcttttgaatttaatgtaaatggaatcatgcagtgtgtactttttaatatctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgcca

SEQ ID NO: 171063 - DNA, 601 bp, Human
tctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgccaccatgaagagtcttgtacatgttttttggtacacatacatacttaggagtaggattttcagggtcaccaggaaggatatatttaggctcagtgaatactagcaagcaatttttaaaatgmggtcaatataatccccatgtgtaaaataaaggtgtacaaacgcacacacacacacttgctcatatgcttatatgtgcatagaaattccttgaaaatactcaagaaatgcttcacctctggtaagggataggaatggaatgggtcttttgtttagtatcctatgtgccctttgaattttgttttactgtaagtatgtatttttaagaaaaccaactagttatttttaaaaatcatttgaaagtcttcctactttgatatatgaaaaacactggttttaaaaaaaataatagaaaagcttta

SEQ ID NO: 171064 - DNA, 601 bp, Human
tatgtatttttaagaaaaccaactagttatttttaaaaatcatttgaaagtcttcctactttgatatatgaaaaacactggttttaaaaaaaataatagaaaagctttaaaatcattattatttttttgagacggagtcttgctctgtcgccaggctggagtgcagtggtgcgatttccgctcaccacaacctttgcctcccggattcaagcaattctcctgcctcagcctcccaagtagctgggactacaggtgtgtgccaccaggcccagctaatttttttttttttttgtatttttawtagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaaatcctttatgattgggcagaaacttggtttaatgtgtcaccttggagacctgggttatagtcctgcctcttccattaactacttgttgaatgtggacaatttactta

SEQ ID NO: 171065 - DNA, 601 bp, Human
tgcctcccggattcaagcaattctcctgcctcagcctcccaagtagctgggactacaggtgtgtgccaccaggcccagctaatttttttttttttttgtatttttaatagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaartcctttatgattgggcagaaacttggtttaatgtgtcaccttggagacctgggttatagtcctgcctcttccattaactacttgttgaatgtggacaatttacttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaa

SEQ ID NO: 171066 - DNA, 601 bp, Human
ttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaaaaccataattagctaatcttttatatgacttttttcttcctcatttcaagctaatgagaagcaaacaaactggatagcagcaatataattaaaaaattataggmcagcttctagcatgtattcttgagtcaatactgactcagcccagtctcttcctcttccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagc

SEQ ID NO: 171067 - DNA, 601 bp, Human
ccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttttgyatttttagtagagacggggtttcaccgtttttttagccgggatggtctcgatctcctgacctcgtgatccgcccgcctcggcctcccaaagtgctgggattacaggcgtgagccatcgcgcccggccgaggagctgactcttgcagcctccttttcttcccaggcttccgtgtcagcagtttctggctggattagcaagtggaggaactggcaggagattagaaggcaagaggaaagagaagacagggcttccctccccgaccttcaggcttcagagtcgtagtggttttttgctcatgc

SEQ ID NO: 171068 - DNA, 601 bp, Human
agtgaaataacttgccctaggccccatagaaggctggtattgaatcaagattgaaattctgcatgtgaaaacttttatgtgctacatgtctgctagtcctggaagaaatcctttctttgatgagtattttttttaaaggctttacttgcaatatatttacaaaagccttagttatttagtaaatttttcaatgaaaaatctgaaccataataattttctgcttagtacttatatagctagcatactatccctagcattaatcaaagtgtcatgtaaaggtttgatttttgagcctaagcaraatttgaaattcttctaagagaatttagcacctagggcaaactacaggggagaattcttgaggtgtcatgtttattcacttctggaattgtttaaaatatgtcaggtgcatccttaaagggagaaagaagggggaagagatgttacaaaagagtagaatggggcaagagaagtggcaagggagtattgttgctaggttgccagccttctgcccccactgtcttggtgatggtggaggggtagtgtggcagctgggatatgaatgaggtcttttttataactcactaaaagccattacctt

SEQ ID NO: 171069 - DNA, 601 bp, Human
gatacaactctatgagaatgagtattttatttcctgacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatttggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtccttttttttttttttttttttttt

SEQ ID NO: 171070 - DNA, 601 bp, Human
gacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatytggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtcctttttttttttttttttttttttgagactgggtctcactctgtcacccaggttggagt

SEQ ID NO: 171071 - DNA, 601 bp, Human
tatgcacttaacacactcacatgtctttaagcttggtgactcgtgtggctttttcgaaggagatttgattctggaagtggttaagtaggatgtgaatggctaaggtctggtcattggtgaagcctaggggaagaaaagaaaggaaacacaagtcttagaagaatttcagatcggccccaacgactagaagggtggttctactaagaaaatgtgtgtagtcagaaaatgaagagtcagttgcttaaaattttactttttttcttgttcctggcatgtaaagtcatatccatactttctgttrtaatttcttcttacaaattccattgataatccctattcttggatagcaatgagcagcattacttcttttttatttttttaaaaaaattaaattttttgttgaaatgagggtcctgctgtattgcccaggctggtatcaaatttctgggctcaactgatcctcctgcctcagcctcccaaagcgctgggattacagttgtgagccagtgtgtctggttgtaccttttaatttttgtgttcaggcaacattaactctgagtcacagtaagctttttttttcttcctgtcatattatggacat

SEQ ID NO: 171072 - DNA, 601 bp, Human
tttgtgttcaggcaacattaactctgagtcacagtaagctttttttttcttcctgtcatattatggacatagaagttttttggttttctttagattgtttctccttaggttgcagaacatcaagaaatggattacagtcattttcctctcttccccatgctcttccctttcttttccttttttcttttttttttttttttttggagacagaatcttgctctttggccgaggctggagtacagtgtcatgatcttggctcactgtaacctccccgcaccaggttcaagtgattctggtgccyaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctcttttccatttttaaaaaggactgtctccaacatattaaaattcacaaaaaataatataaacacacatgtactcactggctaggcttaataaaaaacatttagtcatgtttactt

SEQ ID NO: 171073 - DNA, 601 bp, Human
ttttttttttttggagacagaatcttgctctttggccgaggctggagtacagtgtcatgatcttggctcactgtaacctccccgcaccaggttcaagtgattctggtgcccaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctctttyccatttttaaaaaggactgtctccaacatattaaaattcacaaaaaataatataaacacacatgtactcactggctaggcttaataaaaaacatttagtcatgtttactttaaagctttttatttttttgagaaataagcattaaagagttgaagtctcctttctgtcttttcataattctgttcttccctcttccttccttgagatcttcactattcttgggttaatttggatctttctactccttgttaccacagaaaagtaattcttaatgaatttgaccatattttaaacttctga

SEQ ID NO: 171074 - DNA, 601 bp, Human
cggacatgcaagtagggaagatatcgctaaattcttttcctagcaaggaattttaataatactctggagaaggaatgcattccttggaggaggtctatagggcatgtctgtcttatgctgttgacataaggactgaaatacaccctggtctcctgcagtaccctcaggcttattagggtggggaaaaaaccccaccctggtaaatttgaggtcagatcagttttctgctctcaaaccctgttttctgttgtttaagatgtttatcaagacaatttgtgcaccgctgaacatagactcttaycagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagctcaggtgggcatcacggtcctaccgatatatgtgaggcccagctgtgaaattcctctcttcgtactcttatttcttagccggctgacgctt

SEQ ID NO: 171075 - DNA, 601 bp, Human
ggtcagatcagttttctgctctcaaaccctgttttctgttgtttaagatgtttatcaagacaatttgtgcaccgctgaacatagactcttaccagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagatcaggtgggcatcacggtcctaccgatatatgtgaggcccagctgtgaaattcctctcttcgtactcttatttcttagccggctgacgcttatagaaaatagaaagaacctacattgaaatattgggggcaggttcccctgatatatttccttagtgacattcctgcaatctcctttagaaagtctttctgttcaccttctataaccagggaaggagagattgagaagagacgaaggatgattttatgtttttcagtcccagtcattatttgatgagaaactgatattacaagctttaaa

SEQ ID NO: 171076 - DNA, 601 bp, Human
acctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaartacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatg

SEQ ID NO: 171077 - DNA, 601 bp, Human
tctttcttttttttttttggtagagagacagagtctcactttgttgcccaggctggtcttgaactcctgggctcaagcagttctcctgcctcagcctctcaaagtgctgggattataggcatgagctacgacacctggccctttatgctattcttaaaactttttatttttttacttttaaacttttttgttaaaaactacgatacacacactactacagtggtggtactaacatgtggaatgtgtccttgctgtcttttttggcattcagagctttgtgacccatctaaggtctttgtgacacacacacacacacacacacacacacacacacacgcacacgcacgcacgcactggtctaggcctacactgagtcaagattataaatatcactgtcttccacctccttatggaaggtcttcagtggcaataacatacatggagctgtcatctcctataacaataggaataccttctggaatacctcctgaaggatctgcctgaggcagttattcttttttttagtaagtggaaggagtacactctaaaataaagattaaaatgtatagcgtagtaaatacataaaccagtaatgtagtca

SEQ ID NO: 171078 - DNA, 601 bp, Human
aagcacaactttcccagaagtcccccacagacttccacttatgtcatatcagctccccttctataaggaaggctggttaaatgtcgtttttaatctggtcacactgccactctaaacaaaattagggttcttttagtaaggaaaaagagaagagtaggtagcaggtaggcaagtagataactagcagcatctgccacactgttttccattctctatgagagatgttctctaactattctctacaactcttaacttgcctctcattttctacctctgtgtccttttctttgtgtgtggtgcggggggtacagaggctcactctgttgcccaggctggagtgcagtggcgtgatctcggctcactgcaacctctttcttccaggttcaagtgattctcctgtctcagcctcctgagtagctgggattacaggcgcctgccaccatgcccggctaatttttgtatttttggtagagacggggtttcaccatgttggctaggctggtctccaactcctgacctcaggtgattcacctgccttgtcctcccaaagtgttgggattataggtgtgagacaccacgcctgaccctccttgtcatttta

SEQ ID NO: 171079 - DNA, 601 bp, Human
ctggagtcagcaacataaaggtggtaattgaaaccattagattggttgacattaccctgcaatgagctgaggatgggaccctggaaaaaaagagttttttactttttttttgtctgtttgagacggcacaggaaaagttactgctttaatgcagggaggaagccctgcattctctatgggggccaggatcatgggggtggccagtgccacaaatggtcaccatacaggccagggaggagccagggcccaccaataatccctggaacatccctggatgctagcagttttttactttctaaatttttttttttttttttaagagacaaggttgcctaggctggagtatagtggggtgatcatagcttactgtaacctccaactcctgggctcaagtgatcctcctgcctctgcctcctgagtagctggggctacaggtgcaagccaccatgcctggctaaatttattttgtggaaatgaggtctcatgttacccaggctggtctcaagctcctgtcctcaagtgatcctcctgctttagcttcccagagtgctgggattacaggtgtgagccatcaaaaagcaattttgaaggactgagcaga

SEQ ID NO: 171080 - DNA, 601 bp, Human
cttactgtatgagttaaaggttaagctgaagtttaagagctcccagtagcttcaataaggtagactgtgtttctttcttacctataaggatgactgctgctttaggttagctgggcagctctattctacaaggtcagccagggatccaggtttcttccttattaactcaccattccttaggctgttgtctttacctgcatggttgatgctgaatgtaacatccacatccaggctgtggtggaaggagatggtttgggaagctaagcatggaataagcatctggctatatatatatatatakatagagagagagagagagagagagagagacatgatcttactccatcactcaggctggagtgcagtggagaacacagctcactgcagcctcaacctcttgggctaaagcaatcttcctacctcagcctcccaagtagttgggactacaggcatgtgccaccatgcccagctaatttaaaaaaaaaaactgtttttgtgttgacagggtcttgctgtgttgcccaggctggtcttaaacttctgggctcaagcgatcctcctgcctcagccttccaaagtgctggaattacaggtgtgagcc

SEQ ID NO: 171081 - DNA, 601 bp, Human
gcaattataattcttatctaggctgggtgtggtctcatgcctgtaatcccagcaatttgggaggctgaggctggtggatcacttgagctcaggagttggagaccagcctgggtaacatagtgagaccctgtctctacaaaaaataaaaaaattagccaggcatggtggcatgcttctgtagtcccagctacttgggaggctgtgatgggaagattgcttgaactcggaaggcagaggttgcagtgagctgagattgagtcactgcactccatcctgggtgacagagccagatcctgtctcrgaaaaaaaaaaaaattcttatgctatccaggaaagagcatatatgagaaataactctggtcttggaggctgttattttgttgtgaggagagaaacagatacaagtgagcacttagggctttggggcaaagccatttcttttgatctttcttcccagccagagtcttattggaaagagagaaggcaaagtatacttttatctagaataagaagttttctgtcccctcaacattcctgaatgtgaatgggattcttttagctccattgattctctggctgaggacccagggcccaggtatcc

SEQ ID NO: 171082 - DNA, 601 bp, Human
ctttatgtctatttcatttttctttaaaaggaatcaggagcttaaccctgggtcttcctgggctttggcttgggaggttggctccacgggagatgaggatacccagctcatttcctgcaaagaggcattaatgtggaacagtactagtgtggcagagatggttcttatcaaatagatactttgaccttatcaggtgacaaattaacaaaaatagaaggaaaaccatgactggggatttttagttttctttctttattatctggtaactgtagctgcttttttttttttttttttttttttwaaagtcaagagaactcaaaaaagccagagcatttctgttctgggtgaggttggccagactgttttttttttttttttggagacggagtttcactctttttgcctaggctagagtgcaatggcgtgatctcggctcactgcaacctctgcctcctgggttcaagcgattctcctgcctcagcctcccaagtagctgggattacaggcatgtgccaccatgcctgggtaattttgtatttttagtagagatggggtttctccatgttggtcaggctggtctcgaactcctgacctcaggtga

SEQ ID NO: 171083 - DNA, 601 bp, Human
ggctcttcttatttgaaaatagtgtcaagtatgctctacttatcttctaaaagtgcacatttgttataatagacgtgtaacccctgcagaaggcagatcatagtgctagtaaagcttatgtgttacttaggaaattagcaatgcctccacaactattgtcaaaaataaatctgcggcccggcgcggtggctcacgcctgtaatcccagcactttgggaggctgaggtgggcagatcacgaggtcaggagatcgagaccatcctggctaacacagtgaaaccccgtctctactaaaaatacaaaaaaattagccgggcgtggtggcgggcgcctgtagtcccagctcctcgggaggctgaggcaggagaatggcgtgaacccgggaggcagagcttgcagtgagctgagatcacgcgccactgcactccagcctgggtgacagagcgagactctgtctcaaaaaaaaaaaaataaaaaataaaaaaaataaatctgctgggcatggtggcttatgcctgtaatcccagcactttggaatgctgaggcaggaggatcacttgaggccaggagttcaagaccaggctgggccacatagtgagac

SEQ ID NO: 171084 - DNA, 601 bp, Human
tgttgttactataattggcccctaggtgatacttccaagtcaagctaccttatgttgaaacccttatctcttctgagcatgttatatagaatgccattctcttcctgaaactccattttatgccatgcaaatactaaaattgatcataaaaataagttaaaattaatcaaacactttaacaattatgcacaaccattttaaagtactgactagtctttctaggaatttttttctccatatacatttacttactaaatgtaagacccaaagcagatttccatgtcctcatttggcagtcgtyttccagtggctttttgttcattactgtgggttcttatttaaaagagaaagcttgcaaaagcaattgtggttatttgagggttgcctgaatacaaagataactttaaaaaaaaaacataggttttattattattcagatatggtatgggcaacagatcagaagacatctgccactggaaagatagtctgttacaattcctgagaaggagggcatgctacaccgtgcagggccacatggggaagcaccaggtcagtcaggaggtagagggagcaaggggtaaatgtgggcacaattctttat

SEQ ID NO: 171085 - DNA, 601 bp, Human
tgcatacagaaggtactcttgtaggggttatatctaggaattagctgactgtgggagggacagtctccccagggtcagtaaggccccagatgtcaaaacatcagaataaaaaggctaaagtggggtgtgatggtacatacctgtagtgctggctacttgggaggctaaggcaggaagtttgcttaagcccaggagttgggagtacagcctgggcaacacagtgagactccattcctctctctttttttaaaaattttattttaggttcaggggtacatgtgcatcctgttacacaggcacatgtgtcatggggattagttgtacagattatttcatcacccaggtactaagcctagtacccaatagttatttttttctggccctccccctcctccagtaagctccagtgtctgtttccctctgtgtctccatgtgttctcatcatttagctcttatagtgagaacatgcaggatttggttttctatcctttattaatttgctaaggatggtggcctccagctccatctatgttgctgcaaaggacacgatcttgttcttttgtatggctgtgtcgtattccatggtgtacatttacatttt

SEQ ID NO: 171086 - DNA, 601 bp, Human
catctatgttgctgcaaaggacacgatcttgttcttttgtatggctgtgtcgtattccatggtgtacatttacattttgtttatccagtctaccattgatgggcatttaggttgatttcacatctttgctattgtgaatagtgctgcattgaacacacacatgcatgtgtctttatggcagaacgatttacattcctttgggcatatacccagtaatgggattgctgggtcgaagggtagttgtatttttagctctttggggaattgccagattgctttccacaatggttgaactaatttrcactcccatcaacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatat

SEQ ID NO: 171087 - DNA, 601 bp, Human
gggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatayagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcaggaattgacactctgagaaaatgtttccagtcctaaactgagtaatcaggaggctagagaatgtcagaactggcagtggg

SEQ ID NO: 171088 - DNA, 601 bp, Human
acttaaccagttttgttttgtttttgtgtaatgagaaggatctctaaatgaccatttgttgcagagcccccagctccatagaatctctgtctgccacaggtgtaaccctttagtaaacctgaactatgctgtgctgctgtacaaccagggcgagaagaagaacgccctggcccaatatcaggagatggagaagaaagtcagcctactcaaggacaatagctctctggaatttgactctgaggtatgtcttttattagctcccaagagtcataagtaagctctcaggagacttttaaaaatsaagcccaaatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttctatttcactttttttttttttttttttttgagacggaatctcgctctgttgcccaggctggagtgcaatggcgcaatctcagttcactgcaacctc

SEQ ID NO: 171089 - DNA, 601 bp, Human
caatagctctctggaatttgactctgaggtatgtcttttattagctcccaagagtcataagtaagctctcaggagacttttaaaaatcaagcccaaatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttctatttcactttttttttttttttttttttgagacggaatctcgctctgttgcccaggctggagtgcaatggcgcaatctcagttcactgcaacctccgcctcctgggttcaagcaattctcctgcctcagccttccaagtagctgggactacaggcgcgtgccaccacgcccagctaatttttgtatttttagtagagacggggtttcaccatgttggccaggatggtcttgatctcttgacctcgtgatccacgtgcccagccctatttcacttgttgtaggaaatgcactgtttggcccggtaatgc

SEQ ID NO: 171090 - DNA, 601 bp, Human
atttcactttttttttttttttttttttgagacggaatctcgctctgttgcccaggctggagtgcaatggcgcaatctcagttcactgcaacctccgcctcctgggttcaagcaattctcctgcctcagccttccaagtagctgggactacaggcgcgtgccaccacgcccagctaatttttgtatttttagtagagacggggtttcaccatgttggccaggatggtcttgatctcttgacctcgtgatccacgtgcccagccctatttcacttgttgtaggaaatgcactgtttggcccrgtaatgcaccaggcttgaattgttgggttttgagatcctatgtgaaccaccatgccatccagtaaaggcaatctgtaatctctactgtttgataagtacttcctgcctcaactgctagtacgaccagacactatttcagctaaaaccccagctcgaagaccaaagaagtgggttggcttgtctctgacagtcacgcttttgattcttttacttcctttgtggacacaagatggtggagatggctcagaagttgggagctgctctccaggttggggaggcactggtctggaccaaaccagt

SEQ ID NO: 171091 - DNA, 601 bp, Human
gccccaaagacggaagcggggaagggttagagaagaaaaaccaactcaggaacaaaatcttcattattaatagtatgtaacgtggccgggcgtggtggcttacacctataatcccagcactttgggaggctgaggtgggcagatcacttgaggtcaggagttgaggaccagcctggccaatatggtgaaaccccatctctactaaaaatacaaaaattagctgggcgtggcggtgtgcacctgtaatcccagttacttgggaggctgaggcagaggttgcagtgagctgagatcgtgccaytgcactccaccctgggtgacagagcaagattccgtctcaaataataataataacaaaaacaacaacatgcagccaggtgaactagaaacagcgtgggcctgagattcacatttgccctcttttccccccgaccccccaagcgctatgactcaggaggacccagagagaacctctcctcaggggtggggagcaacagcctcaggatagtccagtgggtgaagcatggtaagggtaacagcccacgttccctgggccctcactgagtgccaggcaccctcccaagggctatcaagggcacca

SEQ ID NO: 171092 - DNA, 601 bp, Human
gccccaggcattcttggcatgaactgtgcctcaggcctggcctgaggactttggttcagtgagctcctggccccaaagacggaagcggggaagggttagagaagaaaaaccaactcaggaacaaaatcttcattattaatagtatgtaacgtggccgggcgtggtggcttacacctataatcccagcactttgggaggctgaggtgggcagatcacttgaggtcaggagttgaggaccagcctggccaatatggtgaaaccccatctctactaaaaatacaaaaattagctgggcgtggcsgtgtgcacctgtaatcccagttacttgggaggctgaggcagaggttgcagtgagctgagatcgtgccactgcactccaccctgggtgacagagcaagattccgtctcaaataataataataacaaaaacaacaacatgcagccaggtgaactagaaacagcgtgggcctgagattcacatttgccctcttttccccccgaccccccaagcgctatgactcaggaggacccagagagaacctctcctcaggggtggggagcaacagcctcaggatagtccagtgggtgaagcatggtaagg

SEQ ID NO: 171093 - DNA, 601 bp, Human
cagttgggatatgggacagaacaagttccacagtttctcatccagattttctccatttccccacaacgccccaggcattcttggcatgaactgtgcctcaggcctggcctgaggactttggttcagtgagctcctggccccaaagacggaagcggggaagggttagagaagaaaaaccaactcaggaacaaaatcttcattattaatagtatgtaacgtggccgggcgtggtggcttacacctataatcccagcactttgggaggctgaggtgggcagatcacttgaggtcaggagttgargaccagcctggccaatatggtgaaaccccatctctactaaaaatacaaaaattagctgggcgtggcggtgtgcacctgtaatcccagttacttgggaggctgaggcagaggttgcagtgagctgagatcgtgccactgcactccaccctgggtgacagagcaagattccgtctcaaataataataataacaaaaacaacaacatgcagccaggtgaactagaaacagcgtgggcctgagattcacatttgccctcttttccccccgaccccccaagcgctatgactcaggaggacccaga

SEQ ID NO: 171094 - DNA, 601 bp, Human
tgcagaggggatgttagcacaggggtcagtaccatgggggtcacactgggagccgcaaccaaatagccatccaggaccactgccccaccccacaccctgcagccctgaggggcgggtgtcctctctagtcataggtctcccactttgctgggcatcagaaccacccaggatgctgggcccctcagcagagacctcaatggatctttactcctgaggactcagtagcctagggacttccctagggacacgaaggctgctcagatggggcaggattccctcctgggctctctttttgcttttkgatacatggtcttactctgttgcctacactggagtgcagtggcatcattatggctcactgcagcctcaacctcttagactcaagtaatcctcctgcctcagccttccaagtagctgggctacagacaggtgtgcaccaccacacctgaccacttttttgcatttttttttttgtagagaccatgttgcccaggctggtcttgaactcatgagctcaagtaaccctcccacttcggtgtcccaaagtgctgggattacaggtgtgagccaccatgcctggcccatcctgggctcgcttttt

SEQ ID NO: 171095 - DNA, 601 bp, Human
gagtagctgggaacgtaggagcaagccatcacaacctggctaatgtttttgatttgttgtagagatagggtcccattttcttgcccaggctagactcaaatgcttgagatcaagcaatcctcccatctcggcctcccaaagtgctggattacaggtgtgggtcactgccactgatcaggaaataagttttaaccaggaagacatgaggcatcaagagagagaaaccaaaagggtgagatgggtgggtcttagttaaacctgtgttaaaatgtctgccactttaatagctgggtgaacctcrgtttcctcatcaataacactgggataatcatacttcagaaagcctaaggaataagaaaatccctgtaatgaaaatccctcactacaaagcctccactcagataccatcaaagaccagtgggaagagtgcttatgagaattggaagaaagaaaaatttcagaggaattcagaaatcaaatgctttgggcttcacctaaaggtgacgctggtccccctggaagggaagaagctgagcacccagggtcgctggttacctgcagctgtgagtggtggtacatccaccggagggcagccgaggtc

SEQ ID NO: 171096 - DNA, 601 bp, Human
tattaaactagaattgggttccatttggccacagagttctgctttatttgtactttgctaccaaaccacaaaagttcaccacttgttctatttgccattcttccttttaattcctcatgaacaaacttaataaattaactacagcatgtcaaacaaccttttgcaacccttgcaatttcaaactcttggagggaggcacccctggcctgggccagcagcctcaacgcgcgggagcgaagggagcgggacagcggctccgcttgccaagtccccagtcaggggaggagcggcgtccccaccrcggtgcccctcgggctccacacccgcgtctcggcaggcggcgacgcaccggaccggcggctaccgggcccagactcccgcgggcagggccgtcccggagcccgcgcctcgccggcggcgccgctccccgttctcatttctgaacaaagacgtggaccgggcacaactcgctgacgccgagagcggccggaaactgcggggaacgcgggcccggccatccgcgcgtccgccccgagccccgcagaggggcggcagggccagcgacctccacccctcggccccccgggacccggactgcgac

SEQ ID NO: 171097 - DNA, 601 bp, Human
gaggcagaggtgggaggactgcttgggtctaggagttcaagaccagcctgggtaacatggcaagaccccatcttttaaaaaagtaaaaaattagggctgggcgcggtggctcatgcctgtaatcccagcactttgggaggccgaggcgggtggatcacctgaggtcagaagttcaagaccagcctggccaacatggcaaaaccctgtctctactaaaaatacaacaattagacaggcgtggtggcacgcgcctgtagtcccagctactcaggagcctgaggcaggagaatcgctcagctcrcccaggaggccgaggttgcagtgagccgagatggcgccactgcactacagcctgggcgacagagtgagactccgtttcaaaaataaaataaaataaaataaaataataaaataaaataaaataaaaaattagccgggcatggtggcgtgcgtatggttccagccactcaagaggctgacgtgagctacgatcacgccactgtgctccagcctgggtgacagagcgagatctcgtctcttaaaaaaaaaaaaaaaagaaaaatgtcccattagttattaaactagaattgggttccatttg

SEQ ID NO: 171098 - DNA, 601 bp, Human
caacaaaaaaatgcacaagctgcttttacttgtttacttataaggtaacaagtgggctgggtgtggtggctcaggcctgtaatcccaacactgtgcgaggcagaggtgggaggactgcttgggtctaggagttcaagaccagcctgggtaacatggcaagaccccatcttttaaaaaagtaaaaaattagggctgggcgcggtggctcatgcctgtaatcccagcactttgggaggccgaggcgggtggatcacctgaggtcagaagttcaagaccagcctggccaacatggcaaaacccygtctctactaaaaatacaacaattagacaggcgtggtggcacgcgcctgtagtcccagctactcaggagcctgaggcaggagaatcgctcagctcacccaggaggccgaggttgcagtgagccgagatggcgccactgcactacagcctgggcgacagagtgagactccgtttcaaaaataaaataaaataaaataaaataataaaataaaataaaataaaaaattagccgggcatggtggcgtgcgtatggttccagccactcaagaggctgacgtgagctacgatcacgccactgtgc

SEQ ID NO: 171099 - DNA, 601 bp, Human
ctcaggaggctgaggcaggagaatcgcttgaagctgggaggcagaggttgcagtgagccgagattgcgccattgcactccagcctgggcaacaagagtgaaactccatctcaaaaaaaaaaaaaaaaaaaaaagaaaggggaagaataaacttacaaactttctcatcttcgtgtgtggcagacagaataacagcccctaaagatgtccgggtactaatccccagaacttgtgaataggttaccttacatggcagaaggggaattaaggtaacagatggaattaaggttgctaatccttakccttgattatccaggtgggtcccactataatcacaaggatcttaataagagggaggtaggaggtcgagagaaatgagaagatgctacctgctggctttgaagatggaaaggggactatgaaccatggaacacaggtggcctctagaagctggaaaaggtaaggaaatgggttctcccctgagcctccagaaagaaccagcctgtccgacaccttggctttagcccagtgagacctattttggacttctgacagcagaaccctaaaacaaatgttatgttgttttgagccaccaggcttgt

SEQ ID NO: 171100 - DNA, 601 bp, Human
ctgtagaaaggggaacaggccaggcggggtggttcatgcctgtaatcccagcactttgggaggcttaggcaggcagatcacctgaggtcaagagtttgagaccagcctggacaacacagagaaaccctgtctctactaaaaatacaaaattagccaggcgtggtggcgcatgcctgtaatcccagctactcaggaggctgaggcaggagaatcgcttgaagctgggaggcagaggttgcagtgagccgagattgcgccattgcactccagcctgggcaacaagagtgaaactccatctcaaaaaaaaaaaaaaaaaaaaaagaaaggggaagaataaacttacaaactttctcatcttcgtgtgtggcagacagaataacagcccctaaagatgtccgggtactaatccccagaacttgtgaataggttaccttacatggcagaaggggaattaaggtaacagatggaattaaggttgctaatccttatccttgattatccaggtgggtcccactataatcacaaggatcttaataagagggaggtaggaggtcgagagaaatgagaagatgctacctgctggctttgaagatggaaaggg

SEQ ID NO: 171101 - DNA, 601 bp, Human
tactaaaaacacaaaaatcagccgggtgtggtggcaggtgcctgtaatcccagctacttgggaggctgaggcagaagaatcacttgaacccagcaggcagaggttgcagtgaaccaagattgcgtcactgcattccagcctgggcaacacagtgagactccatctcaaaaaaaaaaaaaaaaaaaaaaaagaaagaaaaagtttaattaggcctggcacagtgactcaacccaacactttcagaggccaaggcgggaggatggttttagaccagcctgcgcaacatagtgagactctgcawctatttaaaaaataataataataaaaagtttgtttaaaagaaaacaatggaagttctgaggtgacgtctgaacacgtcatgttatatgctttatgaatccatcacacacatttccttttacaatgtgggatctggtcaaggtaaattctctgtgaaacctatgagggaaatggacagttctggagactaacacaaaccttaaagaacttgggagtcttattcttcatatgatcatcttacaccatcaggtactttttgtgtggtgaccctctgggtggggaatcttcaatctttttagtt

SEQ ID NO: 171102 - DNA, 601 bp, Human
tttaaaaagtttatttagggccgggcgtggtggctcacgcctgtaatcccagcactttgggaggccaaggcaggtggatcacttgaggtcaggagtttaagaccagcctggccaatatggtgaaaccccatttctactaaaaacacaaaaatcagccgggtgtggtggcaggtgcctgtaatcccagctacttgggaggctgaggcagaagaatcacttgaacccagcaggcagaggttgcagtgaaccaagattgcgtcactgcattccagcctgggcaacacagtgagactccatctcaaaaaaaaaaaaaaaaaaaaaaaagaaagaaaaagtttaattaggcctggcacagtgactcaacccaacactttcagaggccaaggcgggaggatggttttagaccagcctgcgcaacatagtgagactctgcaactatttaaaaaataataataataaaaagtttgtttaaaagaaaacaatggaagttctgaggtgacgtctgaacacgtcatgttatatgctttatgaatccatcacacacatttccttttacaatgtgggatctggtcaaggtaaattctctgtgaaacctatgagg

SEQ ID NO: 171103 - DNA, 601 bp, Human
aaaaatacaaaaatttagccgggtgtggtggcgggtgcctgtagtcccagctactcaggaggctgaggcaggagatggtgtgaacccaggaggcagagctggcagtgagccgagattgcgccactgcactctagcctgggcaacagagcaagactccgtctcaaaaataaataaataaaaataaataaattaaataaataaacaaaccagtaaagatatatcccacacaggtgtagtctgaaccaaactgtccctatctaatgaatacaaaagagtactggaactgagaaagcctttttgytggtttttgaaattgtctttaattggacagagaaactctaagactctctttctatagcatattatcaatgagctatgttccaaaagttttttaatactaaaaggtagccaggaaattacaatgcatttccctccagaaagaattctaaagccgggcgcggtggctcacacctgtaatcccagcactttgggaggctgaggcgggcagatcacgaggtcaggagatcgagaccatcctagctaacatggtgaaaccccatctctattaaaaatacaaaaaaaaaaaaaaagaaagaattct

SEQ ID NO: 171104 - DNA, 601 bp, Human
aacagtttttttttttttaaaaaaagaaaccaataggccaggtgcagtggctcacacctgtaatcccagcactttgggaggcctaggcagggggatcacctgaggtcgggagttcgagaccagcctgaccaacatggagaaaccctgtctccagtaaaaatacaaaattagccaggcgtggtgacgcatgcctgtaatcccagctacttgggaggctgaggcaggagaattgcttgaatctgggaggcggaggttgcggtgagccgagatcgccccattgcactctagcctgggcaacaasagtgaaactctgtctcacaaaaaaaaaaaaataaggccgggcgcggtggctcacgcctgtaatcccagcactttgggaggcggatggatcacgaggtcaggagatcgagaccatcctggctaacatggtgaaacgccgtctctactaaaaatacaaaaatttagccgggtgtggtggcgggtgcctgtagtcccagctactcaggaggctgaggcaggagatggtgtgaacccaggaggcagagctggcagtgagccgagattgcgccactgcactctagcctgggcaacagagcaagac

SEQ ID NO: 171105 - DNA, 601 bp, Human
acacgcctgttgtcccagctactcaggaggctgaggcacgagaatcgcttgaacccgggaggcagagggtgcagtaagccaagatcgtgccactggactccaggctggacaacagagcgagactctgtctcaaaaaaaaaaaaaaaaaaaagtacacacagtatgcatgttataaagaaaatgtatgcaaaatttaatttttacgatttttttctttttcctgagcagaatagtattttcttaagttaatggtttgtctggtgggactccacagtgccataaacagtttttttttttttawaaaaagaaaccaataggccaggtgcagtggctcacacctgtaatcccagcactttgggaggcctaggcagggggatcacctgaggtcgggagttcgagaccagcctgaccaacatggagaaaccctgtctccagtaaaaatacaaaattagccaggcgtggtgacgcatgcctgtaatcccagctacttgggaggctgaggcaggagaattgcttgaatctgggaggcggaggttgcggtgagccgagatcgccccattgcactctagcctgggcaacaagagtgaaactctgtctcaca

SEQ ID NO: 171106 - DNA, 601 bp, Human
cacacgcctgttgtcccagctactcaggaggctgaggcacgagaatcgcttgaacccgggaggcagagggtgcagtaagccaagatcgtgccactggactccaggctggacaacagagcgagactctgtctcaaaaaaaaaaaaaaaaaaaagtacacacagtatgcatgttataaagaaaatgtatgcaaaatttaatttttacgatttttttctttttcctgagcagaatagtattttcttaagttaatggtttgtctggtgggactccacagtgccataaacagtttttttttttttwaaaaaagaaaccaataggccaggtgcagtggctcacacctgtaatcccagcactttgggaggcctaggcagggggatcacctgaggtcgggagttcgagaccagcctgaccaacatggagaaaccctgtctccagtaaaaatacaaaattagccaggcgtggtgacgcatgcctgtaatcccagctacttgggaggctgaggcaggagaattgcttgaatctgggaggcggaggttgcggtgagccgagatcgccccattgcactctagcctgggcaacaagagtgaaactctgtctcac

SEQ ID NO: 171107 - DNA, 601 bp, Human
tttcagaagctgaataagtaaaggacatttgcagacgtctcttccttttcatttgaaaactcacctaaaaattattttaaaattctctgttgacaacttccctaattgaagctaacttcttgaaaggaacaaaaataagacatgcatttgctataatgaacatgatagactccagcaactttcattttaaatgtttatatagaaattatgcttaaaggccaggcacggtggctcatacctgtaatcccagcactttgggaggctgaagtgggcaaatcacctgaggtcaggagtttgagaycagcctggccaacatggtgaaacctcgtctctactaaaaatacaaaaatcagccgggtgtggtggcacatgcctgtaatcccagctacttgggaagctgagacaggagaatcacttgaacccaggaggcagaagttgcagtgagctaagatcacgccactgcacttcagcctgggaaacagagtaaaactctgtctcaacaacaaaaaaaagaaattatgcttaaaaaggaagttcataattgaatcacggcaactgcagtcattagccccaaaatgatgaccattacagagcaacagga

SEQ ID NO: 171108 - DNA, 601 bp, Human
taactaagtttgagaataatggaagtcatccatatcatagaaaaacaaagaaaacgggttctgcatggggtcaaacatgcacagaagtgttctggtttctgtttgaaatggagagttgaggaaaaaaactcaaactcaccacatattaactttttacaagatggaacttggttcaatccattattccctccacagttgctgagctgcctctgtagggccccaggcaccatgcctattctggagacatggtgatgaaaaggcaaatctttcttaaatgcaacaggctcctctccccagcccrcagcagcacccagacatgccagtgcccagaccttatttttcttgttgaatcttctcaccacccacacacaggtctccatggtacagcatgacagctcttcctataattctgatataaatcctccttttatccagagtctttggtcacaaaccgtaatacatacatgtgaaatgttcccaaatcttgagtagacactcaagattatgcctgtgagaaaactcctttccatgaaaacacagaagaaactactctcttttcttatcaaacccccgaagtacccaccagggcattcggcatggg

SEQ ID NO: 171109 - DNA, 601 bp, Human
ttacaagcatgagccaccatgcccagcctgaaactgaacagtttatcattataacccagaccaatacaatctgtttaattcacaggaaggtgtggtggctcatgcctgtaatcctagtactttaggaagccaaggcaggagaatcacttgaggccaggagttcaagaccagcctgggtaacacagtgagaccctgctctatttaattaaaagaaaaattatagtttcaaaaaaaaaatctactggccgggagcggtggctcacgcctgtaatcccagcactttgggaggccgaggcggacrgatcacctgaggtcaggagtttgaggccagccttaccaacatggtgaaaccccatctctactaaaaatacaaaaatcagcagggcatggtggcgtgcgcctgtaattccgctactcaggaggctgaggcacaagaattgcttgaacccgggaggcagatgttgcagtgagccgagattgtgccactgcactgcagcctgggcgacagagcaagactccatctcaaaaaaaaaaaaaaaattaaattaaattaaattttctaaaaatctatttaattcacaatttcttctcgtaaggaaac

SEQ ID NO: 171110 - DNA, 601 bp, Human
ttcatctctcctgttccaaatgacctatgatgtgtgccccccatacttgaaataagaaggcaatcttctaattcttactatagaataagtgtcctaactgatcgtgaatgcaagaaatactgaagaaaaaatctgtttgacataatctcttttgattaacacatggaacatttagaaaggagcaggtatgagccataagattccagaaactgaagtgttttgttttgtttcgtttttgtttttgttttttgagatggagtctcactctgtcgccaggctggagtgcagtggcgcgatctcrgctcactgcaacctccgcctcccaggttcaagcaattctcctgccttagcctcctgaatagctgagactacaggcgtgcaccaccacacccagctgatttttttatttttattagagacagagtttcacaatgttggccaggatggtctcgatctcttgacctcatgatccggccaccttggcctcccaaagtgttgggattacaggcgtgagccaccacacctggcctgttttgtttttgagacatggtctcactctgttgcccaggcaggagtacagtggcacgatctcagctcactg

SEQ ID NO: 171111 - DNA, 601 bp, Human
tcctggcccttactataaaattcagtcactaaagaaagcagctaataaccatctcactaccataaaagcagaaatatacaatgtcacgctatcctggataatgaggagtcatagaaatcccctacatacccttcactgcttttgtgtttttctgaagttaatgcaaacagagaagcaaaacaacattaccagcagtttcagaggatgtgggattcacttcttgatcatttctaaataattttccacctcctccatgcctctatgattgcaactgaaactaaattgcaacaataattagagmcaatcaagtagtgtggcaacggagcaaatggacaggttcaggcaaagttcttttctttagaagcccactctgaagactttcatcttggagaggagagcaggaaaggtgtggaacaataacaggaaagcagactcgaccagactcgacacggctctcaagttgaagtcttccaccggtccagcacaatacacagagatgtttcatccctttcatctctcctgttccaaatgacctatgatgtgtgccccccatacttgaaataagaaggcaatcttctaattcttactatagaataagtgt

SEQ ID NO: 171112 - DNA, 601 bp, Human
ctcatacctgtaatcccagcagtttgggaggccaaggcaggcatattccttgagctcaggggttcaagaccagcatggccaacatggtgaaacaccgtctctcctaaaaatacaaaaactggccaggcgcagtagctcacatcggtaatcccagcactttgggaggccgaggtggacagatcacatgaggccaggagtttgggaccagcctgcccaacatggcaaaatcccatctctactaaaaatacaaaaattagccaggcatggtggtgcccgcctgtaatcccagctactcaggagsctgaggcaggtaaactgcctgaacctgggaggcagaggttaagagagctgagattatgccattgcatgccagcctgggcaatagagcaagaccctgtctgaaaaataaaataaaataaaaatgtaaaaataagccaggtacagtggcacatgcctataatcccagctactcaggtggatgaagcatgagaaatgcctgaacccaggaggcagaggttgcagtgagccaagatcacgccactgccctccaacctggacgacacagcaagactgtctcaaagaaaaaagaaggccaggtgcg

SEQ ID NO: 171113 - DNA, 601 bp, Human
taagccagggagtcagaggttgcagtgagccgagatcgcaccactgcactccagcctgacgacacagcaagacttcgtctcaaaaaaaaaaaagaaaaatacaaaaattagccaggcatggtggcgggtgtctgtaatcccagctacttgggaggctgaggcagaataattgcttgacccgggaggtggaggatgcagtgagtcgaaattgtgccactgcactccagcctgggcaacaagagcaaaattcccatctccaaaaaaaaaaaaaagaaaagaaaagaaaagaaaaaaaaaaaaaaaagaaatctgtgatattactacaaaataggcgggttttttttgttttgttttgttttgttttgtttgagacggagcctcactctgtcacccaggcgggagtgcagtggtgtgacctcggctcactgcaatctccacttcccgggttcaagcgattctccttgttcagcctcccaagtagctgggactacaggcgtgcgccatcacgcctggctaatttttatatttttagtagagatggggtttcaccatgttggccaggatggtctcgatctcttgactttgtgatccgcctgcctcg

SEQ ID NO: 171114 - DNA, 601 bp, Human
tgtaatcctagttactcgggaagctgaggcaggagaatcacctaagccagggagtcagaggttgcagtgagccgagatcgcaccactgcactccagcctgacgacacagcaagacttcgtctcaaaaaaaaaaaagaaaaatacaaaaattagccaggcatggtggcgggtgtctgtaatcccagctacttgggaggctgaggcagaataattgcttgacccgggaggtggaggatgcagtgagtcgaaattgtgccactgcactccagcctgggcaacaagagcaaaattcccatctccaaaaaaaaaaaaaagaaaagaaaagaaaagaaaaaaaaaaaacaaagaaatctgtgatattactacaaaataggcgggttttttttgttttgttttgttttgttttgtttgagacggagcctcactctgtcacccaggcgggagtgcagtggtgtgacctcggctcactgcaatctccacttcccgggttcaagcgattctccttgttcagcctcccaagtagctgggactacaggcgtgcgccatcacgcctggctaatttttatatttttagtagagatggggtttcaccatgttggcc

SEQ ID NO: 171115 - DNA, 601 bp, Human
aaaaataaaaaataaaaataaaaaaaagaacgggcgcagtgcctcacaccagcaccttgggagatggaggttggcaaatcacttgaggccaggagatcaagaccagcctggccaacatggcaaaacccagtctctactaaaaatacaaaaactagccaggtgtggtggcacatgcctgtaatcacagctactcaggaggctgaggcacgagaatcacttgaacccaggaggcagaagttgcagtgagctgacatcacgccactgcactccagcctaggcaacagagcaagactatgtctcaaaaaaaaaaaaagcaaaataatcagcataaaatatccctggtttaaaccctctcatagctccgtgtcccacagaataagtcctgtgtaacaacacatactgaagccccccataactgtcccccatttctctaaccctgcctctggcctcctccctctgctcacagcctactctccaggcacaaagaaccatttgtagctccccaagtggcgaaactgcttcacacctcctgtcctctcattctctttgctttgatatatacttctttgcaatgttctcctacttggcactaactcatctt

SEQ ID NO: 171116 - DNA, 601 bp, Human
agggccaggagcaagtctcggacatgctgaatcttggacaatgatgggatatccaaggggaaatgtgcaggaagcacttgaaaatgccagaatgcagctaagattcaaacgttctcttaatttcaatcttagggctgttggaaataatatttcagagaattagagaacacaaaagaaaggaagttaaacaggtttcaaaaacacatatagtctgcagctgctgtgtacagaagccagaacagacaaaatgaaatgtgagaccgatcgtcctggaggtttacaacacatcacatatgaatgytttcattcaagactggctcggaatcattgtccaaaggtataaaaaggagtctataaatactcttaatatcccccagaaaaatacaaaaagctctccactctgcaacttccagctcctgccctctctctctttccatttaccatctagttacctgaagagttatatacatttgccttcaaagtttccctttcagatctcttcctctacccagcccttcagtggtggtattccaagacgacatccttggactcctcaatcagcccgtggcatcacccactccctgggttccactcccactcc

SEQ ID NO: 171117 - DNA, 601 bp, Human
aaaatcagtacagtatttgttgccacccacagggtaactgtgagggttcaatgagaacttacgaaaaatgttcagcaatgaacttcatgtgcagcaagcagttaactgctagtgtgggaacagctagagcagtgacacctactctggcatgttcccatctcacttcatcccagtaggtaactgcctgttgggtttgctcaaaagtacgtctcagccgggcatggtgtctcacgcctgtaatcccagcactttgggagtccgagatgggaagactgcttgaggccaggaattcaagaccagcctgatcaacatagtgaatccccatgtctaaattttttaaaaccattttttttaaagtacatctcactcagaacacagtgaaagctgaaagtccccaggctcccatagcatttgttggtatttccaccatagcaaatttccacgtgaaccgccctacactgtgagcttctggaaagcagggcctatatcttaaaattcttcacagcctgagcataaagcaaataccctgacacaaagaatttaaaaagtctgaacaaacggatgaatagatgaacaaatggatgaatagatgaacaaatgg

SEQ ID NO: 171118 - DNA, 601 bp, Human
atgtccctttagaatctctctacttctccatttcctcacctataaaatcagtacagtatttgttgccacccacagggtaactgtgagggttcaatgagaacttacgaaaaatgttcagcaatgaacttcatgtgcagcaagcagttaactgctagtgtgggaacagctagagcagtgacacctactctggcatgttcccatctcacttcatcccagtaggtaactgcctgttgggtttgctcaaaagtacgtctcagccgggcatggtgtctcacgcctgtaatcccagcactttgggagyccgagatgggaagactgcttgaggccaggaattcaagaccagcctgatcaacatagtgaatccccatgtctaaattttttaaaaccattttttttaaagtacatctcactcagaacacagtgaaagctgaaagtccccaggctcccatagcatttgttggtatttccaccatagcaaatttccacgtgaaccgccctacactgtgagcttctggaaagcagggcctatatcttaaaattcttcacagcctgagcataaagcaaataccctgacacaaagaatttaaaaagtctgaacaaa

SEQ ID NO: 171119 - DNA, 601 bp, Human
aacgtttagaaagtacataaattcatctctgagaggtctgagaaaaagaaaaaacaatgaaaagacataaatagcatataaggtatgtaaaagtacaagacataaaaatgaagaggggggtgtgaatgagcagccagtatagaaaaagcccattcaaagcatggcctgtgcatggagcctgagaaatctagcttgtggtgccagctcaaccactcagcagctatgtccctttagaatctctctacttctccatttcctcacctataaaatcagtacagtatttgttgccacccacagggtaactgtgagggttcaatgagaacttacgaaaaatgttcagcaatgaacttcatgtgcagcaagcagttaactgctagtgtgggaacagctagagcagtgacacctactctggcatgttcccatctcacttcatcccagtaggtaactgcctgttgggtttgctcaaaagtacgtctcagccgggcatggtgtctcacgcctgtaatcccagcactttgggagtccgagatgggaagactgcttgaggccaggaattcaagaccagcctgatcaacatagtgaatccccatgtctaaatttt

SEQ ID NO: 171120 - DNA, 601 bp, Human
aaaacatagaataatcattttcttctttttataagctcacaactaataccataaaataatatttccatctaaatgtcttttttttttttttttaagacacagtcttgctctgttgtccaggctggagtgcagtggcactatctcggctcaatgaaacctccgcctcctgggttcaagcaattctcctgcctcagcctcctgagtagctgggactacgggcgcaccccaccacgcccagctaatttttgccaggatggtctctatctcttgacttcatgatccacccacctcagcctcccaragtgctagggttacagatgtgagccaccgcgcccggcctaaatgtccctttttcaagatttgtactgaaatctctgaatgcataaaaaatgtctctataaacttcccagcaagtcaacagtgaggaactcactaactggttatcaacataagcagtttcagcaagaaccaggcttatatataaaccccaaaataatggaagaatgaaattagatgtatgcacgaggtaagagggatctattttaactgcaactcccaagtttccatgagcaatttcagtgacctttgtttctatatcaaa

SEQ ID NO: 171121 - DNA, 601 bp, Human
atcagccaactttagaagagggagattatcctagagtatccaagtgggcacacggattcttccaaatggaagagggaggcaggacaatcagtgtcagagtgatgagaggtgagactcaatcagccactgctggctttgaagatgcaggaaggagctaagagccaaggagtgtgggcagcctttagaagctggaaaggtaaggaagtagatctttccctagagcctccagaaagaaacacaaccctgctgaaatacattttggcccagtgagacccattccagacttctggcctccaaactrtaagataataatgtatattgtcttaagccactaaatttgtgataatttgttatggcagcaacaggaaactaatacaatggaaatgtccgtccggctgctttctggatgtttttaatctcaaaaaaagacttttggccaggcacggtggctcacgcctgtaatcccagcactttgggaggaagaggtatgtggatcacctgaggtcaggggttcgagaccagcctggccaacgtggtaaaaccctgtctctactaaaaatacaaaattagccaggagtggtggcatatgcctgtagtccca

SEQ ID NO: 171122 - DNA, 601 bp, Human
aaccttctgactcaagatagtctctgttccggtaatttgatgacaaatagtgttgctgatcagcagaatatagagtggaaagggcggcttttttgcacatgccttcccctacctttgaattaggagcactcttctaaaactagaaatgcttcacgaagtcagacaaagtctacaaagtactgcaatacttaatacccatgaggcacacttccataagaagaaaatgatatgcaggaaggattaaactgcccattctcacaagaaacattccatgggcaaaggcactaaggtagatgtatasatgtagtcggcaggataatggtcccaaagatatacatgtcctaatcactggaacctgtgaacatgttaaattccatggcaaaaggggattaagattgcagatggaattacatctcctaatcagccaactttagaagagggagattatcctagagtatccaagtgggcacacggattcttccaaatggaagagggaggcaggacaatcagtgtcagagtgatgagaggtgagactcaatcagccactgctggctttgaagatgcaggaaggagctaagagccaaggagtgtgggcagcctt

SEQ ID NO: 171123 - DNA, 601 bp, Human
ataatacagggaactaaaagcactcacactactcaaagcttattaaaacctctttaaaaatcaagaggcaggggccaggcgcggtggctcacgcctgtaatcccaacactttgggaggccgaggcgggcggatcacgagatcaggagatccagaccagcctggctaacacggtgaaaccccgtctctactaaaaatacaaaaaatcagccgggcgtggtggcgggcacctgtagtcccagctactcgggaggctgaggcaggagaatgacgtgaacccgggaggcggagcttgcagtgagmcgagatcacgccactgcactccagcctgggggacagagcgagactccgtctcaaaaacaaaaaaaaaagagtgttatttttaaaaactttttaaagcttaaattcctcttattagaatgctatacacacacatttatacgtttgagaaaacagtagtccaaagcaagagcaggaaagggaaagaacagtagtagtcagctagacatttggttttgtatccttaacatctattctgagtggaaattaaaccaaatgagcctttaacataaacgtttgaaagagtaacagcatctggcctgc

SEQ ID NO: 171124 - DNA, 601 bp, Human
cactcaacacgggaaatgaagggaagcatctctggccaggccaactcaagccagagcctgcctgtgtgatgtgaccttggagagaacagttagaggttctgaagcgtgagtttccacacctggggtccccaaatttaggggcattagaagtatatttgtgtgcatgtgtgtacaagcatgtgcatgtatgtacgtatttattcattcactcattcctggatctgccctggtacgtttggtatggctagagtaaggaaccagaataaatggcttttttgaaagattcctccagggattctgygggttagtcaagtatgggaaccaccattctaacccaaatttactagattacgaactttaaaagggaaggctaaacaaaccacttctgcatgttcatctgcctaggacatctgctaccacaattgcaaaaggtgcccatgtggaacggaaaatacatggttgaattttacaaatttagacatataaagctaaaaactcaagaaacactgaattccctcttttgactactgatgttttaattctggcctctatccaaatagcaggtttatatatatatatatatatatatatatatacacac

SEQ ID NO: 171125 - DNA, 601 bp, Human
aaaaaatgctacaattacaggtgtgagccatcatgcccagcccaaaattgtgatttttagtacaagaatataaaataaatttttgcatttagtttgtgactgaagttttatgtcacttttttaaggtaaatccatttttaaatttatgcaaaataacatacttataaaaatctttaactgctttgcatattatacttatgttaaataaaagctcttctaagccttattttgaaactagttacatatcatttgtacattccattcctaactaacctctattatattttatatataataaaayatttttaaggggaaaatggtctgtcacacaatccagccattccatgtgtaggtataacacaagagaagtgaaaacatatccacataatgactcatacatgaatgttcccagcagttttatacacaatagcccaaatctggaaacaactcatatgttcatcaacaggtgaagagaccaaaaacgtggtgcagccatacagtggaacattactcagcaatgaaaaggaacaactgatacccccaacaatgaatctcaaacataatattatttatttatttatttgttttgagacagagtcta

SEQ ID NO: 171126 - DNA, 601 bp, Human
tttaagcaatcctcccaccttagcctcccaagtagctgggaccacaggtgtgcaccaacgtgccaaactaatttttttcttttttatttgtagagacagagtgtcactatgttgcccaggctggtctcaaattcctgggctcaagcaatcctcctacctcaacctcaaaaaatgctacaattacaggtgtgagccatcatgcccagcccaaaattgtgatttttagtacaagaatataaaataaatttttgcatttagtttgtgactgaagttttatgtcacttttttaaggtaaatccatttttaaatttatgcaaaataacatacttataaaaatctttaactgctttgcatattatacttatgttaaataaaagctcttctaagccttattttgaaactagttacatatcatttgtacattccattcctaactaacctctattatattttatatataataaaacatttttaaggggaaaatggtctgtcacacaatccagccattccatgtgtaggtataacacaagagaagtgaaaacatatccacataatgactcatacatgaatgttcccagcagttttatacacaatagcccaa

SEQ ID NO: 171127 - DNA, 601 bp, Human
tgggagaattgcttgaggccaggagttctagaccagcctgggcaatatagtgagaccctatctctaatttaattataaggaaaaaagaaagaaaaaataaaaacaagtcacaaggccggtgccacaggcaagtgccaaacctccccagaagactcatgctcttggccaggcagtggctcatgcctgttagctcaacactttcgggaggatcacttgagcccagaagtttgagaccagcctgagcaacatggtcagaccttatctctacttaataaataaataaataaataaataaataaagaaagataacaacaaagaatcggagggctgctgacatccctaattacatggggtttgtgcactgcccttagggaatctaacagtagattataaacattaactgagcagtaataacagttaggacagaagacagtgtataataaggtactaaatggactaaataggtgatttgccatactccaattatgaaaacaccaacttctgcaaactttaattacttttaactcctgccatctatctcatctggggacatcaatcactgattctttagagtaacctttaattaaaatcttagttccaa

SEQ ID NO: 171128 - DNA, 601 bp, Human
gtgggagaattgcttgaggccaggagttctagaccagcctgggcaatatagtgagaccctatctctaatttaattataaggaaaaaagaaagaaaaaataaaaacaagtcacaaggccggtgccacaggcaagtgccaaacctccccagaagactcatgctcttggccaggcagtggctcatgcctgttagctcaacactttcgggaggatcacttgagcccagaagtttgagaccagcctgagcaacatggtcagaccttatctctacttaataaataaataaataaataaataaataartaaagataacaacaaagaatcggagggctgctgacatccctaattacatggggtttgtgcactgcccttagggaatctaacagtagattataaacattaactgagcagtaataacagttaggacagaagacagtgtataataaggtactaaatggactaaataggtgatttgccatactccaattatgaaaacaccaacttctgcaaactttaattacttttaactcctgccatctatctcatctggggacatcaatcactgattctttagagtaacctttaattaaaatcttagttcca

SEQ ID NO: 171129 - DNA, 601 bp, Human
ggtgggagaattgcttgaggccaggagttctagaccagcctgggcaatatagtgagaccctatctctaatttaattataaggaaaaaagaaagaaaaaataaaaacaagtcacaaggccggtgccacaggcaagtgccaaacctccccagaagactcatgctcttggccaggcagtggctcatgcctgttagctcaacactttcgggaggatcacttgagcccagaagtttgagaccagcctgagcaacatggtcagaccttatctctacttaataaataaataaataaataaataaatatataaagataacaacaaagaatcggagggctgctgacatccctaattacatggggtttgtgcactgcccttagggaatctaacagtagattataaacattaactgagcagtaataacagttaggacagaagacagtgtataataaggtactaaatggactaaataggtgatttgccatactccaattatgaaaacaccaacttctgcaaactttaattacttttaactcctgccatctatctcatctggggacatcaatcactgattctttagagtaacctttaattaaaatcttagttcc

SEQ ID NO: 171130 - DNA, 601 bp, Human
aggtgggagaattgcttgaggccaggagttctagaccagcctgggcaatatagtgagaccctatctctaatttaattataaggaaaaaagaaagaaaaaataaaaacaagtcacaaggccggtgccacaggcaagtgccaaacctccccagaagactcatgctcttggccaggcagtggctcatgcctgttagctcaacactttcgggaggatcacttgagcccagaagtttgagaccagcctgagcaacatggtcagaccttatctctacttaataaataaataaataaataaataaataaataaagataacaacaaagaatcggagggctgctgacatccctaattacatggggtttgtgcactgcccttagggaatctaacagtagattataaacattaactgagcagtaataacagttaggacagaagacagtgtataataaggtactaaatggactaaataggtgatttgccatactccaattatgaaaacaccaacttctgcaaactttaattacttttaactcctgccatctatctcatctggggacatcaatcactgattctttagagtaacctttaattaaaatcttagttc

SEQ ID NO: 171131 - DNA, 601 bp, Human
cttcaatcctagcacgttgggaggctgaggtgggagaattgcttgaggccaggagttctagaccagcctgggcaatatagtgagaccctatctctaatttaattataaggaaaaaagaaagaaaaaataaaaacaagtcacaaggccggtgccacaggcaagtgccaaacctccccagaagactcatgctcttggccaggcagtggctcatgcctgttagctcaacactttcgggaggatcacttgagcccagaagtttgagaccagcctgagcaacatggtcagaccttatctctacttaataaataaataaataaataaataaataaataaagataacaacaaagaatcggagggctgctgacatccctaattacatggggtttgtgcactgcccttagggaatctaacagtagattataaacattaactgagcagtaataacagttaggacagaagacagtgtataataaggtactaaatggactaaataggtgatttgccatactccaattatgaaaacaccaacttctgcaaactttaattacttttaactcctgccatctatctcatctggggacatcaatcactgattctttag

SEQ ID NO: 171132 - DNA, 601 bp, Human
agacaggacagagaacttcttttttttgagacagagtcttgctccgtcacccaggctggagtgtagtggtgtgatctcagctcaccacaacctccgtctcctgggttcaagtgattcttctgcctcagcttcccgagtaactgagactacaggtgcgcgccaccacgcacagctaatttttgtatttttagtagagacagggtttcattattggccaggctggccgcaaactcctgagctcatgatccacccgcctcagcctcccaatgtgctgagattacaggcgtgagccactgcaccyggccaagagagagaacttcaacaacgtatttcagtttataatcttaaccatgtaaatataagtaaggtcacacacctcatatcacaatgtgattatacagattaaatacgatactgaaaatgttaaaatgcctaattaaatacaaagccataggtagtactataacgcatgaattttgttgttgtttagttcaagactagtcctgccaagacattcataatcttgggaaacaggacacacaagaacacataaagcaagaaaaagtacactcaggattaccaaatctcccccaaaggttta

SEQ ID NO: 171133 - DNA, 601 bp, Human
aatgctgccgatcatctcagacaggacagagaacttcttttttttgagacagagtcttgctccgtcacccaggctggagtgtagtggtgtgatctcagctcaccacaacctccgtctcctgggttcaagtgattcttctgcctcagcttcccgagtaactgagactacaggtgcgcgccaccacgcacagctaatttttgtatttttagtagagacagggtttcattattggccaggctggccgcaaactcctgagctcatgatccacccgcctcagcctcccaatgtgctgagattacaggcgtgagccactgcacctggccaagagagagaacttcaacaacgtatttcagtttataatcttaaccatgtaaatataagtaaggtcacacacctcatatcacaatgtgattatacagattaaatacgatactgaaaatgttaaaatgcctaattaaatacaaagccataggtagtactataacgcatgaattttgttgttgtttagttcaagactagtcctgccaagacattcataatcttgggaaacaggacacacaagaacacataaagcaagaaaaagtacactcaggattaccaa

SEQ ID NO: 171134 - DNA, 601 bp, Human
tcatagaaattacctttaaaaagtacctaattggagtaaaatctctactatcaataaagagtaccagggctacagggataaacaatgctgccgatcatctcagacaggacagagaacttcttttttttgagacagagtcttgctccgtcacccaggctggagtgtagtggtgtgatctcagctcaccacaacctccgtctcctgggttcaagtgattcttctgcctcagcttcccgagtaactgagactacaggtgcgcgccaccacgcacagctaatttttgtatttttagtagagacarggtttcattattggccaggctggccgcaaactcctgagctcatgatccacccgcctcagcctcccaatgtgctgagattacaggcgtgagccactgcacctggccaagagagagaacttcaacaacgtatttcagtttataatcttaaccatgtaaatataagtaaggtcacacacctcatatcacaatgtgattatacagattaaatacgatactgaaaatgttaaaatgcctaattaaatacaaagccataggtagtactataacgcatgaattttgttgttgtttagttcaagacta

SEQ ID NO: 171135 - DNA, 601 bp, Human
ttgtgaggaaaaagggaaatgttagttattactcttttccactgtaaaggagttttttaataagcatttttatagagattttcatagaaattacctttaaaaagtacctaattggagtaaaatctctactatcaataaagagtaccagggctacagggataaacaatgctgccgatcatctcagacaggacagagaacttcttttttttgagacagagtcttgctccgtcacccaggctggagtgtagtggtgtgatctcagctcaccacaacctccgtctcctgggttcaagtgattctyctgcctcagcttcccgagtaactgagactacaggtgcgcgccaccacgcacagctaatttttgtatttttagtagagacagggtttcattattggccaggctggccgcaaactcctgagctcatgatccacccgcctcagcctcccaatgtgctgagattacaggcgtgagccactgcacctggccaagagagagaacttcaacaacgtatttcagtttataatcttaaccatgtaaatataagtaaggtcacacacctcatatcacaatgtgattatacagattaaatacgatactgaa

SEQ ID NO: 171136 - DNA, 601 bp, Human
ccatctccctctcttcgccagttacaaggctgatcatatgatctccatgttcagatttctttttctatttctagtaggtttagagcttgtgaggaaaaagggaaatgttagttattactcttttccactgtaaaggagttttttaataagcatttttatagagattttcatagaaattacctttaaaaagtacctaattggagtaaaatctctactatcaataaagagtaccagggctacagggataaacaatgctgccgatcatctcagacaggacagagaacttcttttttttgagacrgagtcttgctccgtcacccaggctggagtgtagtggtgtgatctcagctcaccacaacctccgtctcctgggttcaagtgattcttctgcctcagcttcccgagtaactgagactacaggtgcgcgccaccacgcacagctaatttttgtatttttagtagagacagggtttcattattggccaggctggccgcaaactcctgagctcatgatccacccgcctcagcctcccaatgtgctgagattacaggcgtgagccactgcacctggccaagagagagaacttcaacaacgtatttc

SEQ ID NO: 171137 - DNA, 601 bp, Human
tccataaggcacatcatggcctcttgtacttaggaacaatagacagaaattcagcattatgattaggggctattttaaagagcaagtcaccagcaaaggcacaaaaatacaaaaaaaaaaaaaatgtaatgctaaatagaccacataaaggtcatttgtttacagtatgagggctgaaacaagaaatcagtcaccttgtttcacagtggctggaaatgtgtacactgagcaaactgcatttttcactgctctgtgaatgtccagaaatgaccacgaaaggactacctttggactgatttgygggttacaaataagctttagtgagtaggaaaattcatgaatacaaaatccacaaataacaaggattgactgcataaacgaagaaggaatcagagtacaggtatctctctgctattggttatatcaaatgataatttcatcttttttgttttttgttttgttttgagacggagtctcactgtgtcacccaggctggagtgcagtggcatgatctcggctcactgcaaacccggctaattgttttgtatttttagtagagacagggtttcaccatgttggccaggctggtttcgaaaccctg

SEQ ID NO: 171138 - DNA, 601 bp, Human
gcttatttaatatatattgttgtgttttgttttgtttaagacagggtctcactctgtcacccaggctggagtccagtggtgacatcctggctcactgcaacctctacctcccagactcaagcaatcctcccaccttagccacctgaatagctggaaccatgggcgcatggcggggggacatgggctctatttttagtagacacagggtttcgtcgtgttgcccaggctggtctcaaacccctgggctcaagcaatccacctgcctcagcctcccacagtgctgggattacagatgtgagcmaccatgcccagccaactgttgattcattaacattgaactcatggccaacagcactgtaactcattcctgagcaaagcttcgctaacatactatattttctccataaggcacatcatggcctcttgtacttaggaacaatagacagaaattcagcattatgattaggggctattttaaagagcaagtcaccagcaaaggcacaaaaatacaaaaaaaaaaaaaatgtaatgctaaatagaccacataaaggtcatttgtttacagtatgagggctgaaacaagaaatcagtcaccttgttt

SEQ ID NO: 171139 - DNA, 601 bp, Human
tggcttatttaatatatattgttgtgttttgttttgtttaagacagggtctcactctgtcacccaggctggagtccagtggtgacatcctggctcactgcaacctctacctcccagactcaagcaatcctcccaccttagccacctgaatagctggaaccatgggcgcatggcggggggacatgggctctatttttagtagacacagggtttcgtcgtgttgcccaggctggtctcaaacccctgggctcaagcaatccacctgcctcagcctcccacagtgctgggattacagatgtgarccaccatgcccagccaactgttgattcattaacattgaactcatggccaacagcactgtaactcattcctgagcaaagcttcgctaacatactatattttctccataaggcacatcatggcctcttgtacttaggaacaatagacagaaattcagcattatgattaggggctattttaaagagcaagtcaccagcaaaggcacaaaaatacaaaaaaaaaaaaaatgtaatgctaaatagaccacataaaggtcatttgtttacagtatgagggctgaaacaagaaatcagtcaccttgt

SEQ ID NO: 171140 - DNA, 601 bp, Human
aaaataataccacatacttattccacaaaatatttcttagcctgctccctctgggtctgaaaaggatagcaaatcaatggccagggggtgagaatatgcttctccacgtgcccagaaggaagggaacatgagatatgggtgcacagagtggcatcagctacgggaagctcatgtggcatccaggcaagtaattcagtggcctccactagcacatcagcagcagagatgcagaaaaacagattacttcaagatgcgttttggaagtagaataaaccatactactaatgaactggataggcaraacaagagaaagggaaggctgatatcaaaacattcaaaacatttgatgggaacacctatgtgagcggatatgctatttctcaggtggggtgaataaagagggacacagcaccaggggctctgctgtggccatgccaactgtgagagaccctgtaggtatcccccaggagatgtcaaatgtggcactgggatgtcacagcctgaagtttaggggtaggaagagggctaagctatagctgattcttgctattcaaagtagttattgtttaaaaagttgttgctgttgccgggcacagtggct

SEQ ID NO: 171141 - DNA, 601 bp, Human
ggaggtcaaggctgcagtgagctgtcatcaccccactgcactccagtcttcgtgacagagtcagactctgtctcaaaaataataataataaaagtgtacactgatttattaaaaaaagatttgactctttaccatgtgttcattctaaatgatgtctgttgaactgtgccaagcactatgttagccaagagctagacctacaaaggtcaagaaaacaaagtatctccctcttcaaaacacaagagttcattggaggacacaggtaatggcagcgccaaaaaaaaaaaaaaaaaaaaaaaargaaaaaactacatggcatgctaaggatcaggctctgaaggcccagagtatgccaggctcgtagagtaagaatagaaaaagtccctgggaggggtgggaagatagtggcacaggtatactaacgaggggagtgacttttaagaaaatgcacactctcagcagcattctctggtatttaggaagagatctggggagactcaaatactgcactgcggtcccaatcttgaaggatctagaggtcaacatctgcggggaggaggcactgtctgggagaggcaggacatttttagagaatactatt

SEQ ID NO: 171142 - DNA, 601 bp, Human
ggctcaggaggtcaaggctgcagtgagctgtcatcaccccactgcactccagtcttcgtgacagagtcagactctgtctcaaaaataataataataaaagtgtacactgatttattaaaaaaagatttgactctttaccatgtgttcattctaaatgatgtctgttgaactgtgccaagcactatgttagccaagagctagacctacaaaggtcaagaaaacaaagtatctccctcttcaaaacacaagagttcattggaggacacaggtaatggcagcgccaaaaaaaaaaaaaaaaaaraaaaaagaaaaaactacatggcatgctaaggatcaggctctgaaggcccagagtatgccaggctcgtagagtaagaatagaaaaagtccctgggaggggtgggaagatagtggcacaggtatactaacgaggggagtgacttttaagaaaatgcacactctcagcagcattctctggtatttaggaagagatctggggagactcaaatactgcactgcggtcccaatcttgaaggatctagaggtcaacatctgcggggaggaggcactgtctgggagaggcaggacatttttagagaat

SEQ ID NO: 171143 - DNA, 601 bp, Human
caattctttcaaaggttccttctactttggttacctaaaaaacatagaggtatactatttttgtgtattgacataaatgcatctattagaccttgggggaaaaaagagttgatggcaaaggatatatgtaatgtgtcaacaagaattcaaagaacttgccattccttgacataggcttaccttgtacctagcaaagcaagctatgggatttctgatcacatttgctagtacataccttcatgacacagactttttagcacttttgttatcaaaagaaaaactcaaaaccgattagatgtcaaaaaaaaaaaaaaaaagaaaacctaaaccatatcctttgttttatgtacacaatttgcatttacttcaatttttgcctaaggaccagtaactcttgcaagaaaaaaaataagagaggtatgcatcacaaagactgatcttatttagtttctatcaagaaaatccatgaccagttccataacttgccacaaaactgaaaaactgtgtggttttgagtatgtacattttggggatttttctttctgagaagggggtcaagagcattggtcagatgctcagagaggacccttgagccaggact

SEQ ID NO: 171144 - DNA, 601 bp, Human
aaactgccttgctgcaggagatggagaggagacctggaaatcttaactgccaacaatgaacactttcaaaccaccctcgtttccttatctccattctcagaggtgctgggtaccctgcagcctttctggaatttgggggtaaatcattttgcttcctggtatcctctctctgcagcttagacctttcctaacaagctgccaaatgggagacagcttagggcatacaatcacgcaagtgtcctccaaagtcccgaagaacatctgcaaggtggggtggagcataacaaagacttgtccagcstctgcaggcagaaatccagacacctggacacactgcacaattctttcaaaggttccttctactttggttacctaaaaaacatagaggtatactatttttgtgtattgacataaatgcatctattagaccttgggggaaaaaagagttgatggcaaaggatatatgtaatgtgtcaacaagaattcaaagaacttgccattccttgacataggcttaccttgtacctagcaaagcaagctatgggatttctgatcacatttgctagtacataccttcatgacacagactttttagcacttt

SEQ ID NO: 171145 - DNA, 601 bp, Human
gcaggagaatcacttgaacctgggaggcagaggttgcagtgagctgagatggtgccactgcactccagcctgggagacagagcaagactccatctcaataaataaataaataagtaaaataaaaaataaagtgctagcctagccacagctaaatgcacagtgtggattatcatttaaaacacacgccaactagacagacataatgtagtattttaatgtctacgcttctgtggtgtggtggtgtcagagcttctgttgtatttatttagtgtgggcatttgtcctgtgagttacttaaaartattccttggcacttaaaaaaagtaattggaaaatgttgcgtaactatttttgtagagacagaaagatgtctatgttatactgttaaatgaaaaaatcatgtaacaaaaatgcatagactataaaaatgaaaaaagaaataagccaggaagaatatatactaaacacattaacaatcattatctctgggcggtgggatggtagagaattctcccatcatctccgtccactcaccagcccctccttctctgttctcgtccacagtacaccagactccacactggtctccagccagcagtct

SEQ ID NO: 171146 - DNA, 601 bp, Human
tgtttaatggttgcattatgtatatgttgtaacttacttaaccacttctactgttgggcattaatctttttctttccttatatcctgtaaaatgctgcaacatccttgtaacctttgcctcctcagctcctactagttccttaggctaaatttctctaagtgggcttaagagctggtcaaaagatacgaactactttaaggctcactatacactgctatgaaactgatttccaaaataactgttttcatttaccagctgtcttctaacatgctgccctgctgggccagtggctcatgcctrtaatcccaggcctttaggaggctgaggtgagaggactgactgagcccaggagtttgagactagcctgggagagaaggtgggaccctgtctctacaaaaaatgtaaaaattagctgggcgtggtggcacatgtctgtggtcccagctacttgggaggctgagacaggaagatcgcttgaatctgcaaggttgaagccacagtgagctatgattgtgctgttgcactccagcctaggcaagagtgagaccctgtctcaaaaataaataggccgggtgtgctggctcacgcctgtaattccag

SEQ ID NO: 171147 - DNA, 601 bp, Human
tcaatcattatcccagagacagaaacattcctagagtgggagtgtgcagaaaggtaagataggcaccacctataaaagtgagggcagagtttagagaggacaccaaggagtaataaagccccccagactagcaacaggggcagcccccatcactgctaagtcaagacggggtgcgagggcatcatactgctgctaaaagtggcaaatgggagctctctggcaagagtgtcagtagaggattcagcaagcctcagttaccagcaggagagaatcaccttgacttcactcttctctcaccctygcgtctcctggtcaaacccaaccaggaaccacactccctccaggacagcctccggcagacagcaggatggagccggacaggaagtagagctggaggcaaaaggaaggtgtcgggtgcaaccctcaagccagatcctgggggccaggtttcccactgtcaggaaaaggaatttggaaacatgaaaagggggaaggctagaaagaaccctaaggttggaatggaattgaaggagctggtatgtttaatggttgcattatgtatatgttgtaacttacttaaccacttctactgttgggcatt

SEQ ID NO: 171148 - DNA, 601 bp, Human
atcccttaaatagattttagcctcaccccctccagcaatagattaggtgggaatacacaagcatgtaatggtctaaaatgtttcaaaactaggctgggagttgtggttcatgtctgtaatcccagcactttgggaggccaaggtgggaggactgcttgaagccaggagttcaagaccaacctgggcaacaaagcaagatcctatttctacaaaaaaattaaataaatgacagtagaaaaaaaaacgtgaatatttatataatattctagggaaggtttgttttttgaaagcataatacccrtatcaatcattatcccagagacagaaacattcctagagtgggagtgtgcagaaaggtaagataggcaccacctataaaagtgagggcagagtttagagaggacaccaaggagtaataaagccccccagactagcaacaggggcagcccccatcactgctaagtcaagacggggtgcgagggcatcatactgctgctaaaagtggcaaatgggagctctctggcaagagtgtcagtagaggattcagcaagcctcagttaccagcaggagagaatcaccttgacttcactcttctctcacc

SEQ ID NO: 171149 - DNA, 601 bp, Human
cacagccagtgatcccaacttgtaagagggcaggtcacttctattttctccctactgtcaaatggtatagcgtttctctggaatagacacccaaaggcagaaaagctggtcatgaggcctgagtacttaaagctttcacagatgctgccaaagtgcttgccacgtccctgatgggaccaaacttaacttctgccagtcagacagtgggaaacggtttctcgttgttgttggtcatttgcactgacctgattactgatgatgctgattatcttttcgtaagtttgaggtatttcctctttcrtgaattgctttttcaaagcctttgcccacctttctattgcttatcattttttaaatgatttgtagattacaaatcctttgtatgaaatgttacaaatattttgtcataaccagtcacttgtttttaaaaagtttttacaaagatagttgtatcttttgtcttatctgtttcgttcaacattcactgagcacattaagtgccagccactagtgagacatcagaggactaaagagacaaaatgcctgccctcgtggcgtctccactctaacgagatgggaaaggtggggaaacaagtaagta

SEQ ID NO: 171150 - DNA, 601 bp, Human
aaaacactttgttttgtagaggcaattaatataaacccaacgtgtcaccttttggtttagtatgtcaaaatcacagttgtaagtcccagcctgcaccatttcaaaacctatgtttaatgattcccaaacagcatttctatcttctggtatcaggtctgattcacagccagtgatcccaacttgtaagagggcaggtcacttctattttctccctactgtcaaatggtatagcgtttctctggaatagacacccaaaggcagaaaagctggtcatgaggcctgagtacttaaagctttcacrgatgctgccaaagtgcttgccacgtccctgatgggaccaaacttaacttctgccagtcagacagtgggaaacggtttctcgttgttgttggtcatttgcactgacctgattactgatgatgctgattatcttttcgtaagtttgaggtatttcctctttcatgaattgctttttcaaagcctttgcccacctttctattgcttatcattttttaaatgatttgtagattacaaatcctttgtatgaaatgttacaaatattttgtcataaccagtcacttgtttttaaaaagtttttaca

SEQ ID NO: 171151 - DNA, 601 bp, Human
atgtaaacagctgttatgctatattgtttaaagaaaatgaaaagaaaaaagtctgtatgtattcagtacaggtgtgacctttttttattttccaaatattttccatccacaataggttaaatccatggatggggagcccatggaaagccgactacattttcttaaaatggaatcattaaaatccctggtcccctcacaatgagataatagcccatttcccaagagcatgactaagagatcgtaatcattacagcatgttatgaggtcacaggctaaaagcagaaagcagatattagaggcaaaaaaaaaaaaaaaatccaagggccaaactcccaatctaagttcagtttcatctccattatgatttctaatatgctgcacccaaagattcttgcctgcacagtcctatcatgttcatgacacatattcattgttgaagattagaaaatagtaacaaggaaaaaaaacaccttaatcctatcaccaagagatagccattggtgacattttggtagacattttccagacttttgttataagtattatatatattctctctctcttctatagatacacacacacacacacacacacacacacg

SEQ ID NO: 171152 - DNA, 601 bp, Human
ctgtggggtctgactgggaggggccggggatacctgtgaagctgtccagccactagggcagctcagagctgcttcctgaacagacaggcaatggctggctgcacgcctgggccaatcaacctccagcctccaaagaagcggcactcccagtcagtgccaccacccagttcctgaagtcgagctcaagcaccttccgagtgtgttaaccatctgcttccctgaaagcaatcttacactggagtcaaactagtttagtagccacacttctagtcttttctcaaactcaaccaaagtcatagcyaggactcactgctgtttttctcttcactttcaagtacagttgtcccttggtatccaagggggactggtgccaggaactccgatggacaccaaaacccacggatgcttgagtccttaattatttgcacataagctacacaaatccactcatatactttaaatcatctctagattacttctaataccaaatacaatgtaactgctatgtaaacagctgttatgctatattgtttaaagaaaatgaaaagaaaaaagtctgtatgtattcagtacaggtgtgacctttttttattttccaaat

SEQ ID NO: 171153 - DNA, 601 bp, Human
ttactgggagccaagttttcctgtggggtctgactgggaggggccggggatacctgtgaagctgtccagccactagggcagctcagagctgcttcctgaacagacaggcaatggctggctgcacgcctgggccaatcaacctccagcctccaaagaagcggcactcccagtcagtgccaccacccagttcctgaagtcgagctcaagcaccttccgagtgtgttaaccatctgcttccctgaaagcaatcttacactggagtcaaactagtttagtagccacacttctagtcttttctcaractcaaccaaagtcatagccaggactcactgctgtttttctcttcactttcaagtacagttgtcccttggtatccaagggggactggtgccaggaactccgatggacaccaaaacccacggatgcttgagtccttaattatttgcacataagctacacaaatccactcatatactttaaatcatctctagattacttctaataccaaatacaatgtaactgctatgtaaacagctgttatgctatattgtttaaagaaaatgaaaagaaaaaagtctgtatgtattcagtacaggtgtga

SEQ ID NO: 171154 - DNA, 601 bp, Human
ttagaaggcacagcttgtcatcccattactcatagctccactgtttacagtacaggtgtggagcagataaaggaagttctacagaccctgccctcccaggcttcaaacagtcctcacctaacaaccaaagggagaagaccacatcgtcttttcccttagacacattttatttaacaaaacaagtactatttatcccaaatctcactggttctttcaatccgatctctaatgtctttactttttagtatcagattctttctggatatttgtggaattcccagaagttctgaccaactgttaytttgatacaggaagtagacacaatcaccaagtatgaagtggaatctaccaagaaacacccaaggcggaactctaacgaaagcaaagattggaggagaacttctttggtttaaaaacactgagttaccttaatatctctctctcttctcgctctttctctctctctcctctctctcactctctgacacacacacacatacacacacacacacccgagagagcctcagcttcctaaccactaagagactatgcagtctttctcctgaaaacagtaagataaaaaccagagtctaggttggtc

SEQ ID NO: 171155 - DNA, 601 bp, Human
aagtatcgttatggacacctgtgcatgcttccctcccagcgtcccccacgcgtgctgcagctttcagtgtcgcccgtggacactgtccaggatcatttgcacttagaggtggggctttcaaatgtgctttatagtgaaccagagtgggaaaagcctaaagaggacacccaagttttattacaactttcacaaaatccacttgaaacatagccagatatttattccaaacttaaaaatatcacacattaccagctacaacccagtacgcattttactattttgtcttgcagcattacaacaycaccatctgataaggtgccacaataaaatacaataaaacacacacacatccacaaacacaactcctgtgttgacccagggctttaagacacagctcttcagcagaatctcttgggatttagaaggcacagcttgtcatcccattactcatagctccactgtttacagtacaggtgtggagcagataaaggaagttctacagaccctgccctcccaggcttcaaacagtcctcacctaacaaccaaagggagaagaccacatcgtcttttcccttagacacattttatttaacaaaacaag

SEQ ID NO: 171156 - DNA, 601 bp, Human
ggacctgccagaggaaactccatttgtccccctccttttacacctacctaaatgccactctgtctctcacggcaatgtctaagggcatctattttagcagtggtttaaagggcaacactgccttcagtcccaggtgacaacacaaggaaataccatgggagggggtaagggaagcgaagaagcaccagttctttaaggttacttggtcaaagcaaagctgttcagtaattctacctctaagctcccggcccctaacctcatgccccacccccatcactcccactgttgattagggtagttyatgttgacttttgaagcctccaggataaaaagtgactattacacagcacctccggtgggtctgaagctaggctcacccggaaggaccagaagcaagtaagcgtgagggaccatggccaggcccggctcactcctgctgtcccagcatagtcactagtgtcctcttccactctcaaaagtgttccctttggaactagatcttggctagtgtggactcacctttcagttagaaaagcaccaagcaggcagttcagccctggcctggcacgtcccctcactactgacccctcttcagatacag

SEQ ID NO: 171157 - DNA, 601 bp, Human
tactcacagaattccaggcgatgccaagaggcttcagaggggccaacctgtgagccagaacttgaaggaccaacggattccccagatggacaagaacagaatggtgtataccaagcaagataaagtgtatggaagtgacagaggccagcaacaatgggcacaccacagggcaaggcccaggacacagcagggctgaactggcaccctgaagggggcttagtgtctgcctgtgaagggcctcaggtcccacaccaaagattttggaatctatcccaaagagatgccaaagagagagttcaawggcaaatcaaggccgggcacagtggttcacgcctgtaatcccagcactttgggaggccaaggtgggtggatcacatgaggtcaggagttcaacacaagcctggccaacatggtgaaacctcgtctctgcaaaaaatacaaaaattagccgggtgtggtggcatgcacctgcagtcccagctactcaggaggctgaggcaggagaatcgcttgaacccaggaggcagaggttgcagtgagccaagattgcactccagcctcggcaacagagcgagactctgtctcaaaaaaaaaaaggcaa

SEQ ID NO: 171158 - DNA, 601 bp, Human
acactaccaatagagcccaattcacattccggtcaccggctgcatcctcagctcttttttttttctcttactgaaatacacagattcacttcagctcagcgtttactgagcatctgccataggcgcagcctgtgcttggagctgggatttaaacagctccagtccctggcctgcacagaaagtgaaggccagtggggacaggcatgtaagcccgtagcagcagcacacccggccacagcggccaagtgcagcaagtactcacagaattccaggcgatgccaagaggcttcagaggggccarcctgtgagccagaacttgaaggaccaacggattccccagatggacaagaacagaatggtgtataccaagcaagataaagtgtatggaagtgacagaggccagcaacaatgggcacaccacagggcaaggcccaggacacagcagggctgaactggcaccctgaagggggcttagtgtctgcctgtgaagggcctcaggtcccacaccaaagattttggaatctatcccaaagagatgccaaagagagagttcaaaggcaaatcaaggccgggcacagtggttcacgcctgtaatcccagc

SEQ ID NO: 171159 - DNA, 601 bp, Human
aatgagtacaaataatctacctcgggtacactaccaatagagcccaattcacattccggtcaccggctgcatcctcagctcttttttttttctcttactgaaatacacagattcacttcagctcagcgtttactgagcatctgccataggcgcagcctgtgcttggagctgggatttaaacagctccagtccctggcctgcacagaaagtgaaggccagtggggacaggcatgtaagcccgtagcagcagcacacccggccacagcggccaagtgcagcaagtactcacagaattccaggmgatgccaagaggcttcagaggggccaacctgtgagccagaacttgaaggaccaacggattccccagatggacaagaacagaatggtgtataccaagcaagataaagtgtatggaagtgacagaggccagcaacaatgggcacaccacagggcaaggcccaggacacagcagggctgaactggcaccctgaagggggcttagtgtctgcctgtgaagggcctcaggtcccacaccaaagattttggaatctatcccaaagagatgccaaagagagagttcaaaggcaaatcaaggccgggc

SEQ ID NO: 171160 - DNA, 601 bp, Human
taaaattcaaaccagagtgaatcctcttcaaaacttgtcacagcagatggtgatacaggtttcttgctatgatgtgtgctttgtacaatgccaaacatgctcctgcttaaaaataaagatgtaaccatttctgattctgcaaaatacaaaatccataaggaagggagtgagaaatatctagggggatatgaattgatagttacagcacctcaggtcttcctgcaaacaccacaacctgagcaacttgtccaactagagactaccacaatcacatggcacgcattaaaacatgggataaccmccgggcgcggtggctcccgcctgtaatcccagcactgtgggaggccaagacaggtagatcacgaggtcaagagatagaggccatcctggccaacatggtgaaaccctgtctctactaaaaatacaaaaattagccgggcgtggtggtacgttcctgtagtcccagctactcgggagcctgaggcaggagaatcacttgaacccgggaggcagaagttgcagtgagccaagatcacgcccagcctggcaacagagtgagactccatctcaaaaaaaaaaaaaaaaaaaaaaaaaaaaagga

SEQ ID NO: 171161 - DNA, 601 bp, Human
tagtctggcaggaatcagaatgccagatgagacgaaatactgtcaggggagtgggctacacaggcagtctcccgtgctgctgggagagtgtaaactggtacaaccttttggcactagcaaaacataaagagcacacaccttttgatttgatttgaatcaaacttatgaatttgattcttaaattccacttaagagtggatatgctccccaaattccaaaaattttaaactacctaaaaactacttggtaatttaaaagaatgaggtgatttgtaaatgctaacatgaaaagatctctaagtcacatctggtgaaacaggatggcacagaataccttctcacaagtaacacctacgcttgctaaacacacagggagcttctgagaaggacacacttgaaactgctagcaggaatcacctttcaaagcaaggactgtggaaagagagtgggggaggcctggactcttcctcttctgcctatctgtatatctggatccacaactaacacaaaatttgatgttgaagtttttattcaaagaaaatacagaaatgcccccagccacttatatttgctcagactggcccaatatttctattatagaa

SEQ ID NO: 171162 - DNA, 601 bp, Human
agaaagaaaagggactggaagctttgcgtagtcttcactgcaccgcggtctgcactcctgttcagaagcggtagcaaagaaataagtggttttttgccctactccaactcacaccttcaactaccatccttatccagcactaattccccaaaccactactgacttcccatcctctttccagttctctctctcaggctcaaggacaggtgcaaccagaaagtgaccctctgacaagcgtgcaagggcaatgtgcatcaatcattttatttctaaagcggaaaatgaggcacaaggaatacaytcaaatctcgcagtttcatcagcatcccaaacccacgaattcacaatgctgctcaaaggtcctctctgcccatgaggcgtccccaaaccccaaatcacctgggccacaggctccaagcaccacagacatgataagcataaagcttttaggcgagtcagcattctcaatctcccctccttctgtgtcccatgaaaacagaggcctggggttttttttacttttttctttaaattctattccactccttacacttaaaaatgcctcattattctttagtaaatgctaggagcataaaatctt

SEQ ID NO: 171163 - DNA, 601 bp, Human
ttgaaagagcccagcaggtgagttctgacccgtgactctctacagaagactcagtcatcatgtgcaaggctcactatgactctctctttaacatggccagcttccactacgccgacagagtggatcacagccggggtttacctgtggtgtgtgaacctaggcaaaggctttagcttgacccaggccagagactgcaggtggcaaaaacctgcactttcagttaattctaggcacagacaacatgagaaaaggatgtcagtggacaaagaagttacaagaaaagctgcaaccaagaagtctrcagtgtggccctcctcatatctgaacaaaacagatgccacaatatataccacacaatcaagcttatgaaaccacatccatcagagagaatcacaggaaacgactggccacagaataggaatctcaggaccaacagaaaacatgaacgttttaaaaaataatttctcagactcataattcaacagtctttttttttttttttttttgagacggtgtcttgctctgtcacccaggctggagtgcagtggcgcgatctcggctcactgcaagctctgtctcccaggttcacgccattctcctg

SEQ ID NO: 171164 - DNA, 601 bp, Human
gtctttcaagaaacagccatagtgtgaacaattttcttttagtgtcaagagagtagtacttatttaaaagaatcatactaagtccatgaaaaacaaattctaaaattctacattctacaaaatgtatattgagagtcccagtgcaacacgtccctgggcccctgtcttcctccttctcactgtctagtaagccatcccacctctcctcccagtccaaggaagattccactttcccgggatccaccagagtactcagttacatctctttgcttctttcttcttgttcagaagctcatcctcrccatccgccatccgtcgagtcttacctcctacagggagaactcagattcctccagccatgctccctgctcagtttacccatattaaccatcacctgatgaccttctttatcacttggtaaataaccaggtgataaattacgtgatacaaacaaactcagtgaagacagcctggactatccacgctggttatctaccaccatgtttcccagggatttcatgtgagattaagctcttgcttttcagtaatatcttgtactgtaaatattctcatagcacttttcatagtcctaagggctgtc

SEQ ID NO: 171165 - DNA, 601 bp, Human
ttcttcagtctgggcattactggcacagggagcaggtcactctttgtggtgggggcttccctgtgccttgcagggtgcttagctgcgtccctggcctctacccactaggtgccagcagcatccccatcccaattccccacaaccaggtttgacaaccaaaaatgtctccaggcattgctgaatgtcccctgcgggacaaaactgtcctggttaagaaccattgctctagataaacaatggaagagggggtggaaatcctaaaaacactcccataccctccctcctttccagtctcctgcckttaggaaatcagtcatggaaggcacccgcccctctgcaagccctgcctccactgccatgccatgggggttgggctggctggggaatgcaaacagacgtcctcatcaccaggcagtgccaccaggcctgacccaaataccctggctctgcgttgtatcttgtctttcaagaaacagccatagtgtgaacaattttcttttagtgtcaagagagtagtacttatttaaaagaatcatactaagtccatgaaaaacaaattctaaaattctacattctacaaaatgtatattgagagtcccag

SEQ ID NO: 171166 - DNA, 601 bp, Human
acagcttttgactaagaagggaggagatattttttaaacaattctaaaataaccaaggagagaaagtaaaagggaaatcaccgtgctagagcagggttcttcagtctgggcattactggcacagggagcaggtcactctttgtggtgggggcttccctgtgccttgcagggtgcttagctgcgtccctggcctctacccactaggtgccagcagcatccccatcccaattccccacaaccaggtttgacaaccaaaaatgtctccaggcattgctgaatgtcccctgcgggacaaaactgycctggttaagaaccattgctctagataaacaatggaagagggggtggaaatcctaaaaacactcccataccctccctcctttccagtctcctgccgttaggaaatcagtcatggaaggcacccgcccctctgcaagccctgcctccactgccatgccatgggggttgggctggctggggaatgcaaacagacgtcctcatcaccaggcagtgccaccaggcctgacccaaataccctggctctgcgttgtatcttgtctttcaagaaacagccatagtgtgaacaattttcttttagtgt

SEQ ID NO: 171167 - DNA, 601 bp, Human
gccaaaacagcttgctcgcccctcctcccaagggggcaggctcctgtcccctgggtgaagctgccactccccgtgcctgccagctgcaaccactgtcagcttgcacagctgggccacgacaccccttccgtgtccaaaagagaggcttggtggcttggaagtcaattctctctcactttaccctcagtggctcagatctgtttgtttgctagccctttgtaatgctctgaatttttctgtacattgaaatattctccctcagtctgacagctggaaaggacccctagcattaaatgcgacrtacaattccaactccttttctatgtgtattgatggaaagaggactactcgtgcccaggaaaggttcccaagtccttaccgagtaaaacagaaactccacgggtggcaggcctagaggggagatcaccctgaatctgtcccgctgttttctgcccccctatttcaaacctcacggaagctggaccaaggaaattgactactggcatgttcctaagtctcaggcttagaagaaacgacactgaatgcctggatacctatccaaaagtgtagtggaaaaaccttcagaggagagcatagaatg

SEQ ID NO: 171168 - DNA, 601 bp, Human
tagaaaaataaagttaacatccgctttcaataaaagctaaaaactagaaaacaaccattttaagaaccttaactttttctaaaagctcacagtgacaacacctgatatagctgacatagctggggtttcccagcagcttctttctagcactccactgctgtttcgaaaggatcccagggactgggcgcagagctccacagggaagaaccattttctagccctagcctccttgagccaagtggcctgctccttcactcccagggaaagcctggagttccctcttcctccaaacaagccaaawcagcttgctcgcccctcctcccaagggggcaggctcctgtcccctgggtgaagctgccactccccgtgcctgccagctgcaaccactgtcagcttgcacagctgggccacgacaccccttccgtgtccaaaagagaggcttggtggcttggaagtcaattctctctcactttaccctcagtggctcagatctgtttgtttgctagccctttgtaatgctctgaatttttctgtacattgaaatattctccctcagtctgacagctggaaaggacccctagcattaaatgcgacgtacaat

SEQ ID NO: 171169 - DNA, 601 bp, Human
ttaaatttcttccatgcaaaaactacccagtttccccactaacagtaaatctattaaaggcttttattactgcattctgcattttcagggaagacttcggtcctcttctcagtgttggagccgtctcatctgacagctcctcacgttcacaggcgatgctgcctgggctttcactcactactttgtgacctggagcaaacaatcacctcttccagcctcagtttcctcacttatgtaatgaggatgtcacccagcccttctcaactatcttataaaaggaaggtattggctgggcgcagtrgctcacgcctgtaatcccagcactttggaaggccgaggctcgtggatcacttgaggtaaggagttcgagaccagcctgaccaacacggtgaaaaaccccatctctaccaaaaatatacaaaattagccaggcatgatagcaggtatctgtaatcccagctacttgggaggctgaggcaggagaatcgcttgaacctgggaggcggagggtgcagcgagccgagatcgcgccattgcactccagcctgggcaacaagagcaaaactccatctcacaaaacaaaaaagtaaggtatcaaaaa

SEQ ID NO: 171170 - DNA, 601 bp, Human
cactaccctatgggtgtaagtcactttgtctcccagaaaatcccagtgacttataatttgaaaaacttcaaaatactggaaacaactcaggctttggagacataccaatgttcaacaaactgctaatctctctgggcctcagttttgtccagctgtaaaatggcactgcagttattagcactgttgtgaggaatgcgtgatggaaaagataaagctgtgagcacaaataggtgcccaacaaatgccaaatgtctttcctttatctgcatacccaattcatcttcctcttttgcttctttcyaacaatgtcatcattgacgcattcagcctgcatttactgcttgcctactaggtggaaggcagcgggggtacaacactgaagagacagatctggttccttccggcaggagcagcagtccctggaagcatccactgagaaggtgatgacttcaggtgtgcatgttaacgagggatcatgcacaaggctgtatgaatccacagcatgggtgcctcacccaacttctgggacggatccggggactgccactctacagggagtggtcttgggtcctaagcctagcttggggccacactcaccagc

SEQ ID NO: 171171 - DNA, 601 bp, Human
agctgaaatgggttccagccagtggcatacaaaggaggactgtcttaaagggacagagccctctttccaagccagaggacgatacatgagcacacggcgggctctagtctaaaatcctgcaacccgcgctccaccggccacaggcagatgcccggggatatgccataaagttccacggaaaacgcagctctctgacagcaggttctgcttggcagacacatagcagctgccaggaccacactgtcctaaatccccgtgggtaccgtcaaatgaacgtgtccaaggcatgctttaggaccargatgtctctttgaggtcatccagctggcaccagacccctctgcctagctttcaaatacatcacttgccttatttttttccactataatgattaaccagcatccttcttacagcctctgcctttcaatggataaaaaggtccatatttaaaccaacaatgcggggaaacattttataaagtaattaaggagtgagccctcatttgcggagaaggtaaatatacaaaaggtaactaccttagtcagagttgctcccaggccaaggaggtcattgccatttccttttcatcccctccagctgg

SEQ ID NO: 171172 - DNA, 601 bp, Human
cagcaggttgtccctgccggcagcctgagcacaatggagacaaaccagagggggagccgccctgacacaccacccggtcgctcgccctcctcgcccattgccagaggggcacccggaatccatgcccacaaaggttaatctgcaaggtgtccggctggcagtcagggggacggtccagcatcagccccatcaccattcctttccagggttccaatttaatgaagaggattaaagtgacaaaaacaacaaggcgctattgtgcttggctgtgaataggaaagccacacaagggaagctttcrtttatttatttatttaaatgttgctttgcagattttaacagtcggcagaaacccagagctgaaatgggttccagccagtggcatacaaaggaggactgtcttaaagggacagagccctctttccaagccagaggacgatacatgagcacacggcgggctctagtctaaaatcctgcaacccgcgctccaccggccacaggcagatgcccggggatatgccataaagttccacggaaaacgcagctctctgacagcaggttctgcttggcagacacatagcagctgccaggaccacactgt

SEQ ID NO: 171173 - DNA, 601 bp, Human
agcccgggagtttctgggaaagcaccgtccgcaccctgggaaacccgtctattcatgccgcttctctcctgtgtagccattagggttaaactgcaaaagaacggctcagatgggccagatggcagcacaacaaacagctcctccctcccccactgccacgtgctgcagccatgcttatgtgccagggaggcggtgtgccagggaggcggctgaaccccttgctctttaaaagaatggccactggggagggcagcaggttgtccctgccggcagcctgagcacaatggagacaaaccagagkgggagccgccctgacacaccacccggtcgctcgccctcctcgcccattgccagaggggcacccggaatccatgcccacaaaggttaatctgcaaggtgtccggctggcagtcagggggacggtccagcatcagccccatcaccattcctttccagggttccaatttaatgaagaggattaaagtgacaaaaacaacaaggcgctattgtgcttggctgtgaataggaaagccacacaagggaagctttcatttatttatttatttaaatgttgctttgcagattttaacagtcggcagaa

SEQ ID NO: 171174 - DNA, 601 bp, Human
acccatgtctacctcacagcccgggagtttctgggaaagcaccgtccgcaccctgggaaacccgtctattcatgccgcttctctcctgtgtagccattagggttaaactgcaaaagaacggctcagatgggccagatggcagcacaacaaacagctcctccctcccccactgccacgtgctgcagccatgcttatgtgccagggaggcggtgtgccagggaggcggctgaaccccttgctctttaaaagaatggccactggggagggcagcaggttgtccctgccggcagcctgagcacartggagacaaaccagagggggagccgccctgacacaccacccggtcgctcgccctcctcgcccattgccagaggggcacccggaatccatgcccacaaaggttaatctgcaaggtgtccggctggcagtcagggggacggtccagcatcagccccatcaccattcctttccagggttccaatttaatgaagaggattaaagtgacaaaaacaacaaggcgctattgtgcttggctgtgaataggaaagccacacaagggaagctttcatttatttatttatttaaatgttgctttgcagat

SEQ ID NO: 171175 - DNA, 601 bp, Human
ctcagtcaagtaggagggtaaaacagactcatttcagatacataaggatcagaaagtttgtcttctgtgcaccccttctgaagaagctacttcaggagcaagatgtggatcaaggaacgggactgactcaggagcctgaggacagcaagcgccatcaactgtgatggccaacagccaccagaccgggtcagagcaggaagccaaagggctgccagaggaatgccatcagaaagaatgaaatcagactcgaaaccagagaatgaaggagaaagcagctgagaaaactgtgtgataccaacargcatcattcggtttcctctcaagagaataaaaaggactgggcaacaggaaaaactcaactacaggaaatcacagaagaaatgaaacatgccccccgagtggtgtcctctgggccatcagggacgccaggaacagctccctttgagtgggcacctggctctacggtgagtggtatctacattcctgtcatggtgctggtcgctggtagttaacttacagaatcaccctgtagacaaagcatgaaagaccaacccaggctggagaagcaaagctatctgttaccaaggtgaaggaagagctg

SEQ ID NO: 171176 - DNA, 601 bp, Human
gaatacggccttgcaaattaaacatacttttgtcccccacatcaaaaaagtcaacgaaggattaaaagataaagttggggcattcctgtagaacaaagaggtttgaaaatataagcaaacctggaaatataagcaaaaaaataaactcggttgaataaaaatatttttaaatcccacagagaaattctcataggaaaaattcagaagttccaggaataaagacgatcctaaaacctccacagaggttaaggagagtgattaatcagaccacccacgagggaagatctcgctggtgtcagtrtaagagcccgcacactaaagatagcgcagtggaactttcaaaattctaaatgaaaattatctgaaccccaaattctcagtcaagtaggagggtaaaacagactcatttcagatacataaggatcagaaagtttgtcttctgtgcaccccttctgaagaagctacttcaggagcaagatgtggatcaaggaacgggactgactcaggagcctgaggacagcaagcgccatcaactgtgatggccaacagccaccagaccgggtcagagcaggaagccaaagggctgccagaggaatgccat

SEQ ID NO: 171177 - DNA, 601 bp, Human
aacagaaaactcaccctagagcaaacagagataattagggggaaaaaagaaagaaaaaaaaaacctttaaaagaacagaaaactctggaaaagggacaattacagaaaaagaatacggccttgcaaattaaacatacttttgtcccccacatcaaaaaagtcaacgaaggattaaaagataaagttggggcattcctgtagaacaaagaggtttgaaaatataagcaaacctggaaatataagcaaaaaaataaactcggttgaataaaaatatttttaaatcccacagagaaattctcayaggaaaaattcagaagttccaggaataaagacgatcctaaaacctccacagaggttaaggagagtgattaatcagaccacccacgagggaagatctcgctggtgtcagtataagagcccgcacactaaagatagcgcagtggaactttcaaaattctaaatgaaaattatctgaaccccaaattctcagtcaagtaggagggtaaaacagactcatttcagatacataaggatcagaaagtttgtcttctgtgcaccccttctgaagaagctacttcaggagcaagatgtggatcaagga

SEQ ID NO: 171178 - DNA, 601 bp, Human
ctgagcactcaaccattctgggtttaatattcacacatgacaatttttctggatggacacaatctagcttctgtattataaattcaaaatgcccttctagtcctctatcttccaagatattattttttaaatagtaaaggaataggccaggcgcggtggtccacgcctgtaatcctagcactttgggaggctgagaagggtggatcacgtgaggccaggagttcaagacccgtttgaccaacaaggtgaaaccccgtctctactaaaaatacaaaaattagctgggcgtagcggtgcacacctgtaatcccagctacttgggaggctgagacaagagaatcgcttgaaccccagaggtggaggttgcagtgagccaagatggcaacgttgcactccagcctgggcaacagagcaggcctccatctcaaaaaaatttaaaaatttaaaaaaaatagtaaaggaacaaaaacatccataaacctacaatatcaaagagtacacagagaagggccatcagaagagatttcaacaaatttccagaacagagaaaggaaagaaacagtgctaagtgctaatatcttctagaataaaaactccacaa

SEQ ID NO: 171179 - DNA, 601 bp, Human
tataccctgagaagccaacttgtatcattctaaactggaaactctaaatcgttgctttcttttcagaatctgagcactcaaccattctgggtttaatattcacacatgacaatttttctggatggacacaatctagcttctgtattataaattcaaaatgcccttctagtcctctatcttccaagatattattttttaaatagtaaaggaataggccaggcgcggtggtccacgcctgtaatcctagcactttgggaggctgagaagggtggatcacgtgaggccaggagttcaagacccrtttgaccaacaaggtgaaaccccgtctctactaaaaatacaaaaattagctgggcgtagcggtgcacacctgtaatcccagctacttgggaggctgagacaagagaatcgcttgaaccccagaggtggaggttgcagtgagccaagatggcaacgttgcactccagcctgggcaacagagcaggcctccatctcaaaaaaatttaaaaatttaaaaaaaatagtaaaggaacaaaaacatccataaacctacaatatcaaagagtacacagagaagggccatcagaagagatttcaacaa

SEQ ID NO: 171180 - DNA, 601 bp, Human
acacacctgctctccagtcccattcctgtgtcaagacccaggactccagctcagcaatccatcagcattatgtggattctaaccctgcacccccgccaaacccaccaccccaaatgtttcttcccaggctgaacagttctcccaacattaaaaaatatatatatatatattaaaatggctgcttcaggaaaaagtcagacaaataagtgagctctggttaaagcaaaagccgttttgaaaaacaacatcaactctactgatgcgtacaccgttctacagaaacgcatgtttaaagcagttyactctgatttttctgtgcttcacagcccagaaaaatttctagtccaagtagaagacccctttaagaaattaatttcttcaggttctagaagatacatattcattccaatataacatggttttgaaattaaggcaacattcattttttaaaaacagctgctccgcaagaggctcaataattgggatttgattttgaagctacagaactggcttaatcagatcatcaatgtatctctacccagcagaagcaagactaaatccaaggtccatataatgaagctgatgaaaaacagagcaatcg

SEQ ID NO: 171181 - DNA, 601 bp, Human
tgtaatcccagcactttgagaggccggggcgggcagatcacgaggtcaggagaccgagaccatcctggctaacatggtgaaaccccgtcactactaaaaatacaaaaaattagctgggcgtggtggcaggtgcctgtagtcccagctactcgggaggctgaggcaggagaatggcgtaaacccgggaggtggaggttgcagtgagccgagatcccgccattgccctccagcctgggagacagtacaagactccatctcaaataaataaataaataaataaataaataaataaataaataatatatatatatacacacacacacacacacacacaccagactttctataaaaacaaaggaaaatgactttttaataatattttatattgattgcacattgatataacttaatgaaatgtattattttaattgatctcaaaggaactagtatgaaataaaagtgcatctatggctcatattatatttctagacagcatagagttggaattaacatctctgcttgagagcacagttaggatacacatactttccttctgcccatggcattaaaacttaatctactacattcacagagcagttac

SEQ ID NO: 171182 - DNA, 601 bp, Human
cctgtaatcccagcactttgagaggccggggcgggcagatcacgaggtcaggagaccgagaccatcctggctaacatggtgaaaccccgtcactactaaaaatacaaaaaattagctgggcgtggtggcaggtgcctgtagtcccagctactcgggaggctgaggcaggagaatggcgtaaacccgggaggtggaggttgcagtgagccgagatcccgccattgccctccagcctgggagacagtacaagactccatctcaaataaataaataaataaataaataaataaataaataaataatatatatatatacacacacacacacacacacacaccagactttctataaaaacaaaggaaaatgactttttaataatattttatattgattgcacattgatataacttaatgaaatgtattattttaattgatctcaaaggaactagtatgaaataaaagtgcatctatggctcatattatatttctagacagcatagagttggaattaacatctctgcttgagagcacagttaggatacacatactttccttctgcccatggcattaaaacttaatctactacattcacagagcagtt

SEQ ID NO: 171183 - DNA, 601 bp, Human
ggtaggggtggtttgagggtccttctatccttcagtgggtgcctatgtgagcctgagctgcactgtacaatatggcggccaggagccccacgtgacattaaccacttgaaatgtcaccacccagtttgagatgtgctgtaggtaaaaaatatacaccgaggccgggcacagtggctcatgcctgtaatcccagcactttgagaggccggggcgggcagatcacgaggtcaggagaccgagaccatcctggctaacatggtgaaaccccgtcactactaaaaatacaaaaaattagctgggygtggtggcaggtgcctgtagtcccagctactcgggaggctgaggcaggagaatggcgtaaacccgggaggtggaggttgcagtgagccgagatcccgccattgccctccagcctgggagacagtacaagactccatctcaaataaataaataaataaataaataaataaataaataaataatatatatatatacacacacacacacacacacacaccagactttctataaaaacaaaggaaaatgactttttaataatattttatattgattgcacattgatataacttaatgaaatgta

SEQ ID NO: 171184 - DNA, 601 bp, Human; identical to SEQ ID NO: 31209

SEQ ID NO: 171185 - DNA, 601 bp, Human; identical to SEQ ID NO: 31208

SEQ ID NO: 171186 - DNA, 601 bp, Human; identical to SEQ ID NO: 31207

SEQ ID NO: 171187 - DNA, 601 bp, Human; identical to SEQ ID NO: 31206

SEQ ID NO: 171188 - DNA, 601 bp, Human; identical to SEQ ID NO: 31205

SEQ ID NO: 171189 - DNA, 601 bp, Human; identical to SEQ ID NO: 31204

SEQ ID NO: 171190 - DNA, 601 bp, Human; identical to SEQ ID NO: 31203

SEQ ID NO: 171191 - DNA, 601 bp, Human; identical to SEQ ID NO: 31202

SEQ ID NO: 171192 - DNA, 601 bp, Human; identical to SEQ ID NO: 31201

SEQ ID NO: 171193 - DNA, 601 bp, Human; identical to SEQ ID NO: 31200

SEQ ID NO: 171194 - DNA, 601 bp, Human; identical to SEQ ID NO: 31199

SEQ ID NO: 171195 - DNA, 601 bp, Human; identical to SEQ ID NO: 31198

SEQ ID NO: 171196 - DNA, 601 bp, Human; identical to SEQ ID NO: 31197

SEQ ID NO: 171197 - DNA, 601 bp, Human; identical to SEQ ID NO: 31196

SEQ ID NO: 171198 - DNA, 601 bp, Human; identical to SEQ ID NO: 31195

SEQ ID NO: 171199 - DNA, 601 bp, Human
atgaaaagactataacaacagaaaagcaaagccagtgcagaacttgcagggcatgagctgagcccctacaacatatgaaatcccggccagaattcccttcacagtgatttactatcctcagtcaccaaaccatcagaagcagcggctcttgcctgcagcctgatgggctacgaagtgcattccctgggtgagaagctgcatgtgcatgatgtccatggggatggagaacaacgctaagtgttagacacgacagaaacccatcttcacacctcacagcagaaaatgccaaggcgtgtacctstttcttggtcctaaataagtgactggtgaatatggtcaggatttcaatgttttacttaagccccattttgctctaaactgattttaaaagatacttctgagtcttaattttctcagtgggatcaatgacttttgctccatgaagatacacttggagaacaaaagcaaagcattctcaactcaacggccttgatttactttaagacaaaagttcgatgccatgggagtatgcccgctttgcccttacaatgaccaagaaaggtggcagaaatgaaaaagcaccccatcaccagtccggtga

SEQ ID NO: 171200 - DNA, 601 bp, Human
aagattctagaatctcgtagcattgctataggattgtccaggacttagaagtacaccacttagatgcttatgtatcattttgacccagaaaatagcgagacaaattcagacacgatgttaaagacatcgttagtgtaggtgtcttcagaaaaaaggcaaaatatagggcagaagggtgaacaaaacagaaaaaattgtaccaagatgttcacagtggtactttgggggtgaagcagaaagcagctttctttttattattttgcagatatttgaagtgtattactctcatatgaaaagactrtaacaacagaaaagcaaagccagtgcagaacttgcagggcatgagctgagcccctacaacatatgaaatcccggccagaattcccttcacagtgatttactatcctcagtcaccaaaccatcagaagcagcggctcttgcctgcagcctgatgggctacgaagtgcattccctgggtgagaagctgcatgtgcatgatgtccatggggatggagaacaacgctaagtgttagacacgacagaaacccatcttcacacctcacagcagaaaatgccaaggcgtgtacctgtttcttggtcc

SEQ ID NO: 171201 - DNA, 601 bp, Human
aaggcttgtcttttgatgcagggtgcttggtctccatgcggtgaggcagttttgaagctttcatggctttgttgggtagttggtcaccacatattctacaaagtgggcttggcgaatgtgatcacctgttgaaatgaacctagaatttgagtagaactcttggcattttctttacaatgcagctttatttttgttggcagtcttggcgtgttctgctgtctcatcaatgggtctctcccccttttcaaagaagctctccagtgacgtttggtttttactcattttggctagggttggtggrtgggcttaccaaaaccatggctgagacaagtacacagtgtgggaaagagatgtggatggcagtggtaaataaaataacgggcaggccatgcacggactgaaataagtgttggattctgacttaaagcctgccaccagatacagctgtacaattgaagtacatcagctcacttgccactataaagcctgccaccagaggcaggctaattgtcacttgccactcactgatagagttctgatgagtctgcaagcaactgatgtattattatggtctctgtggagtcaaacctctctgctaaca

SEQ ID NO: 171202 - DNA, 601 bp, Human
acagccagtcctggctttggcaatgcggttagacacgaagaatgatgctttcagcgcagacatatttgatgaagtggtggccttcaataattgcttctgttcttgatgtttacatttttttcttttgaaaactccaaaggcttgtcttttgatgcagggtgcttggtctccatgcggtgaggcagttttgaagctttcatggctttgttgggtagttggtcaccacatattctacaaagtgggcttggcgaatgtgatcacctgttgaaatgaacctagaatttgagtagaactcttggcrttttctttacaatgcagctttatttttgttggcagtcttggcgtgttctgctgtctcatcaatgggtctctcccccttttcaaagaagctctccagtgacgtttggtttttactcattttggctagggttggtgggtgggcttaccaaaaccatggctgagacaagtacacagtgtgggaaagagatgtggatggcagtggtaaataaaataacgggcaggccatgcacggactgaaataagtgttggattctgacttaaagcctgccaccagatacagctgtacaattgaagtacatca

SEQ ID NO: 171203 - DNA, 601 bp, Human
ttttcctgcaactagatagtcccatctggggctgatgggagacagtgacacccaacatgtgttgcttgtgtccagtctactctgtaatcactctttggctgctgtcactgcagaaaacactgcttcacaaagacaggatgttgggcgtggaagcaggctttcagtgcttttggggcaatctcaggatattctgcctcaactttaatccagaacatatggagatttgaagttgtctcaaacgtacttttaaggccactgtcatttgcgatctcaagcagttgatcttcttctagcattggcmaaggtgattcacctggcttattctcaaatgggtcacagatccattcctttccagttcaggttcttttgtggttgggaagtatcgctcaagctcttctgaaagctgaggcgctggggcaaagaaggccctggctccgtctctcacaatctctctaatgtttgaaacatgtcagaaatcccagtgttcactcatcacccctgtaattccagtttggctttgaaagcagccacttgatctgccgactgggacacacttgtcactctcccctgaagtgacagattgagtttgtgagtaggttta

SEQ ID NO: 171204 - DNA, 601 bp, Human
atataatgaaataattatacaactcaccatgatgtagaatcaatgggagccctgagcttgttttcctgcaactagatagtcccatctggggctgatgggagacagtgacacccaacatgtgttgcttgtgtccagtctactctgtaatcactctttggctgctgtcactgcagaaaacactgcttcacaaagacaggatgttgggcgtggaagcaggctttcagtgcttttggggcaatctcaggatattctgcctcaactttaatccagaacatatggagatttgaagttgtctcaaacrtacttttaaggccactgtcatttgcgatctcaagcagttgatcttcttctagcattggcaaaggtgattcacctggcttattctcaaatgggtcacagatccattcctttccagttcaggttcttttgtggttgggaagtatcgctcaagctcttctgaaagctgaggcgctggggcaaagaaggccctggctccgtctctcacaatctctctaatgtttgaaacatgtcagaaatcccagtgttcactcatcacccctgtaattccagtttggctttgaaagcagccacttgatctgcc

SEQ ID NO: 171205 - DNA, 601 bp, Human
agcatattttagtattagctctatatttaagtttatttagctattacttctatatgagtatatttagctattagttctatacttaagtatattttggtattagttccatacttaagtatattttcgtattctgaacttaagcatattttagtattagttgtatatttaagtattagttctgtatttaaatgaatagttcaatgctcactaccagtcttttacttcccagggcctttcttgtgattcattctcttacgtgctggatgttactgtcaagcaatttttttttcaagaaggttcyaaagtgccgcatttcacatgttttcttcaggagagtgcggccagctgtgctttacttaaacaataacgtggctggataaagggtcttgggtcattcttctcttcaaaactgtgcagaccttgatactttaatttctgggactaaaagctgctggagatgatctgctttttccaacagaacgaccagacacttggctccaagttcaatggtctaaggggccaggctttggagcgaccctttctgtaacagtttcctgaaatacggtgtcttctttgatttgcagattcagggctttttcct

SEQ ID NO: 171206 - DNA, 601 bp, Human
cgcatgtggtggcacgtgcctgtaatcccagctactcaggaggatgaggcaggagaatttcttgaatccgggaggcggaggttgcagtgagccactgcaagatcgtgccactggactccagcctgggtgacagagcaagactctgtctcaaaaaaaaaaaaaaaaaaaaaaggttttacttattcttttaaaaaatacaacatgcttccattttaacaatatttcttgactctgcattttaaaaagtacaaaatcttctaattcttcacattgttcctcctcccacctcctgatttttatgatttcacttttacattgtccaggtttataacattcatggtacgtcctgcagccacaatttctggttaattagtatttgttttatatttaagcatattttagtattagctctatatttaagtttatttagctattacttctatatgagtatatttagctattagttctatacttaagtatattttggtattagttccatacttaagtatattttcgtattctgaacttaagcatattttagtattagttgtatatttaagtattagttctgtatttaaatgaatagttcaatgctcactac

SEQ ID NO: 171207 - DNA, 601 bp, Human
aatactccaaatccaatcactcctaaattatcattgctgacattaggtgaagatattttgtgtgtgtgcagagagatggagaaaaacaggttttatgaaaatgggatatttcgagtggtattattttcataaaacacattctattttaattgtttagaatttaacagggggaaaaaaggaagcagaaactgaagaattgttgaacttcaaagtaaatgtttctttaccacaagagttcctgaaataaccttattcaagctaagacaaagaagtttatgaaaacattaagaggtctgaccargcatggtggctcacgcctgtaatcccagcactttgggaggctgaggcgggcagatcacgaggtcaggagtttgagaccagcctgaccaacatggtgaaaccccatctctactaaaaatacaaaaattagccgcatgtggtggcacgtgcctgtaatcccagctactcaggaggatgaggcaggagaatttcttgaatccgggaggcggaggttgcagtgagccactgcaagatcgtgccactggactccagcctgggtgacagagcaagactctgtctcaaaaaaaaaaaaaaaaaaaaa

SEQ ID NO: 171208 - DNA, 601 bp, Human
gaactaaatattgtagaaaagaatacaggtgaaaggtttaaaaatactccaaatccaatcactcctaaattatcattgctgacattaggtgaagatattttgtgtgtgtgcagagagatggagaaaaacaggttttatgaaaatgggatatttcgagtggtattattttcataaaacacattctattttaattgtttagaatttaacagggggaaaaaaggaagcagaaactgaagaattgttgaacttcaaagtaaatgtttctttaccacaagagttcctgaaataaccttattcaagytaagacaaagaagtttatgaaaacattaagaggtctgaccaggcatggtggctcacgcctgtaatcccagcactttgggaggctgaggcgggcagatcacgaggtcaggagtttgagaccagcctgaccaacatggtgaaaccccatctctactaaaaatacaaaaattagccgcatgtggtggcacgtgcctgtaatcccagctactcaggaggatgaggcaggagaatttcttgaatccgggaggcggaggttgcagtgagccactgcaagatcgtgccactggactccagcctgggt

SEQ ID NO: 171209 - DNA, 601 bp, Human
ctgggttaactgggttgaggcatcaccaggcgagcaggtgggtggtctaagagtaatcacactttggacctcaataagtatgtgacataatgtatactctttgactggtgaggcctgcggcatccaggttacatatgcatgatgcacattcttgatggaatatgattttaaaccaagatgatttacacccatgctcttcagcctgggagtggggaccaggttataagaagaccctcctggtcaccgggagaacccactggggattctggtatccttcctggccccccctctttcctgctcyatcctgcagagcgtggccctcctcgctcttctcagcacactcatcctgccacttgagaattggcttgagtgagccagcatcgcagacaggtgctcacgctatccctcagtgctggagtgaaagaagaatgagaaccactgatggaaacaactaaacgttaagctgctgggcagcaatgtaaaatcccaaatattaaaaaggcccctgcctagaactttcactggactctggcaggcctaataacaggcaggctgcacccctcagtgatgacttgtgtgtgcccaataaccactcccttcc

SEQ ID NO: 171210 - DNA, 601 bp, Human
gctgggttaactgggttgaggcatcaccaggcgagcaggtgggtggtctaagagtaatcacactttggacctcaataagtatgtgacataatgtatactctttgactggtgaggcctgcggcatccaggttacatatgcatgatgcacattcttgatggaatatgattttaaaccaagatgatttacacccatgctcttcagcctgggagtggggaccaggttataagaagaccctcctggtcaccgggagaacccactggggattctggtatccttcctggccccccctctttcctgctscatcctgcagagcgtggccctcctcgctcttctcagcacactcatcctgccacttgagaattggcttgagtgagccagcatcgcagacaggtgctcacgctatccctcagtgctggagtgaaagaagaatgagaaccactgatggaaacaactaaacgttaagctgctgggcagcaatgtaaaatcccaaatattaaaaaggcccctgcctagaactttcactggactctggcaggcctaataacaggcaggctgcacccctcagtgatgacttgtgtgtgcccaataaccactcccttc

SEQ ID NO: 171211 - DNA, 601 bp, Human
gagcgagcactcagacttctgcctgggtggtggggacaggccctcaggggcatgaggtgagggcaacagctggtctgtttcctaaacagttctcagccaattctgcttctggtttttaccctccccattctcacttctagggtttaattggtgcctgcaccttttgaggattccgctgggttaactgggttgaggcatcaccaggcgagcaggtgggtggtctaagagtaatcacactttggacctcaataagtatgtgacataatgtatactctttgactggtgaggcctgcggcatccrggttacatatgcatgatgcacattcttgatggaatatgattttaaaccaagatgatttacacccatgctcttcagcctgggagtggggaccaggttataagaagaccctcctggtcaccgggagaacccactggggattctggtatccttcctggccccccctctttcctgctccatcctgcagagcgtggccctcctcgctcttctcagcacactcatcctgccacttgagaattggcttgagtgagccagcatcgcagacaggtgctcacgctatccctcagtgctggagtgaaagaa

SEQ ID NO: 171212 - DNA, 601 bp, Human
cttgtttcgcagctgtgatgtcacctgagacggctgagtctcttcacagctggtggtggacccttcttcttcctggacccctccctctctctcatccaagttgctctttggctgttcggctgctttggtctctacctgctctcagccggcaggaattcctcaggtatctgggactccttggttgtcccatttgaagagtggaagactaagagctgactgggacctgaagcctgtgcactgtgaccatctacaagggccctctcactaggctgtctgctggggaatctgactaaataacctyacgcatctcttcttgggcagagaagtttcccactctgtctgcaagctacagacctggctacctgtggttctgagagctgagtgaggagaagctgggggtgggagaagtcctcagcattcgagaaggctgcatttaccccacactcctgtctggggaaaatgcccccaccttcaactgggcctagagtccctcatccagaaatgcttggtcagtctctcctgtgagcgagcactcagacttctgcctgggtggtggggacaggccctcaggggcatgaggtgagggcaacagctggtctgt

SEQ ID NO: 171213 - DNA, 601 bp, Human
actctgtctcaaaaaaaaaaaaaaaaaaccaaccagttctatgagttctctaaaagcgaaaaagagtctttcagccatttccccatcctggctagcaactatttccaacttcttcaagccaacctgcttggtctttacctctgtatctcacacatctccaaaataccatattagaactgccttttgactgcttgattttagatgttatctacagaagaggactgagctcctcttacccgggcatattcatattccccgtcctcctaaaataactatctggtcatctgaggtagggctatamacagtgtcttcattaacaccacgtttctcttccgacctgtgccatatagtgaacttcctaattttttccttcctgaaaagcttccttccccactggaaccaaaattatggagggtggagaagtgggttgttcctttgatttatatttctgtgaccttaccaccaaaaccaattgcaaatggttaacctcttatcaaaatctccttgctaatgctaatttgtatcaggcatcctattaattttcatttcttgaagtaatccttcctggagcctctgaaacctgttccagtctggactggtt

SEQ ID NO: 171214 - DNA, 601 bp, Human
tggatttccaaaggcaccttgactcctgtccagaacagagctgcacccgccaactagtcccatctcatctacagagggcacggcaccgcagacacttccagcacacgcctgacggcagtttcacagtcccctgatatccagccaacccatggccaagtcctagcactgttaaagtctttatatttggccaggagaatggtgtgaacccaggagacggagcctgcagtgggcccagatagcgccactgcactccagcctgggtgacagagcaagactctgtctcaaaaaaaaaaaaaaaaaaccaaccagttctatgagttctctaaaagcgaaaaagagtctttcagccatttccccatcctggctagcaactatttccaacttcttcaagccaacctgcttggtctttacctctgtatctcacacatctccaaaataccatattagaactgccttttgactgcttgattttagatgttatctacagaagaggactgagctcctcttacccgggcatattcatattccccgtcctcctaaaataactatctggtcatctgaggtagggctatacacagtgtcttcattaacaccacgtttc

SEQ ID NO: 171215 - DNA, 601 bp, Human
actccacctggatttccaaaggcaccttgactcctgtccagaacagagctgcacccgccaactagtcccatctcatctacagagggcacggcaccgcagacacttccagcacacgcctgacggcagtttcacagtcccctgatatccagccaacccatggccaagtcctagcactgttaaagtctttatatttggccaggagaatggtgtgaacccaggagacggagcctgcagtgggcccagatagcgccactgcactccagcctgggtgacagagcaagactctgtctcaaaaaaaaacaaaaaaaaccaaccagttctatgagttctctaaaagcgaaaaagagtctttcagccatttccccatcctggctagcaactatttccaacttcttcaagccaacctgcttggtctttacctctgtatctcacacatctccaaaataccatattagaactgccttttgactgcttgattttagatgttatctacagaagaggactgagctcctcttacccgggcatattcatattccccgtcctcctaaaataactatctggtcatctgaggtagggctatacacagtgtcttcattaacac

SEQ ID NO: 171216 - DNA, 601 bp, Human
tgaagcctcagttctggggcaacaactccaggaagcctttcctagtttcaccctagcgccccgatgcctgggactgcagctgtgggtctgaccattaaccactcactgcctctgtccatcgccccaccgccagacagtacaatcctcagagacactgccatcctgacaactccacctggatttccaaaggcaccttgactcctgtccagaacagagctgcacccgccaactagtcccatctcatctacagagggcacggcaccgcagacacttccagcacacgcctgacggcagtttcacrgtcccctgatatccagccaacccatggccaagtcctagcactgttaaagtctttatatttggccaggagaatggtgtgaacccaggagacggagcctgcagtgggcccagatagcgccactgcactccagcctgggtgacagagcaagactctgtctcaaaaaaaaaaaaaaaaaaccaaccagttctatgagttctctaaaagcgaaaaagagtctttcagccatttccccatcctggctagcaactatttccaacttcttcaagccaacctgcttggtctttacctctgtatctcaca

SEQ ID NO: 171217 - DNA, 601 bp, Human
gctctcccactcacctctgaagcctcagttctggggcaacaactccaggaagcctttcctagtttcaccctagcgccccgatgcctgggactgcagctgtgggtctgaccattaaccactcactgcctctgtccatcgccccaccgccagacagtacaatcctcagagacactgccatcctgacaactccacctggatttccaaaggcaccttgactcctgtccagaacagagctgcacccgccaactagtcccatctcatctacagagggcacggcaccgcagacacttccagcacacgyctgacggcagtttcacagtcccctgatatccagccaacccatggccaagtcctagcactgttaaagtctttatatttggccaggagaatggtgtgaacccaggagacggagcctgcagtgggcccagatagcgccactgcactccagcctgggtgacagagcaagactctgtctcaaaaaaaaaaaaaaaaaaccaaccagttctatgagttctctaaaagcgaaaaagagtctttcagccatttccccatcctggctagcaactatttccaacttcttcaagccaacctgcttggtctt

SEQ ID NO: 171218 - DNA, 601 bp, Human
attctaaacaagaataacaccaaaaatgtctgaggattgtcaatataactgctaagtcctccgcgagtagaaagaccagaagattcaacagacaccgtgagagtgtggccggcagtgacccgggcacggtcctcaagcagggagtgtgcgggcccctttccctcttccctttgcctggctctcccactcacctctgaagcctcagttctggggcaacaactccaggaagcctttcctagtttcaccctagcgccccgatgcctgggactgcagctgtgggtctgaccattaaccactcacygcctctgtccatcgccccaccgccagacagtacaatcctcagagacactgccatcctgacaactccacctggatttccaaaggcaccttgactcctgtccagaacagagctgcacccgccaactagtcccatctcatctacagagggcacggcaccgcagacacttccagcacacgcctgacggcagtttcacagtcccctgatatccagccaacccatggccaagtcctagcactgttaaagtctttatatttggccaggagaatggtgtgaacccaggagacggagcctgcagtgggc

SEQ ID NO: 171219 - DNA, 601 bp, Human
cagattcctcgccggtgactcagccgaactttcctgctttctcccaggacatgaagttcataaatcagcctgagggaactccttacattctaaacaagaataacaccaaaaatgtctgaggattgtcaatataactgctaagtcctccgcgagtagaaagaccagaagattcaacagacaccgtgagagtgtggccggcagtgacccgggcacggtcctcaagcagggagtgtgcgggcccctttccctcttccctttgcctggctctcccactcacctctgaagcctcagttctggggcracaactccaggaagcctttcctagtttcaccctagcgccccgatgcctgggactgcagctgtgggtctgaccattaaccactcactgcctctgtccatcgccccaccgccagacagtacaatcctcagagacactgccatcctgacaactccacctggatttccaaaggcaccttgactcctgtccagaacagagctgcacccgccaactagtcccatctcatctacagagggcacggcaccgcagacacttccagcacacgcctgacggcagtttcacagtcccctgatatccagccaa

SEQ ID NO: 171220 - DNA, 601 bp, Human; identical to SEQ ID NO: 31194

SEQ ID NO: 171221 - DNA, 601 bp, Human
agaggtaggagtcagaggcctggacttgggagctccacttcttagctgtggaaccctgaggaagcttctccctcctcccagaccttggatcacggtatgtgacttccagcaaatttcttaacctctatgggcctcagtttcctcatctgtagctaggaaaatggtgtctcacaggattcacaaattacagaacatgactactatctcctctgagctgtcactatgagaatgagagcggcttcgtcagacacagaaagaccagttgagcagatggcatctgtgtgggtagctcactcgcctyttcctattttgggtctatgaggacacgtggggaacccagatgggacgtgctctcttacatatgctataatagccaagaatccaaaggcctcctgggaagccgtcagctgggaaccaggacgaagcttccctaagaacttggagcacagaagagatgcgggcggcatgtttaaccactaagatgatcaacacctggtgaggtgagggctgcaccaggcgcgcactgccctttctcagcagtcacttacttaatgcacttaatccactcctccttctcctcgggcgtcggagctgagatccg

SEQ ID NO: 171222 - DNA, 601 bp, Human
ccttgctgtgtccacacagtgacctaaggtgacacacttcgaaagagacacaggaacacgtgacaagaaaattttggggtttttacctgtttcaacataataatcaattcacatttaggaacagaatcataccacattcttacagctatattccaattcagagaaaaagactggtgcttgagtttccatgatgacatctgactttgctttgcagcagcgagtgccacgtaatcaagccgtgtcacatgcagtcctctggcacggggtgtgtgatagctggcatggtaatgcagtggggccwtccaagccccccacgtgcacctgctcagtaactaaggctccatgactctgcaggcggcactgcccagcacgatgctgctggtggggcaccatggacagaccggctggacctggctgggtctccggtgcacagggagggggcccgagctcatgcttgtgctacagcctcaaagacagcagcgcaggccgcgccgcgggctggagcacctgcagtggactggcaacaccacaaccctatgtctgccattctcgactttcaagcaacttatggtctaaaagtcctgacacttaatttctttcc

SEQ ID NO: 171223 - DNA, 601 bp, Human
aaaaaaaatagcaaaagctgaagctagtctctaggaatccagggcggggcctggcagaggacgctctgctcggcagcagtgcatccatggaggtgcgggagaagagcaggagctccaaggcccccgcagaccaacgcccttggctgcacgctcagtgtcgcttcgtggaggagaccttctttttccgtgctgcgagcatttcgtagaaagggtccctgctgatggctgctctggagcacagaaaagggagaaaacagagacgtgagggacagaatcagaagaaacacacccaggcaggggwttctcaggggcccctcgtgccccagaacacctgtcccaccccaccatcactgcaaaggccaagttagcgtcctccacccttgctgtgtccacacagtgacctaaggtgacacacttcgaaagagacacaggaacacgtgacaagaaaattttggggtttttacctgtttcaacataataatcaattcacatttaggaacagaatcataccacattcttacagctatattccaattcagagaaaaagactggtgcttgagtttccatgatgacatctgactttgctttgcagcagcgagtg

SEQ ID NO: 171224 - DNA, 601 bp, Human; identical to SEQ ID NO: 31193

SEQ ID NO: 171225 - DNA, 601 bp, Human; identical to SEQ ID NO: 31192

SEQ ID NO: 171226 - DNA, 601 bp, Human; identical to SEQ ID NO: 171096

SEQ ID NO: 171227 - DNA, 601 bp, Human; identical to SEQ ID NO: 171097

SEQ ID NO: 171228 - DNA, 601 bp, Human; identical to SEQ ID NO: 171098

SEQ ID NO: 171229 - DNA, 601 bp, Human; identical to SEQ ID NO: 171099

SEQ ID NO: 171230 - DNA, 601 bp, Human; identical to SEQ ID NO: 171100

SEQ ID NO: 171231 - DNA, 601 bp, Human; identical to SEQ ID NO: 171101

SEQ ID NO: 171232 - DNA, 601 bp, Human; identical to SEQ ID NO: 171102

SEQ ID NO: 171233 - DNA, 601 bp, Human; identical to SEQ ID NO: 171103

SEQ ID NO: 171234 - DNA, 601 bp, Human; identical to SEQ ID NO: 171104

SEQ ID NO: 171235 - DNA, 601 bp, Human; identical to SEQ ID NO: 171105

SEQ ID NO: 171236 - DNA, 601 bp, Human; identical to SEQ ID NO: 171106

SEQ ID NO: 171237 - DNA, 601 bp, Human; identical to SEQ ID NO: 171107

SEQ ID NO: 171238 - DNA, 601 bp, Human; identical to SEQ ID NO: 171108

SEQ ID NO: 171239 - DNA, 601 bp, Human; identical to SEQ ID NO: 171109

SEQ ID NO: 171240 - DNA, 601 bp, Human; identical to SEQ ID NO: 171110

SEQ ID NO: 171241 - DNA, 601 bp, Human; identical to SEQ ID NO: 171111

SEQ ID NO: 171242 - DNA, 601 bp, Human; identical to SEQ ID NO: 171112

SEQ ID NO: 171243 - DNA, 601 bp, Human; identical to SEQ ID NO: 171113

SEQ ID NO: 171244 - DNA, 601 bp, Human; identical to SEQ ID NO: 171114

SEQ ID NO: 171245 - DNA, 601 bp, Human; identical to SEQ ID NO: 171115

SEQ ID NO: 171246 - DNA, 601 bp, Human; identical to SEQ ID NO: 171116

SEQ ID NO: 171247 - DNA, 601 bp, Human; identical to SEQ ID NO: 171117

SEQ ID NO: 171248 - DNA, 601 bp, Human; identical to SEQ ID NO: 171118

SEQ ID NO: 171249 - DNA, 601 bp, Human; identical to SEQ ID NO: 171119

SEQ ID NO: 171250 - DNA, 601 bp, Human; identical to SEQ ID NO: 171120

SEQ ID NO: 171251 - DNA, 601 bp, Human; identical to SEQ ID NO: 171121

SEQ ID NO: 171252 - DNA, 601 bp, Human; identical to SEQ ID NO: 171122

SEQ ID NO: 171253 - DNA, 601 bp, Human; identical to SEQ ID NO: 171123

SEQ ID NO: 171254 - DNA, 601 bp, Human; identical to SEQ ID NO: 171124

SEQ ID NO: 171255 - DNA, 601 bp, Human; identical to SEQ ID NO: 171125

SEQ ID NO: 171256 - DNA, 601 bp, Human; identical to SEQ ID NO: 171126

SEQ ID NO: 171257 - DNA, 601 bp, Human; identical to SEQ ID NO: 171127

SEQ ID NO: 171258 - DNA, 601 bp, Human; identical to SEQ ID NO: 171128

SEQ ID NO: 171259 - DNA, 601 bp, Human; identical to SEQ ID NO: 171129

SEQ ID NO: 171260 - DNA, 601 bp, Human; identical to SEQ ID NO: 171130

SEQ ID NO: 171261 - DNA, 601 bp, Human; identical to SEQ ID NO: 171131

SEQ ID NO: 171262 - DNA, 601 bp, Human; identical to SEQ ID NO: 171132

SEQ ID NO: 171263 - DNA, 601 bp, Human; identical to SEQ ID NO: 171133

SEQ ID NO: 171264 - DNA, 601 bp, Human; identical to SEQ ID NO: 171134

SEQ ID NO: 171265 - DNA, 601 bp, Human; identical to SEQ ID NO: 171135

SEQ ID NO: 171266 - DNA, 601 bp, Human; identical to SEQ ID NO: 171136

SEQ ID NO: 171267 - DNA, 601 bp, Human; identical to SEQ ID NO: 171137

SEQ ID NO: 171268 - DNA, 601 bp, Human; identical to SEQ ID NO: 171138

SEQ ID NO: 171269 - DNA, 601 bp, Human; identical to SEQ ID NO: 171139

SEQ ID NO: 171270 - DNA, 601 bp, Human; identical to SEQ ID NO: 171140

SEQ ID NO: 171271 - DNA, 601 bp, Human; identical to SEQ ID NO: 171141

SEQ ID NO: 171272 - DNA, 601 bp, Human; identical to SEQ ID NO: 171142

SEQ ID NO: 171273 - DNA, 601 bp, Human; identical to SEQ ID NO: 171143

SEQ ID NO: 171274 - DNA, 601 bp, Human; identical to SEQ ID NO: 171144

SEQ ID NO: 171275 - DNA, 601 bp, Human; identical to SEQ ID NO: 171145

SEQ ID NO: 171276 - DNA, 601 bp, Human; identical to SEQ ID NO: 171146

SEQ ID NO: 171277 - DNA, 601 bp, Human; identical to SEQ ID NO: 171147

SEQ ID NO: 171278 - DNA, 601 bp, Human; identical to SEQ ID NO: 171148

SEQ ID NO: 171279 - DNA, 601 bp, Human; identical to SEQ ID NO: 171149

SEQ ID NO: 171280 - DNA, 601 bp, Human; identical to SEQ ID NO: 171150

SEQ ID NO: 171281 - DNA, 601 bp, Human; identical to SEQ ID NO: 171151

SEQ ID NO: 171282 - DNA, 601 bp, Human; identical to SEQ ID NO: 171152

SEQ ID NO: 171283 - DNA, 601 bp, Human; identical to SEQ ID NO: 171153

SEQ ID NO: 171284 - DNA, 601 bp, Human; identical to SEQ ID NO: 171154

SEQ ID NO: 171285 - DNA, 601 bp, Human; identical to SEQ ID NO: 171155

SEQ ID NO: 171286 - DNA, 601 bp, Human; identical to SEQ ID NO: 171156

SEQ ID NO: 171287 - DNA, 601 bp, Human; identical to SEQ ID NO: 171157

SEQ ID NO: 171288 - DNA, 601 bp, Human; identical to SEQ ID NO: 171158

SEQ ID NO: 171289 - DNA, 601 bp, Human; identical to SEQ ID NO: 171159

SEQ ID NO: 171290 - DNA, 601 bp, Human; identical to SEQ ID NO: 171160

SEQ ID NO: 171291 - DNA, 601 bp, Human; identical to SEQ ID NO: 171161

SEQ ID NO: 171292 - DNA, 601 bp, Human; identical to SEQ ID NO: 171162

SEQ ID NO: 171293 - DNA, 601 bp, Human; identical to SEQ ID NO: 171163

SEQ ID NO: 171294 - DNA, 601 bp, Human; identical to SEQ ID NO: 171164

SEQ ID NO: 171295 - DNA, 601 bp, Human; identical to SEQ ID NO: 171165

SEQ ID NO: 171296 - DNA, 601 bp, Human; identical to SEQ ID NO: 171166

SEQ ID NO: 171297 - DNA, 601 bp, Human; identical to SEQ ID NO: 171167

SEQ ID NO: 171298 - DNA, 601 bp, Human; identical to SEQ ID NO: 171168

SEQ ID NO: 171299 - DNA, 601 bp, Human; identical to SEQ ID NO: 171169

SEQ ID NO: 171300 - DNA, 601 bp, Human; identical to SEQ ID NO: 171170

SEQ ID NO: 171301 - DNA, 601 bp, Human; identical to SEQ ID NO: 171171

SEQ ID NO: 171302 - DNA, 601 bp, Human; identical to SEQ ID NO: 171172

SEQ ID NO: 171303 - DNA, 601 bp, Human; identical to SEQ ID NO: 171173

SEQ ID NO: 171304 - DNA, 601 bp, Human; identical to SEQ ID NO: 171174

SEQ ID NO: 171305 - DNA, 601 bp, Human; identical to SEQ ID NO: 171175

SEQ ID NO: 171306 - DNA, 601 bp, Human; identical to SEQ ID NO: 171176

SEQ ID NO: 171307 - DNA, 601 bp, Human; identical to SEQ ID NO: 171177

SEQ ID NO: 171308 - DNA, 601 bp, Human; identical to SEQ ID NO: 171178

SEQ ID NO: 171309 - DNA, 601 bp, Human; identical to SEQ ID NO: 171179

SEQ ID NO: 171310 - DNA, 601 bp, Human; identical to SEQ ID NO: 171180

SEQ ID NO: 171311 - DNA, 601 bp, Human; identical to SEQ ID NO: 171181

SEQ ID NO: 171312 - DNA, 601 bp, Human; identical to SEQ ID NO: 171182

SEQ ID NO: 171313 - DNA, 601 bp, Human; identical to SEQ ID NO: 171183

SEQ ID NO: 171314 - DNA, 601 bp, Human; identical to SEQ ID NO: 31209

SEQ ID NO: 171315 - DNA, 601 bp, Human; identical to SEQ ID NO: 31208

SEQ ID NO: 171316 - DNA, 601 bp, Human; identical to SEQ ID NO: 31207

SEQ ID NO: 171317 - DNA, 601 bp, Human; identical to SEQ ID NO: 31206

SEQ ID NO: 171318 - DNA, 601 bp, Human; identical to SEQ ID NO: 31205

SEQ ID NO: 171319 - DNA, 601 bp, Human; identical to SEQ ID NO: 31204

SEQ ID NO: 171320 - DNA, 601 bp, Human; identical to SEQ ID NO: 31203

SEQ ID NO: 171321 - DNA, 601 bp, Human; identical to SEQ ID NO: 31202

SEQ ID NO: 171322 - DNA, 601 bp, Human; identical to SEQ ID NO: 31201

SEQ ID NO: 171323 - DNA, 601 bp, Human; identical to SEQ ID NO: 31200

SEQ ID NO: 171324 - DNA, 601 bp, Human; identical to SEQ ID NO: 31199

SEQ ID NO: 171325 - DNA, 601 bp, Human; identical to SEQ ID NO: 31198

SEQ ID NO: 171326 - DNA, 601 bp, Human; identical to SEQ ID NO: 31197

SEQ ID NO: 171327 - DNA, 601 bp, Human; identical to SEQ ID NO: 31196

SEQ ID NO: 171328 - DNA, 601 bp, Human; identical to SEQ ID NO: 31195

SEQ ID NO: 171329 - DNA, 601 bp, Human; identical to SEQ ID NO: 171199

SEQ ID NO: 171330 - DNA, 601 bp, Human; identical to SEQ ID NO: 171200

SEQ ID NO: 171331 - DNA, 601 bp, Human; identical to SEQ ID NO: 171201

SEQ ID NO: 171332 - DNA, 601 bp, Human; identical to SEQ ID NO: 171202

SEQ ID NO: 171333 - DNA, 601 bp, Human; identical to SEQ ID NO: 171203

SEQ ID NO: 171334 - DNA, 601 bp, Human; identical to SEQ ID NO: 171204

SEQ ID NO: 171335 - DNA, 601 bp, Human; identical to SEQ ID NO: 171205

SEQ ID NO: 171336 - DNA, 601 bp, Human; identical to SEQ ID NO: 171206

SEQ ID NO: 171337 - DNA, 601 bp, Human; identical to SEQ ID NO: 171207

SEQ ID NO: 171338 - DNA, 601 bp, Human; identical to SEQ ID NO: 171208

SEQ ID NO: 171339 - DNA, 601 bp, Human; identical to SEQ ID NO: 171209

SEQ ID NO: 171340 - DNA, 601 bp, Human; identical to SEQ ID NO: 171210

SEQ ID NO: 171341 - DNA, 601 bp, Human; identical to SEQ ID NO: 171211

SEQ ID NO: 171342 - DNA, 601 bp, Human; identical to SEQ ID NO: 171212

SEQ ID NO: 171343 - DNA, 601 bp, Human; identical to SEQ ID NO: 171213

SEQ ID NO: 171344 - DNA, 601 bp, Human; identical to SEQ ID NO: 171214

SEQ ID NO: 171345 - DNA, 601 bp, Human; identical to SEQ ID NO: 171215

SEQ ID NO: 171346 - DNA, 601 bp, Human; identical to SEQ ID NO: 171216

SEQ ID NO: 171347 - DNA, 601 bp, Human; identical to SEQ ID NO: 171217

SEQ ID NO: 171348 - DNA, 601 bp, Human; identical to SEQ ID NO: 171218

SEQ ID NO: 171349 - DNA, 601 bp, Human; identical to SEQ ID NO: 171219

SEQ ID NO: 171350 - DNA, 601 bp, Human; identical to SEQ ID NO: 31194

SEQ ID NO: 171351 - DNA, 601 bp, Human; identical to SEQ ID NO: 171221

SEQ ID NO: 171352 - DNA, 601 bp, Human; identical to SEQ ID NO: 171222

SEQ ID NO: 171353 - DNA, 601 bp, Human; identical to SEQ ID NO: 171223

SEQ ID NO: 171354 - DNA, 601 bp, Human; identical to SEQ ID NO: 31193

SEQ ID NO: 171355 - DNA, 601 bp, Human; identical to SEQ ID NO: 31192

SEQ ID NO: 171356 - DNA, 601 bp, Human; identical to SEQ ID NO: 22259

SEQ ID NO: 171357 - DNA, 601 bp, Human; identical to SEQ ID NO: 22260

SEQ ID NO: 171358 - DNA, 601 bp, Human; identical to SEQ ID NO: 22261

SEQ ID NO: 171359 - DNA, 601 bp, Human; identical to SEQ ID NO: 22262

SEQ ID NO: 171360 - DNA, 601 bp, Human; identical to SEQ ID NO: 22263

SEQ ID NO: 171361 - DNA, 601 bp, Human; identical to SEQ ID NO: 22264

SEQ ID NO: 171362 - DNA, 601 bp, Human
aagcacaaattacatgcctaaaaagacaatattgggactagaatctaggtcgaattctgcttccctccagaccagcaattcctaaacctggttttattttattttatttttatttatttattttggagtcggagtctcgctctgtctcccaggctggagttcagtggagcgatcttggctcactgcaacctctgcctcccgggttcacaccattctactgcctcagcctcccgtgtagctaggactacaggggcccgccaccacgcccggctaatttttttttttttttttttttttttgkatttttagtagagacggggtttcaacatgttagccaggatggtctcgatctcctgacctcgtgatccgcccacctcggcctcccaaagtgctggggttacaggcatgagccaccgcgcccagcccctaaacctggttttaaaatcaaaattacatgggcttcagaatctgttttttgtgggggttttgtgtgtgtgtgtgtgtgtgttttttatagggtctcactctgtcaccaggctggagtgccagaatctgtttttctaacaagcttctgctgagaatttgtgtagtcagtcctggt

SEQ ID NO: 171363 - DNA, 601 bp, Human; identical to SEQ ID NO: 26272

SEQ ID NO: 171364 - DNA, 601 bp, Human; identical to SEQ ID NO: 26273

SEQ ID NO: 171365 - DNA, 601 bp, Human
gaagctttatttaaacagttccaagtaggggagaccagctgcccctgaaccccagaacaaccagctggatcagttctcacaggagccacagctcagagactgggtaagtcaacaatccccagagctgggacaggaggggcagcgacagggcagcacctgagggagaggtgagctgaagttagtgcttaggagatgtggcacactttggggacaggaagaaaaggaaatgcgaccccagagtggcagcagaggggcctgtgggttgagacactatagagtgtgtcataaccgagaccggatmggggagtagttacttctcttcttttcttacaggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacg

SEQ ID NO: 171366 - DNA, 601 bp, Human
ttgttttgttttgttttgttttgtttttagtgcagggaagataatagccatctatctgcagtattataaggttttgtagaaaacatctgtgtctctgcctggttcctattagtcactcaaaatgttagtttcccttccctcagggagaaggtgactgcttttcttatcgcttacagactgtggaaccaaacttccaggactgctaaagagggaacagtcctcggtgaggaggaggaagcaagggaggggactgtctgtgatggggttgggagttgactgtctaattggagtatcttttggsgggatttctgactatgtcttttcctgagcctttgagtctgttcatcatgggtaagttaagagggtttactcgagatgttctctcttggggttcctttctgagcctacacccgagagtgaagtcgatgtgtttggacccttagacagtgaatgcaaagaagttagagaaggccgaggctcgacttaaggcaaagcaggagaagcgctcagagaaggacacgctcaagaccagcaaccctctgtgagtgggggaagcatggctcagaagagagcagagcagcttttgcctggacagaaggtg

SEQ ID NO: 171367 - DNA, 601 bp, Human
gagtaactagcagccgctgtcgcttacagagcgcctgccgtcctggaacaatccataatttgcatgtacatcctagtaatcagcagagcttagaacttggcactctgggactcagaagcccttgttctttccacagtgcccattgccctttcttgttctttccacagtgcccatttccatagtgcccaaggtaatgagcactgtgcaaacccttcctgtattctcttcctcttccagccacaaggtagccaatggcctttccaacggtatagggtgcaggacatcctcctagactgccccygcttaggccaattgctgtttctcctccctccagggcggagggctctgaagctgcagagctggcagaaatctatgccaaactggaggagattgaggctgacaaggcacctgccaggtatttaaagctccccctccctccttcagatttcctttcccttctgtggactgttccaactgagttcttcgatttcttctctactagggcatcagtcattctcgctgggcttggctttacccctaaaatgcagcagcagcccacccggtgagtgacccttgccattcttggctttgaaccctgttg

SEQ ID NO: 171368 - DNA, 601 bp, Human
gtgggggaatttgaccaatgcctacactcctccacctgcaggttttcattgaccggtttcgctacaatgccaacagggcctctcaagtgcagagtaaactcaagatgctggagaagctgtgagtacagcatccttggccagggcctgactcctgttctcttcgtctccttccgcatttgcacgccacccttgccctaccattctaggtctccccttcgctagaagccaactgtgacttcctcctctgctgggaagcagagtattccacactgttcttggagggctaatcttgactagcacrtggcaaccactaatttactttctgtttctgcttctacgtatctgcttattctgggcatttcatataaatggaatcatacaatatgacctttgtgcctggcgtcttttacctggcgtcatgtgtgaggctcatccatattgtagcgtgcgtcagagcttcatttcttttcgtggctggataatattctgttgtgtggatatacagcattttgtttattgagtcatgaggggccatttgggttgtttccattttggttattatgaataatgttgctgtgaacattggtgtacaaatttttgt

SEQ ID NO: 171369 - DNA, 601 bp, Human
caagatgctggagaagctgtgagtacagcatccttggccagggcctgactcctgttctcttcgtctccttccgcatttgcacgccacccttgccctaccattctaggtctccccttcgctagaagccaactgtgacttcctcctctgctgggaagcagagtattccacactgttcttggagggctaatcttgactagcacgtggcaaccactaatttactttctgtttctgcttctacgtatctgcttattctgggcatttcatataaatggaatcatacaatatgacctttgtgcctggygtcttttacctggcgtcatgtgtgaggctcatccatattgtagcgtgcgtcagagcttcatttcttttcgtggctggataatattctgttgtgtggatatacagcattttgtttattgagtcatgaggggccatttgggttgtttccattttggttattatgaataatgttgctgtgaacattggtgtacaaatttttgtgtggacatatgttttcagcttgcttgggtgtatacctaggcgcagaattgctgggttacctggtaattccaaattaatgttttgaggaactgtcaaactg

SEQ ID NO: 171370 - DNA, 601 bp, Human
gtgtggatatacagcattttgtttattgagtcatgaggggccatttgggttgtttccattttggttattatgaataatgttgctgtgaacattggtgtacaaatttttgtgtggacatatgttttcagcttgcttgggtgtatacctaggcgcagaattgctgggttacctggtaattccaaattaatgttttgaggaactgtcaaactgttttctaaagcaacaacatcattttacattcctaccaacaagggatgagagttccaatttctccatgtctttggcagcactgttattgactttttttttttagttttagccatcctagtggctgtgaagtgatagctcattgtggttttgatttgcattgccttaataactaatgataatgtgcattgggagtttaattttgaagtgccctttctataagtgctggcaggaagcttaaaatcataaagcttagatgtttgcgacgtggaaacatatcacaatatagtaactggggataaaaagtcacaaaaagcctaattctattttttagcatacagtaaatgagaagaatggactctaaagtaatgatacctgagtggtaggagtacaa

SEQ ID NO: 171371 - DNA, 601 bp, Human
ggtaggagtacaagccctttctaagttttctctgaacatatattactcgtgtaggaagttatttttttaagtaataaatctagtctacctcatctcttctcccaggcctgagctgaagcctgtggacaaggaatcagaggtcgtaatgaagtaagtgctgggccagtggggctggtggggaattgcttgcttccagctgcccccacatcctcacccctacctcctgcaggttccctgatgggtttgagaagttctcgccgccaattctgcagctagatgaggtggatttctactacgatcygaagcacgtcatcttcagtcgcctctctgtgtctgctgatctcgagtctcgcatctgtgtggtaaggctgctgtttctctgtgctgcgagctgggactctcctgtctaagtgtgtggtgtggattggcccagatcctcaggctgtaaagggacgaggtctgtggaacaggagtgagggcctgggctaaggattttgcaggacttacactagccctgtcctctggccgcacagcgctgctcttcagggaggaagagcctagtgtatagtgttttaaaaatacttaaaaatacttaaagcag

SEQ ID NO: 171372 - DNA, 601 bp, Human
attgcttgcttccagctgcccccacatcctcacccctacctcctgcaggttccctgatgggtttgagaagttctcgccgccaattctgcagctagatgaggtggatttctactacgatccgaagcacgtcatcttcagtcgcctctctgtgtctgctgatctcgagtctcgcatctgtgtggtaaggctgctgtttctctgtgctgcgagctgggactctcctgtctaagtgtgtggtgtggattggcccagatcctcaggctgtaaagggacgaggtctgtggaacaggagtgagggccygggctaaggattttgcaggacttacactagccctgtcctctggccgcacagcgctgctcttcagggaggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagta

SEQ ID NO: 171373 - DNA, 601 bp, Human
aggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttmcttttttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggc

SEQ ID NO: 171374 - DNA, 601 bp, Human
ggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttcsttttttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggct

SEQ ID NO: 171375 - DNA, 601 bp, Human
gaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttccwtttttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggcta

SEQ ID NO: 171376 - DNA, 601 bp, Human
aagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttcctkttttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggctag

SEQ ID NO: 171377 - DNA, 601 bp, Human
agcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttccttttctttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggctagagt

SEQ ID NO: 171378 - DNA, 601 bp, Human
cggcttctgcctgcaggaatctgaagattggctatttcagccagcaccatgtggagcagctggacctaaacgtcagtgctgtggaactgctggcacgcaagtttcctggtgagttagggatttgagtcgggggaagagtttgagtagggaagagggctgaggctgaccccggcagctaggcctgccttggggtgcgtgcagagcagccccgccaagcctagatggaaggacatggggacttggaggtgtggctggagggcacagggagggtgttgggccaagaagccacctgatctggggmgtccttttccagggcggcctgaggaggagtaccgtcaccagctgggtcggtatggcatctccggagaactggccatgcgtcctcttgccagcctgtctgggggccagaagagccgagtggcctttgctcagatgactatgccctggtgaggcctcattttccagagctcttcccctcccatttccccttcttgcccagtagaaaactgtatcagaaggctttattttctctcaccgcaccccttcactgcccaccttcctggttctgccttccagccccaacttctacattctggatgaa

SEQ ID NO: 171379 - DNA, 601 bp, Human; identical to SEQ ID NO: 30017

SEQ ID NO: 171380 - DNA, 601 bp, Human
aatctaattatacttgccactcaaaaaacttcctttctgggagttgttaatgaccatgctctctgaaacagcaggattcagttgtggaacataaggaatgtttcatgcagtagacattggacatcctcttatgtggtaagcactgtggtgggcactggataaccttgaatactttttcatggcttcatgtttatggcccaagagtggtccaggctggccaatattgctttcttaatatactgcttaagaaccagagctctggagttctgggtttgaatctcttggccaggattcagatatrcgttttgtgaccaggggcaatgaacttggcctttcgaagcctcagtttctcacttggaaagtgggaataacgcttacctccccggtggctttgagaatgcatgtaagcctgggacctgacatgtagtaaggatgcaatacacattagccatcattgttagtagcgacaatattgttatggtctcattaatggtcccttttactattggtaaatgagtccctaacctctcattatttaccacacaatttctttagttcatattactaggtcccactgttctctctaacctgttgatttccc

SEQ ID NO: 171381 - DNA, 601 bp, Human
tggaaagtgggaataacgcttacctccccggtggctttgagaatgcatgtaagcctgggacctgacatgtagtaaggatgcaatacacattagccatcattgttagtagcgacaatattgttatggtctcattaatggtcccttttactattggtaaatgagtccctaacctctcattatttaccacacaatttctttagttcatattactaggtcccactgttctctctaacctgttgatttccccacttttcattattgagcagtcctttcagagtatcctagatgagattttattctrcttcaaactccggatctgtttttttctggatctgaggactctcaaatgaattacaatgtgaacgatatgaaacagaagtctagctatcaatttgctctactcatttttttcataggggatgggtagatggttggaatgggatttatagtgaatttgattataagagtaatcaacagacgtagctttggttgcatgtttatgctaacagttatggcttctaatctggccatttttgccactgtccctcagataatagggaatagctgctaattttgttattactcaaaagatttgagtgtc

SEQ ID NO: 171382 - DNA, 601 bp, Human
atggatgtttggatgagaccccagaattcgttcacctggtcacttcataattagatacaaagaacaagtctatacttatgctttgaacattttaatccccttcccacctcctttgtagctacttatatagattctgtactggtgacagaatttcaggttttgagaattttttaacacttaaactggcgcttagcttttaatgtgttagagcaatcattggcgacattctgtcattctcagtcacatataccttaaaatttttaatatattatacacttattaagcaatgtaactttttttwacacaaccttacatatagatccaactgatttctttttcatataccttacaaatttgttttcttgctcctttcgccatccatattactattttgttcacctcttctctctccttttcacctctttctttttgctacctagtaacagtcaatcagggtattttgctttaaagttgtttgtttcccagcctcctctccagttgtagtagaaggtgagttttaccttcccttttccagtgggatgcggggaagacttgcctgctacttccagagaacccttttcttcctgaatgtagtcagctc

SEQ ID NO: 171383 - DNA, 601 bp, Human
aggctagtctcaaactcctgggctcaagagatcctcctttcttggcctcccaaaatgccaagattacaggtgtgagcgactgtacccggccaaaaaaaaaatgcatttaagcttaaatgtcatctgtatcaagtacagttaaaaaaatctcatctcaaggagactactctccagttaacataaaaatataccaaaatatgatataagtcgttttgtcttctgctttttattcatgaactggagaagaatgatgctttgatatgtgtcattcttaagtacattgattcaaaggcaaaaaaaattaacctggaaaaaacatttctgctatgtttaaatttttttttggaatgagaatgcatagtttccactgattgattgttatgactactttgaaatgtagttagcaaaaatttatttcttgaatggttcacccacaatgtaactgtatataaataatagagatcaagcagttagaccctaggataaaagtttttttaattggttcattactgttatgtctcccttgccttaaataactgactaaaagtaatatatgatttcctgctcatagtgaacctttatatatgatatatatctatat

SEQ ID NO: 171384 - DNA, 601 bp, Human
ttgctctggaatatagacattaactttatggtaaaagtggtcacacttttctttaaaattgggcttgggctgggcacggtggctcatgcctgtaatcccagcacttcgggaggccacggcgggcagatcacctgaggttgggagttcaagaccagccagaccaacatggagaaaccccgcctctactaaaaatacaaaattagctgggcgtggtggcacacgcctgtaatcctagctatttgggaggctgaggcaggagaatcgctgaacctgggaggcagaggttgcagtgagccgagawtgtgccatggcactccagcctggtcaacaagaacaaaactccgtctcaaaataaataaataaataactccatatcaaaataaataaaataaaaataaaggcttgaaatcatcaaaggactgatttctccactgttggggcacacttatttctagaatctccacttttattctaaggatatttcagaattatcagataaacttatgtttaatttattaaaaagaattatgtatcatacagtagttgtaggagggtatggggcaaagagcatgaaattagatatcattcaagtctgataagt

SEQ ID NO: 171385 - DNA, 601 bp, Human
gtgaacatagttgtttagaatatgacttacttgctttataaaaccattttttcattttttatttttcgaggagggatgaggatttgcctgaaaacatttttttctcacaagctgcccaactaccaaaaaaatcattcttccaaaacctcctgatgttgattcctcatgaagagcagttgagttgcccaatgtgtgccactcatgacagaagcccccttttttagaaacacagtttttaagaaatgcttttatgaagttgaatttaccttagtgttgtcagcattctaatttttttttttttcagatgagaatcgtgactcatttaaagatctttgggcataggaattttcctcagaaaatgcctaaccgaattgtgtgctaatcagagtgatagtagctaggcgtttggcaaatactcttctgataatttatttttcacacaaaggtgcttttagctctttatcactatcctcccccccgccaccttttttttgtagctgtagtatattatcagttcatggccgaagagttctggagctctaaatattttgggtagtgttaagtttctgtagctttgtcttttacgtttttggtggcgtta

SEQ ID NO: 171386 - DNA, 601 bp, Human
ttataccattacaaagggaatgttgcttagttgtctttgaccttggaaatggtgggaacatgaatttgtcctgaaaatgctttttgttgctaggagaaggaaggtttctaacagctattgcaccttaaaataatttggggatgcttaatgtgtgacatttttgataagaaaataattagtgactttcccacattgcagaaagttttcatttatatgccacttgaactttactactagcaacaaagggatgttgacagaactttcagagttgaacagatacagagtagaaatgatatggaaygtttccagagagtattcccaactgaatccagttaaagtggttttcaatttagctcatacatttagggtgatggttttcagataaggtgtagtaaatatttggattgtcactacatggttttatgagatccgaatctaggcaaaaatgtacagttaataagatgcactaagaaaaagttgtgacttccatcttggtgttcattttccctgggtagaaatgccaaatgaacgttaatcagaaaggaaaatcaagtgcgtacgaacatattcactcccctttagagaagctcttacaaggata

SEQ ID NO: 171387 - DNA, 601 bp, Human
caaagggaatgttgcttagttgtctttgaccttggaaatggtgggaacatgaatttgtcctgaaaatgctttttgttgctaggagaaggaaggtttctaacagctattgcaccttaaaataatttggggatgcttaatgtgtgacatttttgataagaaaataattagtgactttcccacattgcagaaagttttcatttatatgccacttgaactttactactagcaacaaagggatgttgacagaactttcagagttgaacagatacagagtagaaatgatatggaacgtttccagagwgtattcccaactgaatccagttaaagtggttttcaatttagctcatacatttagggtgatggttttcagataaggtgtagtaaatatttggattgtcactacatggttttatgagatccgaatctaggcaaaaatgtacagttaataagatgcactaagaaaaagttgtgacttccatcttggtgttcattttccctgggtagaaatgccaaatgaacgttaatcagaaaggaaaatcaagtgcgtacgaacatattcactcccctttagagaagctcttacaaggataaggaaagagag

SEQ ID NO: 171388 - DNA, 601 bp, Human
gttaagataaaccaatgggcttaggtgctgccagtgtgatccatatagtgtaaagttctccgtcagcctttcatctggtagttctggcccattaactttgcctacattaattattttcttaggaagaggttgactctcattttcagacatatgtgggctttgcagatagtagttgtatccagccaaaaaaagacaaaatttgtgtttggggcatacgactgaaagcaaattatagttaagccttggtcatctctgacttaactatgccagtactgaaggatatgaaagtgtatttatatgyacacatatgatatacaaacatttattgggatgctctgtattttgatagaataaaaactggatacttgtcctttctaccctggaacatgagttgacccgttcattagggctcattaatctttgcagataatcaaaagccacgtcaagtaataagacgttctctggtgaagttgaggagccaatggttagacaagactagtcctgccaaattaagatcaatcccacatcagagcccagcttttaaaatttgtgttcagtgcttagaatgctcagatccttcagggcattgccttcccaatac

SEQ ID NO: 171389 - DNA, 601 bp, Human
tacaaaaaattagccgggcgtagtggcgggggcctgtagtcccagctactcgggaggctgaggcaggagaatggcgtgaacccaggaagtggagcttgcagtgagccgagattgtgccactgcaccccagcctgggcgacagagtgagactccgtctcaaaaaaaaaaaaagatgttcttgaagtcaggagtctgctaggtatttgaaggacatctggcttgataatccttgataatattttcatacctgtttgtaaatcaactattgatatatgatggagaaaaatatattcataaaccrtatcttcctactttatctctaattcacttggaatttgttttacttgtttttaggcttgtttatgtatttggatagttataaaaaccaattacaaatattaatggaaataaggaaatttttatttcatatttccaatattgacaccttgaggtgttttctgacaccaagcaattctctgacagcaaccgtgtatccaacaattgaattcatttctgacactatttacctggagttagcatcagatctcacaagttgaagggctcagtgcttcaagattctcctcacttaggatgctagtca

SEQ ID NO: 171390 - DNA, 601 bp, Human
ccagcctgggcgacagagtgagactccgtctcaaaaaaaaaaaaagatgttcttgaagtcaggagtctgctaggtatttgaaggacatctggcttgataatccttgataatattttcatacctgtttgtaaatcaactattgatatatgatggagaaaaatatattcataaaccatatcttcctactttatctctaattcacttggaatttgttttacttgtttttaggcttgtttatgtatttggatagttataaaaaccaattacaaatattaatggaaataaggaaatttttatttcmtatttccaatattgacaccttgaggtgttttctgacaccaagcaattctctgacagcaaccgtgtatccaacaattgaattcatttctgacactatttacctggagttagcatcagatctcacaagttgaagggctcagtgcttcaagattctcctcacttaggatgctagtcacaaatggggtgtttaggatactcatactcctgcttggatgacttcaaatttgggggttcccattatcaaacttgaccacaacccccatcaagtttgataatttgctagcatgtcttatggaactca

SEQ ID NO: 171391 - DNA, 601 bp, Human
caactattgatatatgatggagaaaaatatattcataaaccatatcttcctactttatctctaattcacttggaatttgttttacttgtttttaggcttgtttatgtatttggatagttataaaaaccaattacaaatattaatggaaataaggaaatttttatttcatatttccaatattgacaccttgaggtgttttctgacaccaagcaattctctgacagcaaccgtgtatccaacaattgaattcatttctgacactatttacctggagttagcatcagatctcacaagttgaagkgctcagtgcttcaagattctcctcacttaggatgctagtcacaaatggggtgtttaggatactcatactcctgcttggatgacttcaaatttgggggttcccattatcaaacttgaccacaacccccatcaagtttgataatttgctagcatgtcttatggaactcaggaaataactttatttactgttattggctttattataaaggttacagctcatgaacagccaaatggaagagataggaccctgtatagggcaaggtattgggagtaaggggacaggggaatagcgcagaggttc

SEQ ID NO: 171392 - DNA, 601 bp, Human
gtgcacactatccttgattcatttaccaatctggaagctccccgaaccctattgttaggggtttttatggaggttttattaggtaggcatgattgattgtatcattggccattggactccgtctctagtccttttcaccttcctggaggtgtgtgtatgggggcgtggcagctgaaagttttaacagtctactcacttggttgtttttttctggtggccagcccctatcctgaagttatataggggccctctgagagttaccagactcttgcacaaagtcaggtatggttgaaagggccasattatcggtaacaaaagacactcctgtcactcaggagattctaagggttttcagagctctgtgccccaaacctgggacaaaggcaaaatacagttatatttttcattgtactacaggtacttctgtagcaaaattaccttgcacacaattggcccacagctttgaatctatctgggaaaaagagtggtaatcccataatgggttgtctactggattggtgatttttctgtcgtgaaaaggatgaacatggtttgtttccttggagcaaatgggtacttaggctaggaagttctctgcatc

SEQ ID NO: 171393 - DNA, 601 bp, Human
tgctgcaaatgtttcctcttcctggctagaactctcagcacatgtatagcaatagtgtttctgtgtgaatggaatcagtgcaggtatgtagcagattaggccgttcttattaaggactgtgaaagatgatggtatgagagaactctttaaatgagctagggacaaattaaggattcagagaactattaacacattctcttctcccctgaaccaaaggtggagataactggctgcctccttttgggtatccatttggaaccttctcagagtggttgtgtaattgtgaaattccaactcttakgttcccatgaagtctacttgcaaaatcattggaacatggaattggggttcggggggttatttcggataagctttttatattttgttggtgattaaaatgttgttaaatttagcaacattttaaactacagtagggccttctttgattagctggctccctgggtaatttttatggggttggactaatcatgacttggccagagagattttcaatttagcctgtggaattatatatttgcttgttggtagtagacatctggctcagagtctgatagaaagtgttgctgttattggctttaag

SEQ ID NO: 171394 - DNA, 601 bp, Human
cttctctagagaatttaatactttctcaattaggttttaatatgtacttataactaatatcatagtagttaccacttttcatgtctactgtttgccactattatagcatatttaagatatattaatccttatcacaacagtactgccaagtagcagactgtttttatcctggtttcacagatgtgtagtgtactagaccacagaaatattcttgtttgtatcttgattagtgttccagtggtatttattagtattttcagtggtgatcatttgacatcttggaaaagaattttctttcctrttcctaccctttaacctccttgtactacatttctttttctttttttttgagacaggatctcactatgttgcccaggctgcttttgaactcatgggcgcaaacgatccttttgctttggcctcccaaagtgctgggattacaggcatgagtcaccatgtctggcctcacatttctttttaattttttggcagaatgcccaacgaaacagtctttgtggaggggtcagctaccttatctattgttcatctccactgcctggcatataacttgtttgtaattgtggtatttctgcacttgttg

SEQ ID NO: 171395 - DNA, 601 bp, Human
tgttgggatatttacttgatttcttaaactcagaaccatctagtttccaaaatgcttagctgtgtggatgaacaacagtgctttattgatgagagttcaaagttctgagtgagattttatgaactttttagtaattgctcactcttatgtatcaaagattgccagtggggggagataggggcaatataatattagctgatagcagctcacttaatacatggatatatggaatacctgatattgcgagtctaacatctctttttctttatttatttttatttatttatttattttttgagaygcagtttcactcttgtcacccaggctggagtgcaatggcgcgatctctgctcactgaaacctatacctcctgggttcaagcgattccattgcctcagcctcccgagtagctgggattacaggtgtctgccaccacgcccggctaatttttgtatttttagtagagacggggttttaccatgttggcctggctggtcttgaactcctgacctcaggtggtccgtccgcctcagcctcccaaagtgctaggattacaggcatgagccaccgtgcctgacctaacatctctttttcttttgag

SEQ ID NO: 171396 - DNA, 601 bp, Human
ccaggctggagtgcaatggcgcgatctctgctcactgaaacctatacctcctgggttcaagcgattccattgcctcagcctcccgagtagctgggattacaggtgtctgccaccacgcccggctaatttttgtatttttagtagagacggggttttaccatgttggcctggctggtcttgaactcctgacctcaggtggtccgtccgcctcagcctcccaaagtgctaggattacaggcatgagccaccgtgcctgacctaacatctctttttcttttgagcttatgaaatattaggtctytcattaccgtagtaatttagggagaaaagagaatgaaagtaagttctttactaccactttatttcctcatttctgaaattgtttgactgtaaagttgcatagttggaattgtgggttactcatttcataaccagtgattgcagataattaaaaaattattccaggtaatctttctgttttgaaaatgaggtagtaacaatgagagccaaggaagaaatgagaatttaaatgacagctcccctctctgcgatgtgatgttctgaatacttgtaagtcaaataccaatattcttgaaggtat

SEQ ID NO: 171397 - DNA, 601 bp, Human
aacctacagtgaactcagcattatatcaaaaaggttatactctagaggcagctattgtagatccttcagtggtcttcattaccatgaacaatgaagtactttgctgttactacaacagatgttaaacaagggctatcaaatatggtgatatcagtggagttgaagatatgcagattggctaaaatgttgtagagacggtttccattcttacaggctgggtgggaggattctagtgattgtagttctctgattctgaccatacaggtaacagaatcttgctttcctgtgatataatgaaacraaacaagcccattagatggcggcagggggcagggggcagtgaaatgttgataagaaaaacaatctactaataattctaatttaataaatatttgttgaactgctgttttgtctgaggtactgttataggtgatttgcagagttcaaagataaatcaagatagttaaaaatttaaagcagaaaattgtttacaattttttgatggaaacagacttgaggatgagaggatggtaaggtgagcccagtgtaaagtgtttcttcctgagggacatactgatgtttttggaaactaaataatgct

SEQ ID NO: 171398 - DNA, 601 bp, Human
aatttatgtaacttaaatcacattctcttcatcatggtgtacgtttatgaagttaatggcctttaaagctttcaatttagtttttatttaaatgtgaatgcaatgctgaaaaaaatctctctgtgtattcagtataaatacttatattcaagaaaacagtttaagttttaactgttgtaatatattttattgtttatctggtaaggttagctactattccgtcaaattgggctttctaagaaaggaccaatttttgtttttctttggatagttttcacaatagttctttgttctgtccttrtcttgcattttatcttagtcttatattaatttttcttcacacggaggtaatggatgatgtgccagatggtttcaaacacagactacatgacatatgctcagtttttgatttgaggagtttgtaaagattttcttcaaattgtgatagcaaagttccttaacttaattttttctgtaaacgatttgccatattaaggtaattaataggttcaagttccagagattaggagcttagtatctttggggaccaccattcagcccattacagtctgttttctgggccccaaatattcatatcctt

SEQ ID NO: 171399 - DNA, 601 bp, Human
attgtgatagcaaagttccttaacttaattttttctgtaaacgatttgccatattaaggtaattaataggttcaagttccagagattaggagcttagtatctttggggaccaccattcagcccattacagtctgttttctgggccccaaatattcatatccttcccatgtgcaaaatacatttaccctaccccagcgtctccaaaattttgactcattacagtattaactcaaatgtaaatctcacctaaatattaccagctcaaaaatcccaaatcccattatgaaaatcatttaaatcaggcatgggtaaaactctgagtattatccagggcaaattccatttggtttcaagacccgggagtaatcctctatctttaaatattttctaaagaaaaattctcaagaagtaaaagagcatatttactaaaaaaacctttttttttgtatattgctgaacctctcacagaaagtttttctaccagcaatatatcttattagtgattcttctacctagccattctgatcatcatgttatcattatgtatatataatataaaaccttcaaactttgccattttcatatgaacaaaagcttaaaa

SEQ ID NO: 171400 - DNA, 601 bp, Human
aataaagcattttacaaagcattttcatggtctgatttcaattgtagtgaaaaaatacatgtccctatctatgtatagaaaaaagtctgcagtagttagtaaactgattattttgagatacttggattgataagtttatgtaaaattttaaccctatgtattgtataggtgtatatgtaacatttttaatatatttgatctttttttgcattttctgcccttctaccatggtggttttacttgggtaataaaaaacattggtatctcttcccttcctaccctaaagaaacagcttcatggraataattatttagaatacttgtattactaacttgaagtttactctaccgtaatgtttttagcaaatttttcagattcttcactctgttgtttatattcattaaaatgagggaaaacgatatttattaaactgagggcattaagtataacactgaacagatggtaatatttttagaatttttcagtatatctactgagataattgatttttataatagtattttcacttgcaaaagtattaacttccctgaataatggaaacttgaagtgatagcattctatctattgtatcatagcctag

SEQ ID NO: 171401 - DNA, 601 bp, Human
tgaatttttccaattatgagatgtcagtataatttctctgactaaactctctgggaatattgtttattcttttccttctggagttccagttaaattgcaagttgcatttaggaaatttgactgtcttctgtccaactgtacaaattttcaccacttagtgacaaaatagagtcccatcttaataagctagattcctgcaagatttctatgtcatagtaaattgaaagagttgtgtacatgtgagtgtacacatatcagtggttatttcatttactgaatttttaaacaatagaaatgataytgtagcatcttagtgaaaatattagagcatcttagttaacataaagcaataccttcagaacaatattttacattaaccttcaattgaatttaagtgatgtgaaatattaaaaaacctcttcttatttcccatcctaacctatcatgaaaatgaaggccagtggctgtacttttataaccatgtccataaaaataattttgagctagtttcgatgttgagaactataaagcaagtggtgtaaggtatgattaaaaagctggcagatacatttttttttaagtaatttctcaacaatttgca

SEQ ID NO: 171402 - DNA, 601 bp, Human
agaaggaaaggatatagcagtaatcaccaaacttatcagatctttcttttttaaaagcctttttggacaaggagaaagacaacctgacttaaattaaaactggaaaaacattcatctatttgtactgtcttccctctggagtttctttatgtatgtggaattcatggagcaaaattttttaaaaaatagtaaacacagggtggaaaaaaactttcttccaaagttgagttcaggttttattttttgttttgttcttaactaatgttttataataaacctatagccagctagatttctcatyctttgtttcttcccagcaagtatttaaaatttgaaaggacatggtaataggtagttttaccttatgatagaatctttagagcttgattctggtatgtaaaaattttagacccagactttgttgtaagttttttattgtacaggtcaattgttctgggttaggaataggtaactactagcattgttactggtcagagataactgttttattacttagaacaacattatctcctctaccttcccagccccttccaaaaggtatccttttgtactcttcctctgagttgtttgccatcaagca

SEQ ID NO: 171403 - DNA, 601 bp, Human
ggtttctaggccttcatttcttctgaccatgaattctctctgatccagtgttctattgggaccatgatttgtccctcatattcactgcatgcctgcctcctaccatgtgttataggttatagttttttctgtttatttttaaaccttttattatggaaaattgcatacctacccaaaagtaaagtggtagatgaatctgtctttactgtcaatcagctttaacagcttcaacagttaatagcatggccaatgttgttttatcttttccttcaaccccttagttttaaccaaatctcagatrttatgcaatctacaaatattttagtatgcatttataaaagataagagctgcttttaaaagacataatcatagtaccattgctacatctagtagaataaatctttaatatcatcaaataagcagatgacctcattagtttttttatttttaatagtttgaagtgaggtctatacaaggtcctgcattctatgcagttagctgatcagtcttttaaactagagttccttctcttgaaatcgattagtttttctttgtgatacatttttatctactcaggcattcagaaatttaattctttta

SEQ ID NO: 171404 - DNA, 601 bp, Human
caaagtccctagttaataactaatattcctcgtatttcttgatgagccttctcagtagaactttatcttaaaacttagaatttcttcttctcttggttaaattgtgagaactgtgtcttataaacgttgctgtcttagaattaatgacgaggccgggcacagttgctcacgcctgcaatcccagcactttgggaggccgaggcaggaggattgcttgagccaagaagttcgagaccaggctgggcaacatggcaaaaccccatttctacaaaaatagaaaaaattagccacgtgtgatggygtgcgcctgtggtcccagctacttgggaggctgaggtagaagggtcagttgagccctggaggttgaggctacagtgtaccactgcactccagcctgtgtaagagttgagactctgtctctattaaaaaaaaaaaaaattgtttttaaaaagaaataacaatgggtagaaatttaggagtctggatttctatcctggtgttgtcgttatctctgtgtccttgactttatcacttaattctgctctcaatttaggcattgaattagaatagcgacatacactattttatataatgaatagga

SEQ ID NO: 171405 - DNA, 601 bp, Human
cgaggcaggaggattgcttgagccaagaagttcgagaccaggctgggcaacatggcaaaaccccatttctacaaaaatagaaaaaattagccacgtgtgatggtgtgcgcctgtggtcccagctacttgggaggctgaggtagaagggtcagttgagccctggaggttgaggctacagtgtaccactgcactccagcctgtgtaagagttgagactctgtctctattaaaaaaaaaaaaaattgtttttaaaaagaaataacaatgggtagaaatttaggagtctggatttctatcctggygttgtcgttatctctgtgtccttgactttatcacttaattctgctctcaatttaggcattgaattagaatagcgacatacactattttatataatgaataggaaggggagagaattaagccagccttgcactgccttctttaaataaagtctcatgtacaaaactgataggctaaaaagataaaggaggaactgtgctgactgaagtgtttgtgaggtgggagagagttttgtagcgttgtctgccttcattccccagaatagtcccaggacatctctggtggatttctaagtgtgaata

SEQ ID NO: 171406 - DNA, 601 bp, Human
ttttggtgttataaatcatctttgttcttgaatcagagactgaggcagacattagaagatagccctggttttttaacccacagtacttctaagtgctgctccttgaagatacatctgacttcttagctattgatgagttttccaaccatttctaatcaggcagttatgtttttgagttctgatttcaatcagaatattataaggccttttatctttgcagtatgtatgtttctggaaacttttatctattattaaggaaatttgctatatgaaggtaacttttttcagtgtgtttttttttaaattatctacaactgagtaacagtatgattatattattgttcttgagcaaatttgttttccccagagttaataactgcctcatatatggttcactgtgaatcttctctcaacatagttaaatacatcagttggtcactcagttctccccctctcccccccctttttttctttttttgagttagctatccatccatactcttgctttaatctggagtggttgcacttgaagtctgcttcacagggctgttgccattgttttgtgaatgcctgattctgattatctgtttccgggatttca

SEQ ID NO: 171407 - DNA, 601 bp, Human
tttggtgttataaatcatctttgttcttgaatcagagactgaggcagacattagaagatagccctggttttttaacccacagtacttctaagtgctgctccttgaagatacatctgacttcttagctattgatgagttttccaaccatttctaatcaggcagttatgtttttgagttctgatttcaatcagaatattataaggccttttatctttgcagtatgtatgtttctggaaacttttatctattattaaggaaatttgctatatgaaggtaacttttttcagtgtgtttttttttwaattatctacaactgagtaacagtatgattatattattgttcttgagcaaatttgttttccccagagttaataactgcctcatatatggttcactgtgaatcttctctcaacatagttaaatacatcagttggtcactcagttctccccctctcccccccctttttttctttttttgagttagctatccatccatactcttgctttaatctggagtggttgcacttgaagtctgcttcacagggctgttgccattgttttgtgaatgcctgattctgattatctgtttccgggatttcat

SEQ ID NO: 171408 - DNA, 601 bp, Human
tctggaaacttttatctattattaaggaaatttgctatatgaaggtaacttttttcagtgtgtttttttttaaattatctacaactgagtaacagtatgattatattattgttcttgagcaaatttgttttccccagagttaataactgcctcatatatggttcactgtgaatcttctctcaacatagttaaatacatcagttggtcactcagttctccccctctcccccccctttttttctttttttgagttagctatccatccatactcttgctttaatctggagtggttgcacttgargtctgcttcacagggctgttgccattgttttgtgaatgcctgattctgattatctgtttccgggatttcatctttttttatttttcactttcccactctcattttggtagagtatatattctaagtcttcctgagataagaattctttcttagtagtttttaattatttctcaagctttttgggtgtttgtatgcctgaatatgcctttgtcttttttcagacaggatcttgctctgttgccctggctggagtaaatggtgctatcatagctcgctgcagtcttgaaccactggactcaa

SEQ ID NO: 171409 - DNA, 601 bp, Human
tttcatctttttttatttttcactttcccactctcattttggtagagtatatattctaagtcttcctgagataagaattctttcttagtagtttttaattatttctcaagctttttgggtgtttgtatgcctgaatatgcctttgtcttttttcagacaggatcttgctctgttgccctggctggagtaaatggtgctatcatagctcgctgcagtcttgaaccactggactcaagtgattctcctaccttagccttctgagtagctggcactataggcatgtgccaccatccctggctcwtttttaaattattttgtagaggacagggtcttgctatgttgcccaggatggtctcgaactcaagctatcttcctgcctcggcctcccagagtgctggaattacaggcatgaaccactgcctggccttgaaaatgtctttaaataaataaccctcataatagatcagcagttttattgggtatagaattctggggtagaaatttttctccagaattgtgtttgtatttcgacaatgttttctattttccatggttactttaaaaggttagatgtgactttgattcctgaacctttgtatgt

SEQ ID NO: 171410 - DNA, 601 bp, Human
aaaatatatttgttatctggcataggcagaaatttctttgataggacaaagaaaccactaaaaaataataaattggattttatcaaaattaaaaatttctgctcatcagaagttttttaagaaaataaacaggcaaggccaggcgcagtggctcatgcctgtaatcctagcactttgggaggccgaggcaggcgggtcacttgaggtcaggagttcaagaccagcctgaccaaaatggtaaaactccatctctactaaaaatacaaaattagctggacatggtgtcgcatggctgtaaccmcagctacttgggaggctgaggcgagagaattgcttgaatctggaaggcggaggttgccgtaagtagagatcataacactgcactctagcttgggtgacaagagcaaaattctgtcagggggcggggggcggggaggaaagcagggaggaggagaggggaagggggggagagagagagagagagagagaaagagactagaagaaaacattcacaatgtatatatatatatctgacaaaggacttttgtatatataataaaccaaaactcaaaacaacccagtttacttttttgtttttgag

SEQ ID NO: 171411 - DNA, 601 bp, Human
tgtatatatatatatctgacaaaggacttttgtatatataataaaccaaaactcaaaacaacccagtttacttttttgtttttgagacaaaatctcactctgtcaccaaagctggagtgcatcatagcttagcctccagagtacctgggactacaggcacattacatcacacccgactcatttaaaaaaattttttgtagaggtgggatcttgctatgttgcacaggctggttttgaactctccttaagtgatccccctgcctcggcctcccagagtgctagtattacaggcattgagccrctgggccagcccaaagaacccaatttgaaaaatggtttaaagactctgatagacacttcacaaagaaggcattggaatggatgataagtatatgagaaacagccataagaacattagtaataagagaaatgcagactaaaacaaaaaggtgataccactacacttccacccgaagggctagaatttaaaagaccaggcaatatcttggcaaatatgtggtgtaagcagaattctcctatattgttgaggaagcagaaaatggtacaaccactttagaaaactctgctaggtttttaataa

SEQ ID NO: 171412 - DNA, 601 bp, Human
tatatagatccttaaagaatatttacacacaatagcagtttttttctgcacttttttgtagcttgattttttattcacttagtaacttagtacatcttgaaaatatttctgaattaacacatacccttttcctcctcctcctcttcttcttcttctttgttttttgagattttctcactcttgcccaggctggagtgctgtagtgcaatctcagctcaccgcaacctccacctcccaggttcaagtgattcttgtgcctcagcctcccaagaagctgggttttaggcatgcactaccacayatggctaattttttttttttgagacggagtctcgttctgtcgcccaggcgggagtgctgtggcgtgatctccgctcactgcaagctccgccttccgggttcacgccattctcctgcctcagcctcccgagtagctgggactacaggcgcccgccactgcgcccggctaattttttgtatttttagtagagacggggcttcaccgtggtctcgatctcctgacctcgtgatccgcccgcctcggcctcccaaagtgctgggattacaggcgtgagccaccgcgcccggcccacatggctaa

SEQ ID NO: 171413 - DNA, 601 bp, Human
tctaaacttgagtgagttttactagatttggggaagggattgatgagtgttccaagtggaaggaatcgcatgtatttgaaattatcaaggtgggaaatattcaacttgtcatggaatggaaggaatggcagttcacatggagggtgactgaatgagaaaggaaaaacaaacaaatttagattaagggtgtagagacagttaggtatggagagatgggccacataatgtagggccttgtagataaagagctggatgacatccaaagtgcagtggggagttatggaaaagttgtaagtaggtsagtgatttacaatttaaactgattatttacagtctaaagtaattattctggctgccgtgtggactatgtactgaaaggaggtaagaatatagttagggagacctgataaaactatggtaatgtaggtaaagcgtaatagtcacctatcatgacttcaatagtattaaattgatgacagtacatgtagagagactgtaaagacattttggaagtaattaataaatattggtgataatttgaatgtagatgatgacaaggaggaaggtgttcatagtgacttgtagaattctggcttgaatt

SEQ ID NO: 171414 - DNA, 601 bp, Human
cagttaggtatggagagatgggccacataatgtagggccttgtagataaagagctggatgacatccaaagtgcagtggggagttatggaaaagttgtaagtaggtcagtgatttacaatttaaactgattatttacagtctaaagtaattattctggctgccgtgtggactatgtactgaaaggaggtaagaatatagttagggagacctgataaaactatggtaatgtaggtaaagcgtaatagtcacctatcatgacttcaatagtattaaattgatgacagtacatgtagagagactrtaaagacattttggaagtaattaataaatattggtgataatttgaatgtagatgatgacaaggaggaaggtgttcatagtgacttgtagaattctggcttgaattaatgggtttagttgcgattactgtgatggagactactgggtatggagcatctgtaaataggggtcatagggcaagatcgagttttagataatatttaagtttgagggacctgtgacattttattagggatatcaaaacatacatatatatattatatatatatatagcgtgtgtgtatatgtatttatgtataca

SEQ ID NO: 171415 - DNA, 601 bp, Human
tctgtgcttatgtgcatgtatcacatactctggtgttgaaaatatgagtctggtgccagaagtgaagttgtagattggagataaaaagttgaaaattgctgccatatagatgaaagggttgcctaggaagagagtgagaatgtattttgatgagaaaattgtgtccagggctgagccccaagaaaatctaacatttagaggttggatagaagaggagggacaggcaaaaattaaaagatgcttgataattaggaagcaaactggtagtgcatgatgttatagaaatctagcattgtttcaragtgcagttgggaaggaattgtggttggctatgtctaatgttctgagaatgctagtaaagctaccttgttggcaaaaactcctgagatacactttaaactactcttaatttcttacttacttgggaagaggttttagctgccactggaaattggggcctaaacagggaaaggatctcatgaaaacatgtaacctatagatttagggcagttttccttaccttttcttgaagaagcatagcccagaaaaactgttctaagggtaaacttagagtacaactgacacaggatcagctcttagg

SEQ ID NO: 171416 - DNA, 601 bp, Human
agatacaaattcccttgaatccaactacaattagacttttaacttttaatttttctgttagtgtcatgagtatatgataagaatatcataaggaactagaataaaatcaggtataaagcatagattgggattaaattgagctggttgatcatagttcacatgtacaggctaaaatttaagcagtataaggtactcatgaataccctagatttcaggtctttgtgttatgtaaaatacacatgttcctaaatgtgtctatacataaaatttatttctataaaattgttttccttttctcatygacatgtttaaataagtgtctcaaaaataataaaagtaagcttgagggtgtttaataagtaggtgttcaaaacacaactcacatagtattaagaattagctaacagatcacaaatgaaaagtagttgagactcttggtttttaatttgctttaagaactaaatttctgactttgtaaaagcaatctgaggtttgtagtacaaaatgatatatgagtagcagtgtcctgctaaaatatttattaagaaacaaagatgaaaatatgaaacactgaaaattaagatgacttaactccctatag

SEQ ID NO: 171417 - DNA, 601 bp, Human
tcaaaacacaactcacatagtattaagaattagctaacagatcacaaatgaaaagtagttgagactcttggtttttaatttgctttaagaactaaatttctgactttgtaaaagcaatctgaggtttgtagtacaaaatgatatatgagtagcagtgtcctgctaaaatatttattaagaaacaaagatgaaaatatgaaacactgaaaattaagatgacttaactccctataggatctgataatggatactaatagtaacacagccagaataaggaaaatttttacccagggattctttyatagcagagacttcatcccttttcatgttcatttcttctcctgcccacactggtaactaccagaaaaaaactggggagagatgggaagagggaggatgctgatgaattttatctgggaagtgtcattatgagtgaagtgtactaggtggaagtagagaaggattgtagtaacagtatagtgctgcccagtatagacttaggattgtatttttatattgctgttatcagtccagaatacagtattagagaccaagaaaattggagagaggagaatttaccatgggagcagtgagtgctctg

SEQ ID NO: 171418 - DNA, 601 bp, Human
ttttttttttttttctgagacggagtctcgtactgttgcctgggctggagtgcagtggcgtgatctcggctcactgggaacctctgcctcccgggttgaagagattctactgcctcagcctcccaagtagctgggattacaggtgcccaccaccacgcccagctaatttttgtatttttagtagagacgggggttcaccatgttggccaagctgagctcaaactcccgacctcgtgattcgcccacctcggcctcccaaagtgcggggactacaggtgtgagccactgtgcctggcctctygttgtagtttttgtgtttagacatttgatttggttattttttctgtcttccacgtctatatttaacatactctatccatcctttcgtttttttaatatatggaacgtggtaaatgtttcattgtctttattctagtatttttgtcatttctggtcagttgcaattgattgatgtttttctcttcactatgggtcatgtttttctgcttttttgtatactgtggtaattttagattgcatcccagagattattgtgtgatggctgtttttgtattttcatgaatgtttttgagttttgttc

SEQ ID NO: 171419 - DNA, 601 bp, Human
ggctgtttttgtattttcatgaatgtttttgagttttgttctttggttaagttacttggagatagtttgatcctttcaggtcttgctttttagctttcgcagatgagactactctagagctaattttgccttactagtaaggtaaaatccttctaactactttattggtttccaatcaggaagctttccactccagtggctaagaataggagctgccttgtatgagcctgggtatcatgccttcttaatccttttaggtggcttattcttcaggcttgtataggttcctcacaatcatccrctgatcaaggagggccctctgcatatcggtggggttctctttctgtgtagctgtctcttatcctgtactctgccatgtgaactttggctaccttggtctccctagattcccagatccttgtccgcaactcaagggtactgccaggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctata

SEQ ID NO: 171420 - DNA, 601 bp, Human
tttgccttactagtaaggtaaaatccttctaactactttattggtttccaatcaggaagctttccactccagtggctaagaataggagctgccttgtatgagcctgggtatcatgccttcttaatccttttaggtggcttattcttcaggcttgtataggttcctcacaatcatccactgatcaaggagggccctctgcatatcggtggggttctctttctgtgtagctgtctcttatcctgtactctgccatgtgaactttggctaccttggtctccctagattcccagatccttgtcckcaactcaagggtactgccaggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctatatattctgtctgtttttttcagttgttttaggtatgagggtaagtctgtctcctgatacttcatagtaggacaagtggaggtgccacattgacactcactgtgagatggaaacaggaattgtgga

SEQ ID NO: 171421 - DNA, 601 bp, Human
agtaaggtaaaatccttctaactactttattggtttccaatcaggaagctttccactccagtggctaagaataggagctgccttgtatgagcctgggtatcatgccttcttaatccttttaggtggcttattcttcaggcttgtataggttcctcacaatcatccactgatcaaggagggccctctgcatatcggtggggttctctttctgtgtagctgtctcttatcctgtactctgccatgtgaactttggctaccttggtctccctagattcccagatccttgtccgcaactcaaggktactgccaggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctatatattctgtctgtttttttcagttgttttaggtatgagggtaagtctgtctcctgatacttcatagtaggacaagtggaggtgccacattgacactcactgtgagatggaaacaggaattgtggaactagggaata

SEQ ID NO: 171422 - DNA, 601 bp, Human
caggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctatatattctgtctgtttttttcagttgttttaggtatgagggtaagtctgtctcctgatacttcatagtaggacaagtggaggtgccacattgacactcactgtgagatggaaacaggaattgtggaactagggaataatatctwgaagactttgagaaagagcatctccaaacaagatatcttgcaggattcaaaatagtttcttacaatagtgactgacattgttaatacagtgaaagaagtcatggcgtttataaaaatggattggaaaaatctcgaggagagaacagactggatggatacgcaacaagattatagaaagggggcagatgaggaaaagacataactagggacctgaaaagcagtggtagagtgaaatcccttttgatgcaattgtgaatataaatgatactgcatgacagcaaaagaaaagaatttgagggc

SEQ ID NO: 171423 - DNA, 601 bp, Human
cacttttccatagaaaagtccggagataagcaggctagggttggtgtagtagcttcactgttattggagtcaatgctattttctgctccatcattctcaggacattatttcagttctgcagggcattgagtgtggctggagctctagtcattacctacattccaggcaacaagaaggaggttggaggaaaagaaaaagagtcttttttccaactgagttagctccttttaagtactgtgttcctattttccacctctaactgcaaggaatgttggtgacttagcttggcctgcaaaatacyacatactaggtggcttaaacaacataatttatttctcacaattctcgagactggagagtccaagattaaggtgctggcaaggtaggttttaacctgaggcgtcctgccttggtttataggtggccacctctcactctgagctcaagtgacctcttgtgcatatgagaagagagtgaactctgtggtctctcttcttgtaaggacactaatcccagtggattagggccccacccttcattaaccttcattgaaccttcattatcttcttataggccctgtcttcagtacagtcacatttgg

SEQ ID NO: 171424 - DNA, 601 bp, Human
taaggtgctggcaaggtaggttttaacctgaggcgtcctgccttggtttataggtggccacctctcactctgagctcaagtgacctcttgtgcatatgagaagagagtgaactctgtggtctctcttcttgtaaggacactaatcccagtggattagggccccacccttcattaaccttcattgaaccttcattatcttcttataggccctgtcttcagtacagtcacatttggggttagggccttaacatgtggattttgagaggaaacacagttcagttcatagtagttgggaaatgtmgccttttagctgggtgcattgctgccacacataaatgaggatcctgttagggaggatgaagaggagaatggatgttgggtgacagctgatagttactgccacagcggctgttgtctgagtttcccaggttggtaatgagaaccttggggttggaaccttatgtagtgttcattggaggcaggtaagggtgatctgtataaaataatgcacagaaaattatgaagggaaagatgagggatatttaggaattatttttattttggggggtacatggtgtatatatttatggagtatgtgaga

SEQ ID NO: 171425 - DNA, 601 bp, Human
aaggtgctggcaaggtaggttttaacctgaggcgtcctgccttggtttataggtggccacctctcactctgagctcaagtgacctcttgtgcatatgagaagagagtgaactctgtggtctctcttcttgtaaggacactaatcccagtggattagggccccacccttcattaaccttcattgaaccttcattatcttcttataggccctgtcttcagtacagtcacatttggggttagggccttaacatgtggattttgagaggaaacacagttcagttcatagtagttgggaaatgtasccttttagctgggtgcattgctgccacacataaatgaggatcctgttagggaggatgaagaggagaatggatgttgggtgacagctgatagttactgccacagcggctgttgtctgagtttcccaggttggtaatgagaaccttggggttggaaccttatgtagtgttcattggaggcaggtaagggtgatctgtataaaataatgcacagaaaattatgaagggaaagatgagggatatttaggaattatttttattttggggggtacatggtgtatatatttatggagtatgtgagat

SEQ ID NO: 171426 - DNA, 601 bp, Human
ccaatcttctcattgggtgtgttttctactgtttatgttctttctttcctaggcctcttacgtagtttaggacagaaattgattgactccagagtttaatggaaaggttctggtccagttcctgtatctagtcagtccagtgctgtatctgtgtatagtcctgtggaagccattgtggttgtacctactgttaaagcaattgctgtgaaatggactcagttttgctggaaagatcgctagcccagtataaagacgaatgtatgaacatgccttggtgatgtcataactgtggcatgtttttctgtggtttttacagcactttttctttctaaatgagaaacttggaactctgggtaggaatcacattctcctcttttagcagctttgctgagatgtaattcacatattctgcagttacacatttaaagtgtatagttcatttgcttttagtatatttagtatatttacagaattgtgcatctgacaccttattcagtttttggatattagcccaagtaggtaccctgtatcacttcgctttcaacttactcagttttaaaaagaaactacagtgagctaaactattagtagagatattcca

SEQ ID NO: 171427 - DNA, 601 bp, Human
aaccattctactaattggagaaaactttcctaaattttggaagaagaaaaataatgaccaagcacataaactttgcttgtttgcatcataggatcagagtttaaaagagatcctgatcatttagtatgaaactgaaaaatgtagttgatatttaatgaattctttcattgtgtgtatggttgatagtttgttcctacacattggggtttggtgtgtgtgtgagagagagcaagagagagaaacagattgattttacatttttcattggatttacttttttacaaagcatggttagaagttrttaatactttgatctccaggttgagattttggagatgattttttatttaatggaaatatgtaatgagtgagctcttttgtctacgagccactcattttttatcccattgctttatcgaacgagggctgaaaatttcaattttgaatagcacatggcaattttcctcttagagccagctagctattcagttaactgttctcccacctcaggatggtattaacaagaacaggacagtatactaaggcactagttcccaaacattactggaatcatctgggggtctttaaaaatactgttttc

SEQ ID NO: 171428 - DNA, 601 bp, Human
gaaaatttcaattttgaatagcacatggcaattttcctcttagagccagctagctattcagttaactgttctcccacctcaggatggtattaacaagaacaggacagtatactaaggcactagttcccaaacattactggaatcatctgggggtctttaaaaatactgttttctgactcctgtccctggataattcagatgtaattgctatgggacgatacctgggcattgagatttttaaaatctcccccaggtgattgtaaggtacagcaaaccttgggaatagttgtactaactgaasattgaggcactggaataactaatgttgggtaagatagggtaagaactttttcgcaataaggtttgcagctcttgggattctcacttgataatgctgtttggataaaccatcatccaagtttgaataagatcttatatttagaaatgaaaactgatctgcagaattagtttaatcaataaatgggaatttttaaaaatcttcttggcaatttgtttttatgaatcccgttgaagctgtgtctattgactacctaaatctagatcattcttaatccagtgtgtaaaaaaccaggatgacaca

SEQ ID NO: 171429 - DNA, 601 bp, Human
tatactaaggcactagttcccaaacattactggaatcatctgggggtctttaaaaatactgttttctgactcctgtccctggataattcagatgtaattgctatgggacgatacctgggcattgagatttttaaaatctcccccaggtgattgtaaggtacagcaaaccttgggaatagttgtactaactgaagattgaggcactggaataactaatgttgggtaagatagggtaagaactttttcgcaataaggtttgcagctcttgggattctcacttgataatgctgtttggataaaycatcatccaagtttgaataagatcttatatttagaaatgaaaactgatctgcagaattagtttaatcaataaatgggaatttttaaaaatcttcttggcaatttgtttttatgaatcccgttgaagctgtgtctattgactacctaaatctagatcattcttaatccagtgtgtaaaaaaccaggatgacacaaatgaaaaacttcaaaaacctggaggtcagactattttagtaatttagaaaacatttttcccacacattaatcagtactaaaagaaaaaagttaaaacctatttaaa

SEQ ID NO: 171430 - DNA, 601 bp, Human
cagcacactgggttgggcaaggtgcggggctagggctaacagcagtcttactgaaggtttcctggaaaccacgcacatgctgttgccactaacctcaaccttactcggtcctgaccggctcggcttctgtttgtttatttcatctctactcagtactgccctgttccctggttttaaagttgtactgaaatgcataccttgtgataatgttgtcacattttgtccttattgtgtcgtgccacttaatatgttcattaaaaaaaaaaaatggccagaaacagagatttgatccatagacaayacctggcaagcttatgctggtacctgtaaagaactggtggtttccatctgactcctagtttcatgtaattgtaatttattcatttgtttgtttagatgtttaacaaatctttgctgtatgtaagatatttcaggaaaatcagcaacagggggaacaacttgcaaaaacaaaggaaaaaaagctagctgtggccataccctctctgagcttaaaattcctatgggaacaaaaatgtttcagtttacaagaattcagaatggatttgcatatagtccaagctaatcatcttcctattagtgt

SEQ ID NO: 171431 - DNA, 601 bp, Human
acgcacatgctgttgccactaacctcaaccttactcggtcctgaccggctcggcttctgtttgtttatttcatctctactcagtactgccctgttccctggttttaaagttgtactgaaatgcataccttgtgataatgttgtcacattttgtccttattgtgtcgtgccacttaatatgttcattaaaaaaaaaaaatggccagaaacagagatttgatccatagacaatacctggcaagcttatgctggtacctgtaaagaactggtggtttccatctgactcctagtttcatgtaatygtaatttattcatttgtttgtttagatgtttaacaaatctttgctgtatgtaagatatttcaggaaaatcagcaacagggggaacaacttgcaaaaacaaaggaaaaaaagctagctgtggccataccctctctgagcttaaaattcctatgggaacaaaaatgtttcagtttacaagaattcagaatggatttgcatatagtccaagctaatcatcttcctattagtgtcctattttgagagtttgtcagagtggttgataagagtccttagttttttcttgacatttgagaatgaatt

SEQ ID NO: 171432 - DNA, 601 bp, Human
taaaataaaatgttttattggaatgtgaaatgatttctgtattcctattttgtgccactgcagtgtaagtggaaagagtcattttatttagactcctggatgaatgttgtgttgtccctttgtgctacctgtgtgtgacatccagttttagttggctggatcttaagggaaaggtttcctatatagttaaagttgtaaacttttctttcaggtactagggaaagtaattttaaaaaattatttcctgctttttacagtttgtgttatgtgtgcttcaactttgttgatgaacattattaamcattttagtaatatggattgattttagccattgttaaaaaggtcataaaggtaaagagggtacttccttttgacacttaaaagtttttctcactgattaatttgataatattttgggttgtataatgcttactcaagttttgtaggaattcaagaatgaaaataggaaattgttgtccatcatttgtaatgttacattatcagtggctactggctactgtgacagttccagttgggatgctattaaaaatcccagctgtacttgaagaactttcaaggcagtcatgagacctacaaactg

SEQ ID NO: 171433 - DNA, 601 bp, Human
aatgtatgattaaggaggtgtttgatttgagactttacggttttaaaggaaccatgagacggtggttcacacagctgagagctttccattgctgttggtgaaatgagaaacacgcttgaagtaactctgtgctaacatcttaatacacactttgagaataaagaaggattgcattattagatgttaagctggaaatgatccttaagatttacttgcaatatctgtagaaaagtgaactgtgatattagcttgatttttttctttgtattattcctcatttttagttctgaggaattccttycccaaatttattttgccatatataagaaatatttgaaaaaggtgacttcttagtaaccagagttaattaccccaaagacttaatctaaaaatcagttttgatataatcagatttagtgaggtaacattgtaagagttatacttaaaacaattttttgatgtttggtttgaggacagtctcccaagctatcggtgagtttctgcattaggacctaagatgtgaacatggtttaccctttagttttaattgcacgtgcttgggaaaagggtcttgctctcctgtgagtgggagtaatttgta

SEQ ID NO: 171434 - DNA, 601 bp, Human
tgaacagtcactgtcctctacataaagtaggtgcctgctcagctctctggcaggtggaaatgggagaggatggcaatacaacacatcaattaacatatagatgaggagtacctcatctatatgttaaccagctctctggttaaatgtagcggggtaaagcccagagttcagaccaaatgtttgaagaggcagttaggattaggtttctgagctagggtaattcagatctgggagaaacacctagcatcatcagtcagaatcaggatgccacagaaaatctagggacacaggagaaaagagagtaaatgaaatgtcacagcttagaccatgggcttacaagctcagatggctgacagagggaagaatgactgtaagcctctgatgcctgacagtatattctccacctgactctgcctgcagtgtaaaaaatcctgcatgcctagagtaccagcttccctgttgttttctagcagactcatgtccagattgacttcttgaaggtatgcatgcccttttcatgtttgtagaatatgtgcgaaaaaccaaagaaacgtgaaaaagtaagaatgaaaatgagagggagtataaggactgaagtacc

SEQ ID NO: 171435 - DNA, 601 bp, Human
agaatgaaaatgagagggagtataaggactgaagtacctgtcactaaagatgatggcaggcagtggaatctgaattgttgtgtgaagggttaatactgtaataaagctgtcatctcattgaagaactgaataatattgagcaggtaggtgggaataagaatgtgtcatgttaaatttgtcattgtggatcattatgatgacttttcagtcttctgcttgagaaattatctgggttaatcaggaaaaacagatctgttgtttgagggtaggtgcataggccggactgagttagcaatgtgayctggtatgcaagagtttcaagtattttctttctgttggagatctgcctaacttgtcttgttcttttgaacctcagctctaccctttcacctctactgtttcattgatgtgagtcttgctgattctggcctgttaacctgattttgattcctgcaatcctgcctctccttgattatttggattttgactttagtgtccttgacctggagttgagacccagcctaatcctgatgcttgatagtaaggactagagccctctgctgacagtatcagcagcccacagctcagctgttccctgagt

SEQ ID NO: 171436 - DNA, 601 bp, Human
gctgtcatctcattgaagaactgaataatattgagcaggtaggtgggaataagaatgtgtcatgttaaatttgtcattgtggatcattatgatgacttttcagtcttctgcttgagaaattatctgggttaatcaggaaaaacagatctgttgtttgagggtaggtgcataggccggactgagttagcaatgtgacctggtatgcaagagtttcaagtattttctttctgttggagatctgcctaacttgtcttgttcttttgaacctcagctctaccctttcacctctactgtttcattkatgtgagtcttgctgattctggcctgttaacctgattttgattcctgcaatcctgcctctccttgattatttggattttgactttagtgtccttgacctggagttgagacccagcctaatcctgatgcttgatagtaaggactagagccctctgctgacagtatcagcagcccacagctcagctgttccctgagtagaacggaactttaatctgctggttgagtaggcctccctggtgtagatagtatggtgagtatgggaagtcaggtatcagaaaagtatggcttggcttgttttcct

SEQ ID NO: 171437 - DNA, 601 bp, Human
actaaatcccaacttacatagttatctggagaaaaacctgttttttgttttgttttgttttgttttgttttgtttttgagacagtttcactgcgtcgcccaggctggagtgcagtggcacaatcttggctcactgcaacctctgcctcctgggttcaagtgattctcctgcctcagcctcccaagtagctgggactaaaggcacgcaccaccacacccggccaatttttgtattattagtagaggcggggtttcaccatgttggctaggctggtcttgaactactgacttcaggtgatctkcccgcctcagcctcccaaaagtgctgggattacaggtgagagctaccacgcccagccaaaaacctgtcttaccatacctcactctgcgtgggtgtcatttgaaccagtatgtgatatatttcctgcatattttctatcattctttgtcatcttatggctatgcctctgaaatttgttgtatatgtcagatttctattgttacctcactttattgtcgtaagtactgaaatgatgatctgtcatttatggtcttcagacccttaaaaatttcagtgctaagattgacattgtttctttaaa

SEQ ID NO: 171438 - DNA, 601 bp, Human
gtcttgaactactgacttcaggtgatctgcccgcctcagcctcccaaaagtgctgggattacaggtgagagctaccacgcccagccaaaaacctgtcttaccatacctcactctgcgtgggtgtcatttgaaccagtatgtgatatatttcctgcatattttctatcattctttgtcatcttatggctatgcctctgaaatttgttgtatatgtcagatttctattgttacctcactttattgtcgtaagtactgaaatgatgatctgtcatttatggtcttcagacccttaaaaatttcrgtgctaagattgacattgtttctttaaatgtggatgatgtggttagtaaagaggaagaagatgataccactcttaccaaggcatgtcaaacttgttccattaacttggtcctcagggcagctcttcccataatgtaatataacacatgcttttggaactgaactcccaggtgctctgataatacgtagcagaaggtaaggtaaaaggaattaagtggatctcagtatccccagtgagaagaatggggtattactattaattaattaattaattaatggggctaagatacaactgagagtt

SEQ ID NO: 171439 - DNA, 601 bp, Human
gcagtggattccccttcacattaatgacagtaaccttaagagggatctttagcagggattacttaatgaacaatgaagggtatgtttatggcatagcagtattggtgtttgtagatcacagaaactggatgcgttttcaaaatattacaactgtgttgtaatattatatataaattatatataatatattacatataatatatattaaatattaaaattacaatattaaatataatattaaatatacaatatttaatatattatctataatatgtatgtaatatataatatatattaaattatatctaatatataatatatattaaatatatataatatataatatatattaaatatattatatataatatgtaaaagattaagataatctttgttcttttcttcttttgatttttaatgctgaacctttgctatatcactctttattttctgtggagaggaggtcccatgtgctgtgtttgctcatgtactagttctaggatttctgcatgggtaattaaatatttactaatatctacctggtacaaaaggtggacaactgtcatcatagggagcttttgatttgcttcttgtcttgggt

SEQ ID NO: 171440 - DNA, 601 bp, Human
ggattccccttcacattaatgacagtaaccttaagagggatctttagcagggattacttaatgaacaatgaagggtatgtttatggcatagcagtattggtgtttgtagatcacagaaactggatgcgttttcaaaatattacaactgtgttgtaatattatatataaattatatataatatattacatataatatatattaaatattaaaattacaatattaaatataatattaaatatacaatatttaatatattatctataatatgtatgtaatatataatatatattaaattatatmtaatatataatatatattaaatatatataatatataatatatattaaatatattatatataatatgtaaaagattaagataatctttgttcttttcttcttttgatttttaatgctgaacctttgctatatcactctttattttctgtggagaggaggtcccatgtgctgtgtttgctcatgtactagttctaggatttctgcatgggtaattaaatatttactaatatctacctggtacaaaaggtggacaactgtcatcatagggagcttttgatttgcttcttgtcttgggtgtggt

SEQ ID NO: 171441 - DNA, 601 bp, Human
taccaatgacttccaggtgccatgttgcacaaaaagaaggaaagcagcctttcaacaacttggaatttgggacatttctatatgattgggactgttcaccaagtggatgttgctgtgttttgtgacgagatggagtagaggacaaggggatcatttgtaactgaacatttttagcttgtcctatgggacttgttaactttctattaccgcggcctaatccatacagaactcccaacaactaaatttgtggctgatccaaccaatggcatgagttggactgacagttttagaaaaaatacgstttttggaatttttttttaattggacaagaaccatgcataatattaatagtcttaaagccagagaactgggaatgtaatctttttttcctgtgtctctaagtgactctcaattggagtgatgttggcatttctgacctgtatctacctgctgtttttattggcatttacctgctttattgggcttatatgcaatcttgaatacagatttggacaccaattaaaaaaaattaacttcaagtttataaatttctttactatagaaaactacttatatatgtagagtagtaatttttgttttg

SEQ ID NO: 171442 - DNA, 601 bp, Human
ttgttaactttctattaccgcggcctaatccatacagaactcccaacaactaaatttgtggctgatccaaccaatggcatgagttggactgacagttttagaaaaaatacgctttttggaatttttttttaattggacaagaaccatgcataatattaatagtcttaaagccagagaactgggaatgtaatctttttttcctgtgtctctaagtgactctcaattggagtgatgttggcatttctgacctgtatctacctgctgtttttattggcatttacctgctttattgggcttataygcaatcttgaatacagatttggacaccaattaaaaaaaattaacttcaagtttataaatttctttactatagaaaactacttatatatgtagagtagtaatttttgttttgattttcaatgttttctttatgttatattccaaataaagtaaaacttgaaataatctgaaaatactttttattattgggaaagagatgtggattctttttcaagaaacacaatttaattttcctggaagcgtgtaataacttaagctaagttagtaaagtagtgttaagtaaaagagctcagtaacccca

SEQ ID NO: 171443 - DNA, 601 bp, Human
ttcaatttttaggtagttatgctcctttaatgttagaagatcctggactcacttgattcaaatgtagaagtctttcccatagatattgttttgatggttcattagaaaaactttcttggtagtagctttagtctcttaagtattctctaatttgaattgttgattgtcattatgtattctacttgagttatttattgagttattaaaatcactaatttgaagttactgctattataggcatgtgtttgtagttgatccccttttggggtcctttaggccttttgaaatagtttattaattsctcacatatgataaatgttacagttcaaccctaaaacattagtataattaagagttagcaggtcggtcacagtggctcacgcctgtaatcccagcactttgggaggccgaggcaggcggatcacgaggtcaggagatcgagactatcctggttaacacggtgaaaccccgtctctactaaaaatacaaaaaattagccaggagtggtggcgggcgcctgtagtcccagctactcgggaggctgaggcagaagaatggcatcaacccgggaggaggagcttgcagtgagccgagatcgcgc

SEQ ID NO: 171444 - DNA, 601 bp, Human
attgctcacatatgataaatgttacagttcaaccctaaaacattagtataattaagagttagcaggtcggtcacagtggctcacgcctgtaatcccagcactttgggaggccgaggcaggcggatcacgaggtcaggagatcgagactatcctggttaacacggtgaaaccccgtctctactaaaaatacaaaaaattagccaggagtggtggcgggcgcctgtagtcccagctactcgggaggctgaggcagaagaatggcatcaacccgggaggaggagcttgcagtgagccgagatcrcgccactgcactccggcctgggcgaaagagcaagactccgtcttaaaaaaaaaagttagctgtatttgttcaattccaaacaattcagatgcaataccagcagctacttttctacctactgccagatacttagacaaaatgttcagagaatgtggggaggtgttgatctcttgaaaagcacaatcaatttcatgttagactagtaggccattcagctgctctgtgttctattttgtactaaagtgacattaaagaatacttacagatgaataggttttcctgccagtgctgatgatctca

SEQ ID NO: 171445 - DNA, 601 bp, Human
cctaaaacattagtataattaagagttagcaggtcggtcacagtggctcacgcctgtaatcccagcactttgggaggccgaggcaggcggatcacgaggtcaggagatcgagactatcctggttaacacggtgaaaccccgtctctactaaaaatacaaaaaattagccaggagtggtggcgggcgcctgtagtcccagctactcgggaggctgaggcagaagaatggcatcaacccgggaggaggagcttgcagtgagccgagatcgcgccactgcactccggcctgggcgaaagagcaagactccgtcttaaaaaaaaaagttagctgtatttgttcaattccaaacaattcagatgcaataccagcagctacttttctacctactgccagatacttagacaaaatgttcagagaatgtggggaggtgttgatctcttgaaaagcacaatcaatttcatgttagactagtaggccattcagctgctctgtgttctattttgtactaaagtgacattaaagaatacttacagatgaataggttttcctgccagtgctgatgatctcaaagatagagctgtgctaggaactctctacattc

SEQ ID NO: 171446 - DNA, 601 bp, Human
aacaccttttaatagtgagaggtagaaatcttccccaaccaaagggttatttgatttttcttctctacttgtctctaatattaaacaactcttcgtctgttttaaatttagatatataggattattaagattcttttataaataattaccttcctaaattagcattttcacagctacacttttagagttattttttaaaaaacaggtataaaggtagaatatttacaaaaattattacatcatgctttgaacaaatacagatcacatctctgggctattttgacttttaaaaatatccttyttgagcaaacatgctgaagttgatttaaaagtaagattattaatccataaactatgaaaataatcaaaatgagaaagaagggaaactttccttaacgttaatagaactagtcttattttgtttccatttttcattcttactttagtgcttgtttatctgagcattgatatttaatataaaagttgtaggtaaatctgtgtctgtaacatagatgccagttactaaattttatttgcttatgaaatactgtaggtagcaagctgtaaattttaagtagcaaaattaaatttgtttggaata

SEQ ID NO: 171447 - DNA, 601 bp, Human
gatatactgaatttattaattttcttccatcatttcacatcagcattccgttacatcagtatacagtcatgtattcatgtgcatgactgtatcttggacctaaatattatgtaatgttattctaaatgtttggaactttcttcatgttgcacaagaatcttaccatatcttcctccctttattcccaactatgaacttttcttcacgatcattaaatcatcacaccatatgcagaacaatagttaattagttaattagggactgaactagattttctctcctaactagattctgtggtcarctttttcagtgctgtattcgttttcattatagactttccccagctctacctgaaccctaaatcacctccatagtgctggaatataccaatttatttcatttgttcatttatttaatcattcatgtaccatttacacacctagccttgggctagatagtgtgggaatctgattgtatgaaaagaaagcagagtaagtcatattcatgattgacaaagatgtggaaacaaagcacggaagcttggagtggtgtctgaacaatattcccatggttttgttatcatggatagctgagtcacatt

SEQ ID NO: 171448 - DNA, 601 bp, Human
cgttacatcagtatacagtcatgtattcatgtgcatgactgtatcttggacctaaatattatgtaatgttattctaaatgtttggaactttcttcatgttgcacaagaatcttaccatatcttcctccctttattcccaactatgaacttttcttcacgatcattaaatcatcacaccatatgcagaacaatagttaattagttaattagggactgaactagattttctctcctaactagattctgtggtcagctttttcagtgctgtattcgttttcattatagactttccccagctctrcctgaaccctaaatcacctccatagtgctggaatataccaatttatttcatttgttcatttatttaatcattcatgtaccatttacacacctagccttgggctagatagtgtgggaatctgattgtatgaaaagaaagcagagtaagtcatattcatgattgacaaagatgtggaaacaaagcacggaagcttggagtggtgtctgaacaatattcccatggttttgttatcatggatagctgagtcacatttggttttatgtctcagaaaggttgaagggagttgacatatgcagctgt

SEQ ID NO: 171449 - DNA, 601 bp, Human
atcaagtaatttttcatcatccaccccgttcaactcctccctcccttctgtgtctccaaggtctccagttccgtattctgtccatgtgtgcacatgatttagctcccccttataagcgagaacatgcagtatttgtctttctgtttctggtttgtttcactaaagataatggcctccagtgtatccgtgttgctacaaaaaaaaaaaaacatgatttcattctttttttaatggctgtcactgtctattgtgtatatatgtcacatttttaaaaatgtggacatttaggttgattctgtgrctttgctattatacatagtgctgccataagcataccagtgcagatacctttttgatataatgatttatttttctttgggtagatacccagtagtaggattgctggatcaaatggtagttccactaattagagattaatcttgctgttgggtaatattgagcttctgaaagttccgtcacttattcaaagcagtgaataatccttaatactgaagttggtaacttctatgttgccactatcttcaaccatgcatacttctttctaggatggaaccaacctcaaaaagaaaagtccaaagta

SEQ ID NO: 171450 - DNA, 601 bp, Human
cagtattaagtctgttgacccttttttgtggcatctcactttattattttacatcttctttaatttttctcagcaatattttatagttttcgctgtataagtctttcatgcttttgctagagttgcccttaagtgtataatatttttaatgctaatacgtatttttaaatttaattttctcatgtgactaaatgcacaaatatcatttgatttttttatattgatcttgtgtgcagcaaccttgctaaactcaaattccagtagctttttttacctgccttcagatttactacatagatcrtcattttgtctgtgaataaagagagttactcctttctttcccaattagttcctttatttatttttgtcttgccttattgcactggctggaaccttcagtatgctgttgagtagatacagtgagagtagacatccttgttttttttcctgatcctagagggaaagcattcatgtttccttcattaaatatgatattagctgtggacttttcatatatatatatttttaatcaggttaaggaagtttctttttactcctagtttgctgagagattttgtcaggaatggatgttagatttttg

SEQ ID NO: 171451 - DNA, 601 bp, Human
ttttactcctagtttgctgagagattttgtcaggaatggatgttagatttttgtcaaattctttttccagatccttgagatgtttttgagatgtatggtttgtttgttgttttaataatggtgagttatatgaattgatctcagatattaaacatagcttttatttctgggagaaatccagttggttaggatgttttatcttttttatctatcattggattcaatttgttaaattactaaaatttagctaatttgctaaaattcatttaaaatttttgtatctatgagagacattgatgtrtagttttcttttcttatttttgtctgacttgcatcattgtaatgctagcctcataggatgagttgggaagtatttcttcttcctgaattttctggaagaatttatatagaattggtattattttttctgtaagtatttgatggaatttaccaatgaagccacttgaacttggcaatttctttgtgagaatatttttgactgaatatccagcttctttcaaagatatagttctattcaagttacgtatttcttgtcgagtgatctttggtatttgtttctttgaagaaatttatccctttc

SEQ ID NO: 171452 - DNA, 601 bp, Human
ctgagtagctgggactacaggcatgcactaccaccaccctgctaattgaatttttttttttttttttggaggtggggtctcactttgttgaccaggctagtctcaaactcctggcctcaagccatcctcccaccttggccccctaaagcattggaattacaggtgtgagccatggcgtctggcctccgttacatgattttctgtattgcttttctattattattttttttgacggggagcggtgttcgttctgattgtggtttcttccttttacttatttttgcttaatttgctttttttrtttgtttcttaaggtggtccatgttccttttaaactgtgaaattttttaaacatagactaaattacagaggagaaacagctacccaaatcctatattggcatatttactctttatatgtcttcaaatattataaatagaattaaagccctcatcacatttccctttccagatctcatcactaccctgagtgtttcctttaacttgtttgtttaggtcatccatatgtgcattttcccctacattttacataatatcgctttatgtattttcacatttaagtaaatggaatcctatatgcg

SEQ ID NO: 171453 - DNA, 601 bp, Human
aacaatctataatgcaagaaatgtttgaatgattcagtttaattatagccagcatccagtcatttaacaagtatttattgagtctttgttctggcagaggttacattctagtagggaatatatgagacaaacataataaataagtaaattacactttatattagaggatgatgaaggctttacagaacagagcaggataagggagtgcctgatgggatgacttgcgctttgcatcagttaaagtaggcctcactgagaaggtggcatttgtacggggtcttgaggcatgggatttactttrtgtatttttgtctttttcctttttttttttttttttttggctaatttaagaagtttatgtagtctcttaagattactgtcatctattttcattgttagtaagaatggttttctacacatttcctatttttttttctattttggcaaaatttgaaattttaatgaaagcacagaagttttctgtgtaagcctgtccctgtccatacaattaaagagtggggaaaattggctttaactacattgtttatgtttaaacctgagtagaatattctgttgaaggctttaacaagaaaacaaaaat

SEQ ID NO: 171454 - DNA, 601 bp, Human
tgggtgtggtggctgacacctgtaatcccagcactttggagaccaaggcagctggatcacttgaggtcagaagttcgagaccagcctagccaacatggtgaaaccccatctctactaaaaatacaaaaattagccaggtgtggtggcgcatgcctgtaatcccagctacttgggaggctgaagcagaagaatcgattgaacttgggaggcggaggttgcagtgagtggggattgcaccactgcattccagcctgggtaaaaaagagcgagactcttgtctcaaaaaaaaaaaaaaaaaaaagcatggatggttaggaatggatgtttgataggcccacagctgtttcggtcatggtaagagatctttactgaatttttttgtggatcaccttctgagttacatttagatgttttctgcatcctatattttaaaaccttattttttattcattgagccaggatagtgacaaggacatggataaaaggactgagctatggatagagaattagttggcacatactggtagtgacttgattgtcaatgagaaagggatttgacattccttatattttgactgttatgtaatgaatctggactaag

SEQ ID NO: 171455 - DNA, 601 bp, Human
tttgcaacctggagcctcttttcctgcaaagagacagatgtacactatccatccatagatatcaaactcatcttaccccagtatatttgcatacagtgttcctacagcctggattttgatctgtatttgaatgaaaatgtagtgtctgtatttcagacatttccctaggtgttaatgtctttcttcaatgttgccatggttctttggggaccagcacactactaaatgtgacacataaggttttgtggttgtttcttgaggcctccctgccagcagcatttctttccatctttgtagactsttttaaactaaagataagcttagaattgaataaaattgttctttcttggtttcctccttgatatatatgttttcaaacctagtgctataaataataaaaaagtaagagtcacaggctagatattataggtgttctagattatttatgaatggataggcttagtgctactacaaattcaacttactgcatttttcaatcctcttttggttttgttatatcttcccatatcactttttcttcagatgaacatgtaaaagcggtgtgtgtgtgtgtgtgtgtgtgtgtgtagacacctaacct

SEQ ID NO: 171456 - DNA, 601 bp, Human
ttgtatgtgctatacttttaaatgactggcagtgcaataggtttgtttaaaacagcatcaccacgagcgcgagtaatgtgtcactctacgttatgagggctatggtgtcattaggagataggaatttttcagctccattataaccttatgggacaacctttgtatatgtggtctgtcgttcaccaaaatgttgttttgcagcacgagacaatttctgtatgtgggtatggatgtgccaaaccacctgaaagttagttgcagatatcatgcattttattctaaacacttcagtgcatatctyccaagaaaaagaccattcttctacataaccacgatatcattaccacacctaaaaaaaacaaacaagaatgtcatctttgagcatccccattccaaaaatgcaaagcccgaaatgctcccaaatatgaaacgttaccaacactagtgtgacccaagtggaaaattcacctgaccttatgcgatgggtcacattcaaaatgcaggtgcaccacatcttgttgattcagtgttcccaaggtaaaaaaaaaaagacccttgtggccccctttagctgcaatatatcttttccacacatgcccag

SEQ ID NO: 171457 - DNA, 601 bp, Human
acttacttagcaaactaatgcaggaacagaaaatcaaataccacatgttctcttaagtgggagctaaatgatgagaacacatggacacaaagagcaacaaaacagacactggggcctacttgagtgtgggaggtgggagaggatcagaaaaaataactattgggtactaggcttagtaactgggtgaccaaatggtctgtacaacagacctctgtggcatgagtttacctatataacaaacctgcatgtgtaatcctgggcctaaagtaaaagtttaaaaaaaataaaaattaggccgggygcggtggcacatgcctgtaatcccagcactttgggaggccaaggtaggcggatcacttgaagccaggaattcaagaccagcctggccaacatgtgaaaccccatcactactaaaaatacaaaaattagccaggcacagtggcacatgcctgtaatcccagctagtcaggaggctgaggcatgagaattgcttgaacccaggaggcagaagttgcagtgagctgaggttgtgccactacacttcagcctgggcaacagagcaagattctgtctcaaaaaacatatatataaataaaaagga

SEQ ID NO: 171458 - DNA, 601 bp, Human
agaatgcctcctcattactagaggacccacttctggcccctcaaatgcttctgatgtttcttctcacctaaaaaaataaaatacagtgtacaatagccttttaatcaaaacacagcatcgtagttggaggttgaaagcttgtagctgtttgttgtagctgctgtttaacagttgatgcaggtattctggcgatgctactgtgctgcttagttccccagaactcattgtttttcactgtattgatacgtcatattttttactgttaagtatttgtgtgaacaagtgtaagacaatgattgcstattaatagcatgtaaattccgagtccggaatgatggtgatgcccagcaaccacagattgtctacctgggtggctgagatagtgacacttttgctttttggtgcttcagtgtacacaaactttgtttcatgcacaaatttatttaaaatataatataaaattaccttcaggctatgtatatagttgtatatgaaacataaataaatttcacgtttagacttgggtcccatccccaagatatattattatgtatatgcaaatattccaaaatttgaaaaaatccaaaatcgaaacactcag

SEQ ID NO: 171459 - DNA, 601 bp, Human
gcttgtagctgtttgttgtagctgctgtttaacagttgatgcaggtattctggcgatgctactgtgctgcttagttccccagaactcattgtttttcactgtattgatacgtcatattttttactgttaagtatttgtgtgaacaagtgtaagacaatgattgcctattaatagcatgtaaattccgagtccggaatgatggtgatgcccagcaaccacagattgtctacctgggtggctgagatagtgacacttttgctttttggtgcttcagtgtacacaaactttgtttcatgcacaratttatttaaaatataatataaaattaccttcaggctatgtatatagttgtatatgaaacataaataaatttcacgtttagacttgggtcccatccccaagatatattattatgtatatgcaaatattccaaaatttgaaaaaatccaaaatcgaaacactcaggttccaagctttttggatgaggaatactcaatctgtattatctaatacatagttcatactcagatttcccatatgtcaaaaaaactatcttttagctgtcaatccagggtcacattaagattccataccagctact

SEQ ID NO: 171460 - DNA, 601 bp, Human
attttttagcaagtttcttttagtacttttagctaaaccttgttgtttaaaaggtattctgtacttacagttggttcataatttatttttcatagggacagtcttataaaaattgtgaaatgtatgaaattaatttctaagatcctaagtcctttattttatgacatacagccaacttttccttctattattaaaacacaagaaggaatctaatgaagttattcctaattctgtgaataaccaggaaggtttatgtcttgaaaagcatttataattttaacagaaagaaacttcagctaayggaatacatttttctgtgtgtgtatgcatgcatgcctgcttacttttgtgcacacatgtgtgtaattagaaacaacagtgagctgacagaggcatcctttagggaggaaacggaatcagtgttctgagagttctctctctcttcctgtatgccatcttcctctgtaatatgtttggagcctcatcctcatgtatcagtcacctgtcagtgcatgtaaaatgggattcattatgccatggtgcagatttaaatatgtttcttggaaaaagcaaaatttgtaggttttcttttcttttgttt

SEQ ID NO: 171461 - DNA, 601 bp, Human
cttgttgtttaaaaggtattctgtacttacagttggttcataatttatttttcatagggacagtcttataaaaattgtgaaatgtatgaaattaatttctaagatcctaagtcctttattttatgacatacagccaacttttccttctattattaaaacacaagaaggaatctaatgaagttattcctaattctgtgaataaccaggaaggtttatgtcttgaaaagcatttataattttaacagaaagaaacttcagctaatggaatacatttttctgtgtgtgtatgcatgcatgcctrcttacttttgtgcacacatgtgtgtaattagaaacaacagtgagctgacagaggcatcctttagggaggaaacggaatcagtgttctgagagttctctctctcttcctgtatgccatcttcctctgtaatatgtttggagcctcatcctcatgtatcagtcacctgtcagtgcatgtaaaatgggattcattatgccatggtgcagatttaaatatgtttcttggaaaaagcaaaatttgtaggttttcttttcttttgttttttgagatggagtctctctctgtcccccaggctggagt

SEQ ID NO: 171462 - DNA, 601 bp, Human
agaatagtgagatttacttggtcttagcagcattggtactttacatggaggaaggggacccttggtcacatcaccctacttttcaagctgggactctggatcactgtggctgtatggaaggttacagctagctgggagaggcatcaccttcttattctgctactcaggtattggtgaaaaacagccatgagtggtggagaggctgctgtctccagacttccagtacctggtacaagaaataccaggttaaacttctaggtgagactgatcatcttactctaatgtggttctcacaatgcarttgcaccaaaatcacctggaagcatttactgaatcaagagcttgccagatcagactttcagggttggatctctgttctgacataacatagaaaacagttggttatatgtagtagggtcacatccacacgcaaagtgtagttggtagaactgtatatctttgctctctgaaaccttactccaaggaagatgtgaaccccacacctgttgttgtttgtctacctttttaatagtttgttgtgtgtttgtgtatatgtagcacctaagaataaacatatgcagatatggcagtaatataatca

SEQ ID NO: 171463 - DNA, 601 bp, Human
tttcttataatccaatattgtcttgttccaaattattcccctttttattagagttgtattttttatgatgtatatctgatcatgttacttctctatctaaagtatgcattcttagcagggtgatattgaccctaaggaggcaaaaattgattttggagaaatgaaaatcttaggttgtataatggtttttagtcctccaaagggccatagaatataaacagatatgcactatatctatcatatttaaatttcatgatggggaggataaataatgaaaaaaatactgagagatactattctrtagagacttcctcttgtccttaaaattaattaatttaggctttcagaacccattacgatctggacttagtttattgctctggtcacatttctttttttttttttttttctttcttgtttttttggagatggagtctcagttgcccaggctggagtgtaatgatgtggtcgcagctcactgcaacctccacctcccgggttcaaacgattcttctgcctcagcctcctgagtactgctgggattacaggcacctgccaccacacccagctaattttttttttttaagtagagacagttttc

SEQ ID NO: 171464 - DNA, 601 bp, Human
agtagaaggagatatttttcatacttatattcgacgaaggacttttacacagaatatgtaaagaatacttaaaaatgtaaaacacttatgaaaaataacaaccaaaaatagcaaaatacttgaaaggcactttaaagatgatattcaagaggccagtaaacatattcaatttactgcattcattctgcattattagtaatcaggagacatgcaggtcagaactacagtgaaataccactataattaccagaatgaccacagtttaaaatactgacagtaccaaatattggtgaggatctgragcaactggaagtctcatacataacttgtaggagtataaattagtacagttcctttgaaaaacaagcagtatccagtatagctgatctaatatggttgatgtatacaccatggttcagcaattcaagttctgactatatacccaacaaaagtgtggacataaatacactaaaagacatatgtaagaatgtccggaaaagcacatttataacctacaattagaaactctctccacagtagaacagataataaattgtagcattatgtatacagcagtatatagcatcagagaagatagaac

SEQ ID NO: 171465 - DNA, 601 bp, Human
tctccacctgtttctcacagttaacctgaatccatagctgagattaactgtgataaagaaaaatcactaacagatgaaaactttcagtgattcggagaattgtacctaagaaatctaaacaaatatttcctttaaaatgtcacagaaaaaaaaacaaggtaaaaaattgtaaggagggaataatttgaattccagaaacgttatcttcagatagtaaacatgattcctgaactgaatgggggaaaatggtggcacacagcagattgagtattgcaggttaaccagatctgtaagtaacacygtttagttaatctttaagaataaagggctaaaaagatgaacatgaggtaaatggtaagagagaagaaaaatccaaaatattctatttagctgattgtagacaaagaattaaaattaaaattccttctacttgaagaataactcaagttcttagattaaaataccagaccaaattaaacaagagagtagagggaagccacatctagatgtgttctgagaaaagataagacttgacaagttttcagttaaaacacatgcacacaaatgtacacaaaacaccaagtcagcaatacctgaagag

SEQ ID NO: 171466 - DNA, 601 bp, Human
tttcaagtgattctcctgcctcagcctccagagtagctggattacaggcatgcaccaccacacctggctaattttgtatttttagtagagttggggtttctccatgttggtcaggttggtcagctcttgacctcaggtgatccgcctgcctcggcctcccaaagtgttgggattacaggcgcgagccactgcgcctggcccacctggctaatttcttaaaaaaatttttgtagagactggatttcactgtattaccctggttggtcttaaactcctaggcttaagcgatcctcctgcctcrgcttcccggagtattgggattacagtggcgtgagccactgtacctggcctggataagcattttaaagtgccatttatttatttaggacagagtctggctctgtcgcacaggctggagtgcagtggcatgatcttggctcactgcagcctccacctcccaggttcaagtgattctcctgtctcagcctcctgagtagctgggactacaggcacgcaccaccactcccagctaatttttgtatttttagtacagacagggttttgccacgttggccaggctagtctcgaactcctgacctca

SEQ ID NO: 171467 - DNA, 601 bp, Human
cactgcatagtctatttatatgggatgcagccataagaaaaaaattagtgaaaagtttgtgtttattctgcctttataaaattcatgcaaatttacgtcatatagcctattcccatttctttgaaagttctcattcatcccatggaacttgggtgttttaagcagtctactgggtatggcattggtggggcagggagaaagtgttgtgatctaataatgtgggaatattttaagaaaagatccatttgtttgtcacatttaactactagctcttcaaggatgttgtgacaaacttatatcrcagtccaccaatgactgtaaaaatatctagtcaacatacttagtctgtaaaagaaaactgttgctagagatggagttttaaaaggtgggttagtgaagcagatactgggaccctggctctggagagtacagggaagaagctcctggggcaaatttctcttgggcctcttttggtcaaaagaattacagcctttttgttaaaaggtcaaaagaagaggtcaaaaggattgcgacctttttgtaaaaaggtcctcctgttgtatataggagaaatggaggttgagatttatattggtgtccc

SEQ ID NO: 171468 - DNA, 601 bp, Human
cccaaagtgctgggattacaggcgtgaaccaccgcgcccagcccctcactgcaatttgatgacaaaacccagagggttggaatttctcattctcctctccctccctcccttacccccttccccagatggaaccaacccctccttccccatccaccatccttttaacagtattccagacatcttatgttttagcgtataggatttaaacgtataaatattccattatcttaacaatggcccatcttggctgtctttatttttaagaactcactgtggcatatgtgttttactaatacatagccacattttactgtaatcataagcagtgtgtaaaacttttctgtttcaggcaaggcatctttacatatgtgattatcataaaaacttaattcagagtgttcgaaacagaagaaagagaaaagggagtgatgatgatggaggtgattcacctgttcaagatattgataccccagaggtagatggaagttttttatgcttaatgtaaatcctaagtagtgcattctgaagcctttataaaaagatatgaacaatcttttaagtgtttaaaacatttgagaaatctgaaaatgaaagcaaaatt

SEQ ID NO: 171469 - DNA, 601 bp, Human
atagtccctcctgtaccttcacattttatatatatctacataaaacaatttctttgactctctgcttaaaaaaaaaaataacagactatacagactatacaataactacaagtaactacaagtctgtctgcaggaatatactagtgctacaaacactggtttcagtcaaaaggaaggtttcaattaccttgtgttgaagtgtacaattttcattaggccttttcaaaacatagctgacaaccattaatacaagattaactaaatttcccaggttttctacagttattacctatacctagtyttatccacggctttaaaaaagatgacactgtaccttttcatatttctcctttagcttagctgctttctgttcatatggttgtttatctttggctgactgctcagaccacatttcacccaatttctttgcagtatccccaatggataggccagggtgttcacttttgatctttgggcgatgttcagagcaaaacaggaagaaggcagatctgaaaggaagcaacagagtttaataaactgaaggaaaaatccaaggagcaatttgggttattttaaacttacggtggccttttaggagcat

SEQ ID NO: 171470 - DNA, 601 bp, Human
tcaagcacttaaagtatacggcattgtactaggtaccgagattatttttccattaagatttcttcccttctgttctgtgaaaaaaaaatcacactataccgtaataatcaaaattatgttattgatccctatggcaatggctattagccataaatgttaaatgatcctgagagcagttcaagaagtaccacagtttgaatcttgacttctcaaaagttcttaaaatcttacaaagataaatcactgtaccatataaagaatactaacaaggtaaattaaaatatatacattgcctctaatrtcaataaatttaatctaaaagctagattgcatgagtaggtaaatttaggctttcatacttgccagctgctttctgccacagccaattagaggtgtacctcatactcatttggagctctctgtttacaaaatgctttcattgaaattacctcatttaatcattacatctaatccttgatttagttattattatcatcacagtttaaaaaagagataaagttacttagtaaaagatctatttgctagtgaggccttgaagtcctgtcttttgacatcaagtcttcttactttacaccacatc

SEQ ID NO: 171471 - DNA, 601 bp, Human
ctgaagaaatctgtgcttcgtctaccctgccatggcaatccatttttgtgagccatagaccagtaggaatcatgtagtagaaatatgagtgagagcagttgggtcaagccctctagagacagaaatttcagtcaaaaaaaaaaaaatcaacgaaaaagatgttctctgtgagaagaaaactgcagttagaacacgaactgggcatgttcaccaccagatgctaaacaacagattctaaactttaaaaggcccaaggaagacaggaaaaggttgcagcaggaggataaactgaagacaatcmacaaaagttgaattgcaaaagagtcatttactaacagtagtaataataattcaattcatttattgattatctttgtgtaccaggtactatgctaactactttatgtgattatatgacttcatacattattatcattaagatttcatttaaacttcaccacaaccctgttattattcccatttttaaaatgagaaaactgaggctcaggtattttaagtaaccttcccaagattattcatagcaaaacctgactatatgtctagtaagtttcatatgtctacttacaaaacacaatctttc

SEQ ID NO: 171472 - DNA, 601 bp, Human
caaaagaaaaagagaacagaaggttggctgtataaaacaaacatagggcccacattaataattggagcaatacaatttaattttagatgactataagaattggtgtcccagactaatatgagtttggcaacagtcctatccatgatattaacacagcaatgcttattctggcaaaaaaaaaaaaaaagataaaattactggcatggttctgaatacatatttctttattctttattgtttaaaatatatagtgagtgaacactatatctcagaaagattatcacatctctcatagtagttyactgaagaaatctgtgcttcgtctaccctgccatggcaatccatttttgtgagccatagaccagtaggaatcatgtagtagaaatatgagtgagagcagttgggtcaagccctctagagacagaaatttcagtcaaaaaaaaaaaaatcaacgaaaaagatgttctctgtgagaagaaaactgcagttagaacacgaactgggcatgttcaccaccagatgctaaacaacagattctaaactttaaaaggcccaaggaagacaggaaaaggttgcagcaggaggataaactgaagacaat

SEQ ID NO: 171473 - DNA, 601 bp, Human
ttccccagtgaacatctgcagaggcagtggatttcctgatcatactcccctgtctgactgataagaggaagaagactctggagaaagttatcgacaaggaaaagaaatagagcaaaattgggagcaacctaaaggcccaccgtttggcagggcaaatatgtgaatttcccatgggttagggaagagagaggcaagcttgagttgtctggttgtcatggtgctcttccaatctagaggctgccagccagggacagggctcccactagcaagaccacgagagtgaagtccttaggtgcaggakctggggcatccaaaagtgtcagggcggaactcatacatgcaccctagtgagggcatgacagccaagagaggactgctacaaccccaatgaaattttccattttccatttcattcatgcctcacccaatacatccgaagagaaagggacacagaaaagaatggcctggagaagaggagtgaaaacccacatcatacactctgtcctgtattccaagtctcttaggccaagtcctgacccagacagagaaagcaacattagagtcagactagatatgagagtaaaaatttaaattggtctag

SEQ ID NO: 171474 - DNA, 601 bp, Human
cctggctaacacggtgaaaccccgtctctactaaaaatacaaaaaattagccggaagtggtggcaggcgcctgtagtcccagctactctggaggctgaggcagaagaatggtgtgaacccaggaggcggagcttgcagtgagccgagactgcgccactgcactccagcctgggtgacagagtgagactccgtctcaaaaaaaaaaaaaaaaaaaaagaagaagatagcagtatggtgtataaataacatacacctggcagaatttgagtcatggtcttaccattttctatctgtgagatcytgagcaagtaacctaatctctgttagtctaaatttcctctctcataaaatggaggtaccttctagagttcttgtgaggactaaataacacaatgcctgtaactggatattggctgggactttttgagttgcctctgaatgagagctaagacaaaaaagctgaggacattaaaggccaaatcctcccacattccaaaggggtagccaagaagaccagagctcttcttcaggacttaagaggagactaaacagccactgcccctgtcactctaccaccagcttacagaagcaaaagaacaga

SEQ ID NO: 171475 - DNA, 601 bp, Human
gccgggtgcggtggctcacgcctgtaatcctagcactttgggaggcccaggcgggcagatcacgagttcaggagatcaagaccatcctggctaacacggtgaaaccccgtctctactaaaaatacaaaaaattagccggaagtggtggcaggcgcctgtagtcccagctactctggaggctgaggcagaagaatggtgtgaacccaggaggcggagcttgcagtgagccgagactgcgccactgcactccagcctgggtgacagagtgagactccgtctcaaaaaaaaaaaaaaaaaaaaagaagaagatagcagtatggtgtataaataacatacacctggcagaatttgagtcatggtcttaccattttctatctgtgagatcttgagcaagtaacctaatctctgttagtctaaatttcctctctcataaaatggaggtaccttctagagttcttgtgaggactaaataacacaatgcctgtaactggatattggctgggactttttgagttgcctctgaatgagagctaagacaaaaaagctgaggacattaaaggccaaatcctcccacattccaaaggggtagccaagaagacca

SEQ ID NO: 171476 - DNA, 601 bp, Human
agaaaaggaaaagttaacaatgttaatttggtgtcctggcattcaatggtgttgaaagtaaacacaccataacttttgtcacagtcaagaagatagcagtataggccgggtgcggtggctcacgcctgtaatcctagcactttgggaggcccaggcgggcagatcacgagttcaggagatcaagaccatcctggctaacacggtgaaaccccgtctctactaaaaatacaaaaaattagccggaagtggtggcaggcgcctgtagtcccagctactctggaggctgaggcagaagaatggygtgaacccaggaggcggagcttgcagtgagccgagactgcgccactgcactccagcctgggtgacagagtgagactccgtctcaaaaaaaaaaaaaaaaaaaaagaagaagatagcagtatggtgtataaataacatacacctggcagaatttgagtcatggtcttaccattttctatctgtgagatcttgagcaagtaacctaatctctgttagtctaaatttcctctctcataaaatggaggtaccttctagagttcttgtgaggactaaataacacaatgcctgtaactggatattg

SEQ ID NO: 171477 - DNA, 601 bp, Human
aaggtctgggtctcaacttgccatattctccacatctctctttggtagaacatgaaacacttccacctcgactttccctctctttcattctctctcatccatataaatatatatagttaatataccgagtatattagcagtacactgaagaattcctgagacatcttcaatttcttctttgttggagtggtctgcataggagcatctgttagagatattgtggaaattcttttctgcatccctgtaactaagaagaaaacaaaattagcataaggagaaatttttgaaagcatctgcgaaygcaactcatatacacacgcacaagcacacgcagtctatgctttcatcatagtcacattttaaaataagtgaagctttgagacataattctggcataacccaccattcacatcagcatttgcagtgtagacctggaactggaggcaactgttaacaagaaagctatgtgtgaaaaaaattgaagagaacaaaaaatatatcagctttgtacagctaatgtatcactctgagagcacttcatcaaggctagtgatctgtttctataaggaagctgcctagaaaaggaaaagttaacaatgtt

SEQ ID NO: 171478 - DNA, 601 bp, Human
gccaatctcagtccaccaatattctaatcacactccccaaaggtgataaatataaaccatggagttggaacactgccttctgccatccaaaaaaaaaggttcccaggcatcaaaatttttcttatcttggttgaaatgttgttttcctgtgccaccccccaacaacctcccaaaaaacaatttatgtcatgcttttctgtccagtaagctgaccaattctttcattctcatatatgattacagaagagaatttaaacacaactttaaaaaaagataaaaatctaaacaagccaagattaaycatagctcagtgacttcttaaaaacaaagcttttattgaatatgaccgctaacgctgtcctcagagagtcaatatatcaagagttctaaaaagacattattcaaggagaacagctacctctgtgccagcatctggttgacaggtggcaggcattaaatgttaatgttaatgttaatcttcagaaatttaaactttacaagattgtgctttaaatcttgaaaacaacctatcattacttagaggaagaaaataatcagacctagtatctcttttgtagaaaaagttactattcatggaaat

SEQ ID NO: 171479 - DNA, 601 bp, Human
cttgtagggcacaacatgtgctcccagggagtcccatggaagaggtgagagaacaaatgagtgacagaggcataacaggtcttctccaactcactttctccctctcctcaggtcctcgtttttattccatgccaccctctaaatgcaaacttcaacctgaagagccagtaaatgaccaaactttctagaggagttgtttatactaagtaggtagaaatgctcattttggaaggagaaaaattgctactatgatcatatcttgtgatctatgacttcaagtcttttttgatgatgaagtatgaataatatacaaataagtgaataaacgaacacatttccagactctaatacaaccctgtaataggttaagaaggtaagagaaatatatgtttgccaatctcagtccaccaatattctaatcacactccccaaaggtgataaatataaaccatggagttggaacactgccttctgccatccaaaaaaaaaggttcccaggcatcaaaatttttcttatcttggttgaaatgttgttttcctgtgccaccccccaacaacctcccaaaaaacaatttatgtcatgcttttctgtccagtaagc

SEQ ID NO: 171480 - DNA, 601 bp, Human
atctttctttgcatggccagagtttcaagggcccagcctccattatcacagcaattggcaaagcaccaaaatatggtgaagagatggcaagaaacagaccataatcaatatccgtaatttgtaaatgatgagacagaaaatagaaacaaccagtttctaaaccaacgaaagggaaacagacatcaaacattttgatatctggaagcagttctttcccattactccagaggcatgaaacaccttgtagggcacaacatgtgctcccagggagtcccatggaagaggtgagagaacaaatgartgacagaggcataacaggtcttctccaactcactttctccctctcctcaggtcctcgtttttattccatgccaccctctaaatgcaaacttcaacctgaagagccagtaaatgaccaaactttctagaggagttgtttatactaagtaggtagaaatgctcattttggaaggagaaaaattgctactatgatcatatcttgtgatctatgacttcaagtcttttttgatgatgaagtataaataatatacaaataagtgaataaacgaacacatttccagactctaatacaaccctgtaa

SEQ ID NO: 171481 - DNA, 601 bp, Human
attatgtaccaaataaagcaataaatttaactctaaagtcctccagcagggagggcactgtctactatctttctttgcatggccagagtttcaagggcccagcctccattatcacagcaattggcaaagcaccaaaatatggtgaagagatggcaagaaacagaccataatcaatatccgtaatttgtaaatgatgagacagaaaatagaaacaaccagtttctaaaccaacgaaagggaaacagacatcaaacattttgatatctggaagcagttctttcccattactccagaggcatgwaacaccttgtagggcacaacatgtgctcccagggagtcccatggaagaggtgagagaacaaatgagtgacagaggcataacaggtcttctccaactcactttctccctctcctcaggtcctcgtttttattccatgccaccctctaaatgcaaacttcaacctgaagagccagtaaatgaccaaactttctagaggagttgtttatactaagtaggtagaaatgctcattttggaaggagaaaaattgctactatgatcatatcttgtgatctatgacttcaagtcttttttgatgatga

SEQ ID NO: 171482 - DNA, 601 bp, Human
agctctacaacaactgaaacacccacaacacccttaatagtattagaacttgttaaaactgaaatagtcataacctcatttatatttaacttattatgacaaaggagactatgcaatttatcatccttctcccttaactctcctactcactttgtctccctgcctacaacactatgtaaacccaatccataagaacaagtagcaacatttcagcagaaaacatggtacacatgctttaatacatgcttcatcataccattcaaccattacaatttccaagaaaatactaaatgttgcctcrtagagcataaacacatttctactatttaatttgagctaaaaataggctttgcagattagggctagaaaagattttctattttttggacaactaaaattagatcattttggtatgcaaaagacattatgtaccaaataaagcaataaatttaactctaaagtcctccagcagggagggcactgtctactatctttctttgcatggccagagtttcaagggcccagcctccattatcacagcaattggcaaagcaccaaaatatggtgaagagatggcaagaaacagaccataatcaatatc

SEQ ID NO: 171483 - DNA, 601 bp, Human
tagaagagtgcaagtatttggtatgatgttataatggcagatatatgacattatgcatttttcaatacccatagaactttacagcagaagagctaaacttactgtatacaaatttaaatgtgtgtgtgtgtgtgtgtgtgtgtgtgtttaggaggtcaaagtatcacaggatggaagactataataaaagaatctagctgtattacaaatatatgaaaaaaatcttactggaagtggtggggtagaaaggtgcttacctaagtaaccctggatatgagtggacactataaagctttatacrtaactacatactcccaaactgcccataggcactgtattttagttgataaaattgtttcccctgggagtttctgttaacaattctgaaacaactataaacgtacactggaattgaagaattcagtaaatggatggctaaagggagtcaggtttctccttgttagaaagaaggatatagacaagcaagagggaaaggttagaatgatccatatggtaatggagtaaagttggagacatcagtattaactcatatttagcatatgatgaatacatataaaaatgtttatagatgggcatatat

SEQ ID NO: 171484 - DNA, 601 bp, Human
aacactgccctccccagaggctaatggtgtgaccccatgcaagcagcctgacctagctgtgcttccatttcttctgctccaagtcagagctaagtgtttttgttttgttctgttttgttttatccaactaaggagttttgcagattttaaatggcagtaatactatctttgagaaaacaaaaatagaagagtttctaagaaatttgagaattttgttatgagaatgtattgagtaaaggagctttagttaagtgagtttgactcactggctgttgatagtgttgaaaggaatcttaactcwggcaagctgggggttaggagagcataacgatattaacaaagaccatttgtggacatcttatatttcaacaccttcaacaaatgggaccctgttggttatatcacctcaaagttacactgaaattcctaaaatatttcatttcccagtgaataaatgctgaataacttcattccaggaacttattgttactaagcaaaagagaaagagtctacctattacagtagtatcatgggcaatcattgctatcactaataaatttttaagcagtttctaaattcagtcataatatcaggaaaagta

SEQ ID NO: 171485 - DNA, 601 bp, Human
tgtttggtaacagaagcagttgaggggtcaataagtaatgtagcaggctctaccatcacagcctcatagttcaaacactgccctccccagaggctaatggtgtgaccccatgcaagcagcctgacctagctgtgcttccatttcttctgctccaagtcagagctaagtgtttttgttttgttctgttttgttttatccaactaaggagttttgcagattttaaatggcagtaatactatctttgagaaaacaaaaatagaagagtttctaagaaatttgagaattttgttatgagaatgtrttgagtaaaggagctttagttaagtgagtttgactcactggctgttgatagtgttgaaaggaatcttaactcaggcaagctgggggttaggagagcataacgatattaacaaagaccatttgtggacatcttatatttcaacaccttcaacaaatgggaccctgttggttatatcacctcaaagttacactgaaattcctaaaatatttcatttcccagtgaataaatgctgaataacttcattccaggaacttattgttactaagcaaaagagaaagagtctacctattacagtagtat

SEQ ID NO: 171486 - DNA, 601 bp, Human
actcatctagcatagaacccaggatgtttgaatttaactctaatcttacttaaattttcactaactgtcagaagaattaaacagaatgctattaaaatttgtagttgagtcagagttatgcatcaaagaacaatgaaagcagagagataacacaatggacaaaaacatcagcctcatgaatgggaaataattcatttacttaacaaaagtcttctaacacaaaagaaaagggttgggggagaaaggaaggtggtatgctcacttgagctaaaagattcaaagaaataaagacaaaaaaaaacagtatttcaaaaagcaaatgtgacaagtcactataaatctgctccatgagatggcaacaaaataagctatgagtttgacatatgaagtgattacaggcccacaatcatgtttctcacatagtaagggaagaataatcttccttctaactcagagaaaaagcaataataacaattactgtttggtaacagaagcagttgaggggtcaataagtaatgtagcaggctctaccatcacagcctcatagttcaaacactgccctccccagaggctaatggtgtgaccccatgcaagcagcctg

SEQ ID NO: 171487 - DNA, 601 bp, Human
cttgttctctggctgaaatcccttgatatcttcttcgcaaagatcctaaaatgactctgctttatgaaagctcacagacaagtataaacttccctttcctattgcagcaacaaattctattgcccactttattttctccctagggtaacactgtcctctcggaattaataggatttctgatcctaacaatagtaatagtggacaggaaagtgttatctaaagctctcaagtaaaaaaatctagcagtaaccaggcattttatgaaaacaatgcatgacccactatttctgacattagtttsaacaaaaccctattgcatgtcattgtggaattaatgacatgggatgaataaagggagggatttatctagaactaggtatgcccacttatacataaacaggagaaaatcagaaaaaaatatgatattctaattgggtgatgcaaatgatggcagtctaagccagtaatctaagccagcagttatcagcatgaaggagatttggcaaagagatacagaaaaggcaaaagggaggcaggaaggaaggaaggaatgaagggaggaaaggagggagggagggagggagggaaagaaacaatgagg

SEQ ID NO: 171488 - DNA, 601 bp, Human
gagctgagatcatgccacagcactccagcctgggcaacagagcaagactccatctcaaaaaaaaaaaaaaactagaaatgaaagtctgtatattagtgtgtgcaggaattgtgggagtaggtggggggagttaaatcacatagacagaatacctgattatgtcctgcatatgtttgcttaaaatttttaatttcaaataaatttgaaatgtgagaataatttacataagcctcagtatttttatgcaacaattaaagttttaaggaattatatatatttatatatatatataaaatatatrtacacatatatgtataatctgaaatgaacaccatttttgaaactgatcttttgtctattccaacaaaaagggaaatgaatatccatcatgtgcttatgctctgacctgttattaatttaaaaatataggcagtggtaataattttgaccatgtacagctatattatcttctaaacagttgactttacacgcctattagttcagtaaacactaaacaccaacttagtgtgatgtcctgctttaagtgaagatcctgtgtaactaattctacacaatgctatatggagatacagaatgtact

SEQ ID NO: 171489 - DNA, 601 bp, Human
cctgtaatcccagcactttgggaggccaaggcaggtggatcatgaggtcaggagatcgagaccatcctggctaacatggtgaaaccccatctccacttaaaaaaaaaaaaatacaaatatttttgtggtagcatgtgcctgtagtcccacctacttgggaggctgaggcaggagaatcgcttaaacccgggaggcagaggttgcagtgagctgagatcatgccacagcactccagcctgggcaacagagcaagactccatctcaaaaaaaaaaaaaaactagaaatgaaagtctgtatatkagtgtgtgcaggaattgtgggagtaggtggggggagttaaatcacatagacagaatacctgattatgtcctgcatatgtttgcttaaaatttttaatttcaaataaatttgaaatgtgagaataatttacataagcctcagtatttttatgcaacaattaaagttttaaggaattatatatatttatatatatatataaaatatatatacacatatatgtataatctgaaatgaacaccatttttgaaactgatcttttgtctattccaacaaaaagggaaatgaatatccatcatgtgc

SEQ ID NO: 171490 - DNA, 601 bp, Human
caaaataaaaggagaacagagtagtctgctattaatttgtgcagcactctactgtacttggctgagtaaatcagtacctacacaatgccagcatctagagagcaataaatatttgttgaatagatatttgaatgaataaatgcatattcaggttcctttacattttaatttaaattcaagagggctcattaatggggaaatgtagataatgtagaaaatgcggactggatactggtaagcctttggttttaagttcttaaatcatcaccattccaaagcaaaaatgatggtggtaacagcrgtagtgcacgtgagtatgttaaatcctcttttctacagaagctagcacagaagggactaaaaagaagagttaaggaagaacaaagtaacagccaacacaagcaccaagtcaactagataacaacagaccaattttctaattatctcaccaggacacataccacaatttcatggaaaggagtgccagagattagacgatattagtgaaaatccaaacctttaaatttggggaacagtgaggaaggaaggatgctaagtggaacaaaatttatctagtgagatgcactggcatatcctgcag

SEQ ID NO: 171491 - DNA, 601 bp, Human
aaccctaggaaagattaaaagcatgccaagcggagcaactattcatattcgttacggtctcaaagtagatctcacagaacactgagctatgtttgtcattatgtcattatcccactctaacatattccacaaataaaacacaagggaaaggctgagacctgaaagaatttttttaatggtcatcttttaaaattgagtgaggaggggaaaatatatacatgaattctttcattattttagaggaaactatcatctgtttggtttcattgtttatttggtgaaaggattatgctctcatggmttctcttttcttttgtaacagagccatattcattttttcagtgtcccctccagtttttgtgcatactcacacatattttatgtactcggattcataatgttcatgatatgcccaaacactttatgtataaagttttcttttttgtataatctgtcatctctaacagatactgggagtgtttgtagctgtcagctctcaactgagtctgactctaggcattgccttcagctgaagagagctgccggctcaagatccacctgcctccgcaagggaagctgctttcaaagatagttcatttgg

SEQ ID NO: 171492 - DNA, 601 bp, Human
agtcttttgtgtatatgtgctctaacctgggaaaatagatgttcaggtttattcttcttcactagcatatacacctcaaactgtttttctagtattgtatttatttgccttgtgccgttcacatttttcatgcccaattccattttgatcatgaatatataaaatgttaagctgaaaaaggaagaaatgtagagccgtgaaaatgagtatcagtggtgcatgtacttactgaactcataagcactgcttctttagcatcgtgggtgaggcaaccctaggaaagattaaaagcatgccaagmggagcaactattcatattcgttacggtctcaaagtagatctcacagaacactgagctatgtttgtcattatgtcattatcccactctaacatattccacaaataaaacacaagggaaaggctgagacctgaaagaatttttttaatggtcatcttttaaaattgagtgaggaggggaaaatatatacatgaattctttcattattttagaggaaactatcatctgtttggtttcattgtttatttggtgaaaggattatgctctcatggcttctcttttcttttgtaacagagccatatt

SEQ ID NO: 171493 - DNA, 601 bp, Human
ctgaatacagcacacagatgggtcttgactccttattcaatttgccagtctgtgtcttttttttttcttttttttgagacagagttttgctcttgttgcccaggctggagtgcaatggcatgatctcggctcaccgcaacctcccaggttcaagcaattctcctacctcagcctctcaagtagctgggattacaggcatgtgccaccatgcccaactaattttgtatttttagtagagatggggtttctccttgttggtcaggctggtcttgaactcccaacctcaggtgatccacccatstcagcctcccaaagtgttgggattacaggtgttagccaccatgcccggcccagtctgtcttttaagtggggcatttagcccatttacattagtattgttatgtgtgaatttgattctgtcaacatgatgctatttggttattttgcataatagttgatgcagtttcttcatggtgtcattggtctttatattttgctgtgtttttgcagtacctggtactggtttttcctttccatatttagtgcttcttttaggagctcttgcagggcaggactggtggtaatgaaatccctcagcatt

SEQ ID NO: 171494 - DNA, 601 bp, Human
cagcagcagcccagcagcagtaaggtgcagagtcaaagaatgagcagacatgagctaattacaaagaggagctgcaggagcacctgcttcagctctgtgcccacacctggccccttattctggaatgcaatctgccacactgaaaatagggcagtggctcccaagatttggaatctccctgcagataagtattctcatcacttctcacgcctttactttttaccagtctcttacccgctggtgaagaaggtgggggaggggattactgtgacgtacatagattctggcttttgctgatgaygactagccctgttcaaattggcggccacagaagaggcagcaggaaagcatgatttccacatggaccgatcctcggagggcttactcagagctgttaatcaatgccaatgcctctttaatggtcacttttttaaatttcttctaaaaaaatgggatacatgtgcagaacgtgcaggtttgttacataggtatgcgcttgccatggtggtttgctgcacctattgacccatcctctaagttccctgacctcacccctcaccctccaacaggccatggtgtgtgttgttcccctctctgtgac

SEQ ID NO: 171495 - DNA, 601 bp, Human
tatttagaggaacaacctctaaaaacactataatgtagaatgagaaaaaagaaaccaatggaagaaggactataactaaatgaattacagagagaatttcccctgaaccatggaaaatcctacatctacagatggaaaaagcataaattgcaaccaggaatgataagaaacacagacacacacacacacccctaagaatatctggttggattcctgaaaaaaaaaaaagagagagagagataaagaagatcttttaagttgcaagagaaaacaggtaattaaaaaaaatttacttttcatytgcaacaatgaaagctagatgatgagagaaaaatacaggtgagatactgagagaactgaaacctaaaagtttatcacccagaagagtatctggcaaagattcagagattccatcactcagtgaaacaccttagaaaatgaaaaaaaacaaaaacaaaaaaaacaaaacaaaaaaacacattaatcgatcaagaaatcactcagaatgaagaagtagaggagtctggttaagagaagaaggaaaagtagacacattagtgagcaatgaaccctacaacacacacatagacacatgctttct

SEQ ID NO: 171496 - DNA, 601 bp, Human
aacgaattttttcacctagtaaccacatctaacaagtgcagtatcataaacatacactacaaaactatcagtgttactccttcctttcaaatcacaaagcacatgtccgtgtctttcttataaaatagcagatagtcccttgtagtattttttctgtgatccttctattttccataaacatatttagaggaacaacctctaaaaacactataatgtagaatgagaaaaaagaaaccaatggaagaaggactataactaaatgaattacagagagaatttcccctgaaccatggaaaatccyacatctacagatggaaaaagcataaattgcaaccaggaatgataagaaacacagacacacacacacacccctaagaatatctggttggattcctgaaaaaaaaaaaagagagagagagataaagaagatcttttaagttgcaagagaaaacaggtaattaaaaaaaatttacttttcatctgcaacaatgaaagctagatgatgagagaaaaatacaggtgagatactgagagaactgaaacctaaaagtttatcacccagaagagtatctggcaaagattcagagattccatcactcag

SEQ ID NO: 171497 - DNA, 601 bp, Human
gtcagtttgacaaagaacttcttaaaatcaatgtgataggaaaatgagtagaaaacctaagtgagaaacagtccctttattaataagcatttcatattcattttggtttcatggattggatgctcaagacttgttgagaaagtcacttattaagataaaaatatcaccactcatgtcacattgccaggttacaagactgctcttcaacatgtgttgcattcactaacaataatgtcagccagaatagacaataatagtacttatctgtccagttctctagtgtagaagagaaaacaaagayagacaatattcactgccattagtctcctgttccaactgctctgttgaaactgctttcataaatacttaaatcaatacatactgttttgtccttatcttacttaaccttgtttgctgtttttcctttaatttgacactattaatcatcccttcctcctaaaactctcatctcttttggcttatcaaaccatactctcctggtttgattactctgcatgaacattaattctcacttccttcactaaaacttctttctatgccaaatccttacatcaccatcactatgttataactagaaaac

SEQ ID NO: 171498 - DNA, 601 bp, Human
catattatgtccatattacatccatattatcatcttacttcttatcgaaatgcatgtattaagtggaaaatataaaccagaaaagaaatctatggcacatgaatggggataggcatcaagctatctggtggaaacaaaaggcttacattagcaatctcagggaaagacatgcaggtcagctagacctcagggaaaaggagaaaaaacaagaaaataataatgacagaactctggaatgatttacattctttcacccacaaaagtaagggcagccaagcatggaggaggaatctgatgagayagaattaaaggttattgttaagttttctccatatataatcactccctgatgccctggcaaaagagttccaccttatagtgctggatattacaatgaaaaataaataagtgtgcacaatgtattctatcgtaataagaagcaggatcacatgtgatcacaagatcccccccttgaggatgatatgaggaaaaatgagggaatttatgtgccaaagaggactataacacatacaaaagattttggcctgcatattaaagacagcttctacctaaactctattgcttctcctttgacattggt

SEQ ID NO: 171499 - DNA, 601 bp, Human
gaccagttttagagtcacagcaaaattgagcagaaggcacagttatttcccatatctctctgccccgacacatgcacagcctgccccattatcatatctcccaccagagtggtacatttattacaatccatgaacctacatgatgcattattatcatccaaattccatggtttacattaaggctcactcttaatattgtatattctgtgggcttaaacaaatgtataatgatatgtatacacttatcatatcacttagagcattttcactgccctaaaaatcctgtttatcccttccttcyccctaactcccagagcatcagctttttaaatgttgctaatctagctgttcacctttcaatagccttgcagtagttatcataaataatatatttttctttttcttaatgatttccccattcttcacagaatatccaagttgcctacatattatgtccatattacatccatattatcatcttacttcttatcgaaatgcatgtattaagtggaaaatataaaccagaaaagaaatctatggcacatgaatggggataggcatcaagctatctggtggaaacaaaaggcttacattagcaatc

SEQ ID NO: 171500 - DNA, 601 bp, Human
tctacaactcttctttcctttagcccagagcaacctgtcatttctaatagctaatagcttccctcaaatgcttggaaacaggctaaatagcctaaaagaactttatttaccctagtacaaaatgttgaaaagacactctactggaaactgaatggaactatacaaatttctgtcctggaaattaatgttgtttttccgtttaatcactgaaagcatattactaaacataaaaaatcatggtttatttttctttacattttattatctattttaatgttgactttttaaaatattttacctkagggacaaaatgttcatttaaacccaaatattttaagatttatttctggtgtcttttcatcaattatttataatttataatccagatttcccaaaggggattcaaagaaatccacaaaaaatttcctagtcttcactttattctctcaactagagatcatgttctaaagcaatgaatctctattttaatactaaaatttaaacagaagtctcgagatagtcaattctcagcttttggggaatacattattctgcatattaagacaaaaataggatgtaaaccagatgttcccagattatg

SEQ ID NO: 171501 - DNA, 601 bp, Human
ataactcgttttaaagcatctacaaatgtgaacaaaaatacacatttaacaagtttcttccattctaaaggacttcaaaatgggtagcaattattaaacatacatataatatacatatgtgacaatttgtatttaaaacatcatatgatcaaataatactaattcattcagactaaaatatccaaatgtgccaaactggaatccaggtctatccttagatattttcaaatcactgaacttgtatgataaaaacattattaatttcctaaaccacctgatttcgtcatattgaataaatgtkcatctttctatcattctcaaataattttttttttgagacagagtctcactcttgtcacccaggctggagtgcagtggcatgatctcagctcactgcagcctctgcctcctgggttcaagcgattctcctgtctcagcctcctgagtagctgggattacaggcacccgccaccatgcccagctcgtttttttgtgtttttggtagagatggggtttcatcatgttggccaggctggtctcaaactcctgacctcaggtgatcgatctgcccacctcggcctcccaaagtgttgggattaca

SEQ ID NO: 171502 - DNA, 601 bp, Human
aataatatattctagttcagaaatatttccaaaaacaccaacttcaattctaaaggccaaaaatgcttcaaattctcctagccaaatattgtgcttctgtaaaacagaactgatagttttgatattccctaaattaaagagaaagaataactcgttttaaagcatctacaaatgtgaacaaaaatacacatttaacaagtttcttccattctaaaggacttcaaaatgggtagcaattattaaacatacatataatatacatatgtgacaatttgtatttaaaacatcatatgatcaaatmatactaattcattcagactaaaatatccaaatgtgccaaactggaatccaggtctatccttagatattttcaaatcactgaacttgtatgataaaaacattattaatttcctaaaccacctgatttcgtcatattgaataaatgtgcatctttctatcattctcaaataattttttttttgagacagagtctcactcttgtcacccaggctggagtgcagtggcatgatctcagctcactgcagcctctgcctcctgggttcaagcgattctcctgtctcagcctcctgagtagctggga

SEQ ID NO: 171503 - DNA, 601 bp, Human
ttcattcatacttaatgtttgacatctgataaggaaagatgatgatgacaggaagttgagtttagggaaagatgaaaacatacgaatactataatgaggaaaaagaaaatagggagagagaagaatatgtgaggcatggatgatcacttagagaaaatgtagaggaaaccaagtgatagaatcaaagcttggtcaagccatctggaagagtttttttctaacctcaagactgttgaatcctgccactgataactgcgtcagatgcccctcggtgacatgcttgctcttgatttttttttttatggcagacgtagtggttcattggtattaaatgcacaaacaaaacagttaaattatgagagccctcaatgttagaagaaggaataaatataaattattttaaaatagcattttcttataaaagccaactaaaaaattagagacttcagacatcatagaggtatacattaacaagaatagctattatggggaaaataatgaagacaaagtcaaatttatcaacaaaaacacaatttttacatattatttttctttcttctttccatgttttaataaactgtaaatgtgaaatttgatgact

SEQ ID NO: 171504 - DNA, 601 bp, Human
tgacaaaaataagcaatagggaaaggactccctattcaataaatggtgctgggatagctggctagctgtatgcaggtgaatgaaatgggacccctgccttttaccatatacaaaaatgaactcaagatggattaaatatttaaatgtaagacctcgaacagtaagaatcctagaagaaaacctaggaaacaccattctggacactggccttgggaaagaatttgttactaagtcccaaaagcaacaaaacaaaacaaaaattgacaagtgggacctaattaaactaaagagcttctgaaaagcaaagtaaatgaacagagtaaacaacctaaaaaatgggagaaaatattcataaactatgcatctaacaaaggtctaataaccaaaatctataaggaagttaagcaaacaaaaaataacaccattaaaaataggcaaaatacatgaacagacatttctcaaaataaaacataaaaacagccaccaaacatataaaaaaatactcaacatcactaaatatcagaaaaatgcaaatcaaacccacaatgagataccatctcacaccaggcagaatgggtattattaataagtcaaaagcaac

SEQ ID NO: 171505 - DNA, 601 bp, Human
gtatctgtctttgtgtttcttctcttcttacaaggataccagttatattgtattaaaataatgacctcaccttaaggtcatttgattataactgccaaaagcttatttccaaataaagtcacattcacatggaaaatgaaatggacatatttctgggactcaacaaatgtgcattaaaagaaaaggtatgtcacattaacacgatttctatttgctttaaggttattatactatttgatctgggtaatgtcaaagatgtaatgtactttgatttagaagatatttaacagactcattatgwattaggagtatagacaggaaaatattagctggtttaggtgaattaaactaattagtcaaatccctgaagtattttatattgcaaattctgcatattaccagccttgacgtgtgttctatagtgctctgctgtagatgttgtcatgtatcctttgaaattctacatttttatcaaaagttagaatgaaagtatatttatctaagttacacaggattaaaaaacataagcggttgataacacagagaaagagaatgaagatttaagtatctctacaggcaattatgctagaccaaaattaac

SEQ ID NO: 171506 - DNA, 601 bp, Human
gttctcactcataggtgggaaatgaaaaatgagaactcttggacacaggaaggggaacatcacacaccagggcctcttgtgagggggggggaggggggagggatagcattaggagatataactaatgtaaatgacgagttaatgggtgttgcacaccaacatggcacatgtatacatacgtaacaaacccatacattgtgcacatgtaccctagaacttaaagtataataaaaaaaatatatctataaaaaaactacaccatagcaggtgcaacttagtttcagcaaacatttacattcayataatttaacactgttaaattgaatttgattagttttgtgggagttctttggtatttagtttataaatatattttattttatagttgtatgtgaattatatgtacaagaattccaaattcctgttaggtttgaacataaccaattaacattaatataaaaataatttaagtaaatacaggggatcaacaagaagttattttgtatgtttttgttgttgttgttacttgtttgtttcccttcctttgaaagagcttgctacacatctaaagtttgtaggggtgggaattattataatggct

SEQ ID NO: 171507 - DNA, 601 bp, Human
tttgttgtgtctctgccaggttttggtatcaggatgatgctggcctcataaaatgaattaggaaggagtccttctttttctaccgtttggaatgaatttcagaaggaatggtatcagctccactttgtacctctggtagaatttgcccgtgaatctgtctggtcaactactaattactgcctcaatttcggaacttgttattggtctatttagggatttgacttcttcttggtttagtcttaggagggtgtatgtgtccaggaatttattcacttcttctggattttctagtttatttgcrtagaggtgtttatagtattctctgatggtagtttgtatttctctgggatcagtagtgatatctcttttatcattttttattgtgtccgattcttctctcttttcttctttattagtctgactagcagtctgttaatcttttcaaaaaaccagatcctggattcattgattttttgaagggttttttgtgtctctatctccttcagttctgctctgatcttagttattttttgtcttctgctagcttttgaaatgtggcacatatacaccatggaatactatgctgccataaaaaaggatg

SEQ ID NO: 171508 - DNA, 601 bp, Human
gataatcatgtggtttttgtcaatggttctgtttatgtgatggattacctttattgagtcacatatgttgaaccagccttgcatcccaaggatgaagccgacttgatcatggtggataaagctttttaatgtgctgctggattcggtttgccagtattttattgaggattttcacatcaatgttcatcagggatattggcctgaagctttctttttttgttgtgtctctgccaggttttggtatcaggatgatgctggcctcataaaatgaattaggaaggagtccttctttttctaccgyttggaatgaatttcagaaggaatggtatcagctccactttgtacctctggtagaatttgcccgtgaatctgtctggtcaactactaattactgcctcaatttcggaacttgttattggtctatttagggatttgacttcttcttggtttagtcttaggagggtgtatgtgtccaggaatttattcacttcttctggattttctagtttatttgcgtagaggtgtttatagtattctctgatggtagtttgtatttctctgggatcagtagtgatatctcttttatcattttttattgtgt

SEQ ID NO: 171509 - DNA, 601 bp, Human
ctgtctattactggtatataggaatgcttgtgatttttgcacattgattttgtatcctgagactttgctgaagttgtttatcagctgaaggagattttgggcatctttgagacagggcatcacacaccctgcctgtcgggggttgggagcgataggggatggataccattaggagaaacacctaatgtagatgatgggttgttgggtacagcaaaacaccatggcacgtgtatacctatgtaacaaacctgcatattgtgcatatgtatcccagaacttaaagtataataataataagaakaagaagaaagataatgccagacttgaattctctctacccaggactttttttaaaaactcgtatggcaattattatataatttatatataattacataaaaatggggttttctaaatatacaatcatgtcatctgcaaacagagacaatttgacttcctctcttcctatttgaataccctttctttctttctcttgcctgactgccctggccagaacttccaatactatgttgaataggagtggtgagagagggcatccttgtcttgtgccagttttcaaagggaatgcttccagcttttg

SEQ ID NO: 171510 - DNA, 601 bp, Human
tggctgtctattactggtatataggaatgcttgtgatttttgcacattgattttgtatcctgagactttgctgaagttgtttatcagctgaaggagattttgggcatctttgagacagggcatcacacaccctgcctgtcgggggttgggagcgataggggatggataccattaggagaaacacctaatgtagatgatgggttgttgggtacagcaaaacaccatggcacgtgtatacctatgtaacaaacctgcatattgtgcatatgtatcccagaacttaaagtataataataataakaagaagaagaaagataatgccagacttgaattctctctacccaggactttttttaaaaactcgtatggcaattattatataatttatatataattacataaaaatggggttttctaaatatacaatcatgtcatctgcaaacagagacaatttgacttcctctcttcctatttgaataccctttctttctttctcttgcctgactgccctggccagaacttccaatactatgttgaataggagtggtgagagagggcatccttgtcttgtgccagttttcaaagggaatgcttccagctt

SEQ ID NO: 171511 - DNA, 601 bp, Human
gttttttctaattctgtgaagaaagtcaatggtaacttgatggggatagcattgagtctataattactttgggcagtatggccattttcatgatattgattcttcctatccacgagcatggaatgtttttctattgtttgtgtcctctcttatttccttaagcagtggtttgtagttctccttgaaatggtcattcacaagccttgtaagttgtattcctgggtattttattctctttgtagcaattgtgaatgggagttcactcatgatttggctgtctattactggtatataggaatgyttgtgatttttgcacattgattttgtatcctgagactttgctgaagttgtttatcagctgaaggagattttgggcatctttgagacagggcatcacacaccctgcctgtcgggggttgggagcgataggggatggataccattaggagaaacacctaatgtagatgatgggttgttgggtacagcaaaacaccatggcacgtgtatacctatgtaacaaacctgcatattgtgcatatgtatcccagaacttaaagtataataataataagaagaagaagaaagataatgccagacttga

SEQ ID NO: 171512 - DNA, 601 bp, Human
agggagagtgaaagataatcccttttgctgtgcagaagctctttagtttaattagaacccatttgtcaattttggcttttgttgccattgcttttggtgttttagtcatgaagtctttgcccatgcctatttcctgaacggtattgcctaggttttcttctatggttttttggttttcggtcttagatttaagtctttaatccacctcgagttaatttttatataaggtgtaaggaaggggtccagtttcagttttctgcatataactagccagtttacccaacactgtttattaaatagkgaatccttttcccattgtttgtttttgtcaggtttgtcaaagatcagatggttgtagatgtgtggtgttatttctgaggcctctgttctgttccattggtctatatatctgttttggtaccagtaccatgctgttttggttgctgtagccttgtagtatagtctgatgtcaggtagcacgcctccagctttgttctttttgcttaggattgtcttggctatatgggctctttcttggttccatatgaaatttagagtagttttttctaattctgtgaagaaagtcaatggtaacttgatg

SEQ ID NO: 171513 - DNA, 601 bp, Human
aacacatagcatctattgttctgcccaccccactaataggtttagaacactgttttcttcaccagagtctgtgttaatagtggaaagactatataggctttgaggtcacagaagatctgtatttaaataaagtatctattactcactgacctcaaacaagttcctaagtttctcattggtaaaatgaagataatactactactttcatataattgttatgagaattgaatgagatataaaaaaaacacatcaatagataagtttctagtacaaacaaggaggttaaatggtagctgatatyatcatcatcatcatcatttaaccatgctcagcatcccagccagaagcatcttgctcctgaacagcttctggattttatttaactctgtaaaaaacaaacaacaaacaaaaaaaccagccttttctattgtgaaaactgaaagaagcagcacctcactgaaggaacaaagaaacatttaaaacctttgtgggcactctaagggaatacccagagaagagtgataattgctgtcttccttaggcaattaatactatactgaaccgtttttgctagattaatgggagactctattccaattcc

SEQ ID NO: 171514 - DNA, 601 bp, Human
attatgtcgtcagtccccttcgtcaacacagatgaccttaagtgctctaagaatgcaacacatagcatctattgttctgcccaccccactaataggtttagaacactgttttcttcaccagagtctgtgttaatagtggaaagactatataggctttgaggtcacagaagatctgtatttaaataaagtatctattactcactgacctcaaacaagttcctaagtttctcattggtaaaatgaagataatactactactttcatataattgttatgagaattgaatgagatataaaaaaaacacatcaatagataagtttctagtacaaacaaggaggttaaatggtagctgatatcatcatcatcatcatcatttaaccatgctcagcatcccagccagaagcatcttgctcctgaacagcttctggattttatttaactctgtaaaaaacaaacaacaaacaaaaaaaccagccttttctattgtgaaaactgaaagaagcagcacctcactgaaggaacaaagaaacatttaaaacctttgtgggcactctaagggaatacccagagaagagtgataattgctgtcttccttaggcaa

SEQ ID NO: 171515 - DNA, 601 bp, Human
cttgagatgtaactgaggaaagaagagaaatgttatttcattttcttattctttgctgtataaattgtgtgaaatgtcattctgtcttcaaaggttttgtgtgctgtctacatgcacgtagtctgttgtgtgtactcaataacaaatcagtattcttttttcccatattgatgtggataggtgtctctttgttgctaggactttttacttataaacttcccatttgtcagccatgttcccatcaactttcagttctgaaataatcatcttccccaaagcaccaagcttcagaaacaagttkgggctctatcactaagagtcattacagctatggttagcaagttaaagggatgttcttaggataataaatacatccctaattctgaaggcagagatgtgtataaaagaatagcatttaaaattaggatttcctttgatatattacgtactcaagcttacaatatggtaatgcaattttttcttgaacaaacatgctattaaaaatgaaatgctcaaaatcaaatatggggaaattactcatttaaaaaaacacttttatctcatttttctatattttattcccttaacaacacttatcatt

SEQ ID NO: 171516 - DNA, 601 bp, Human
ccacagggtctagataaacccagtctctagtttcacactgcaaagatgtctccaaggttgcagacctcataaccccttgaaatataaacatactcttagagctaatctaggagcctatcttgagatgtaactgaggaaagaagagaaatgttatttcattttcttattctttgctgtataaattgtgtgaaatgtcattctgtcttcaaaggttttgtgtgctgtctacatgcacgtagtctgttgtgtgtactcaataacaaatcagtattcttttttcccatattgatgtggataggtstctctttgttgctaggactttttacttataaacttcccatttgtcagccatgttcccatcaactttcagttctgaaataatcatcttccccaaagcaccaagcttcagaaacaagttggggctctatcactaagagtcattacagctatggttagcaagttaaagggatgttcttaggataataaatacatccctaattctgaaggcagagatgtgtataaaagaatagcatttaaaattaggatttcctttgatatattacgtactcaagcttacaatatggtaatgcaattttttctt

SEQ ID NO: 171517 - DNA, 601 bp, Human
tctaatctcattcctgagggctccaccctcatgacctaattacctcccaaaggctccacctccaagtaccaacacatttggattagaatttcaacatatggattttgggggaacataaacatcccatcagttgcagtcccctacttacacacagcttcatataaaaccagtcattgctgcttctcatatcttgctttctcaaccttcaactgacctgacctttattctaactcctccctctattgtaggtcaccttgcctttgccaaatgattcagttttttcgagaacgtacagtcagcyctctgtatctgtgggctccacatccatggattcaaccaattgtgaatttaaaccacttgaaaataaactgcatctgtactgaacatagatagacttttttcttgtcattatttccttaaaaatacagtatagcaactatttacatagcatttacattgtattacgtattccaagtaatctatagataatttaaaatatacacgaggatatgcatatgttatatgcaaaggttatatgcaaatactataccattttatatcaggaacttgagcatctttagattttggtatctgtcaggga

SEQ ID NO: 171518 - DNA, 601 bp, Human
agtgagctgagatcatgccactgcactgcagcctgggcgacagaacaagactccatctcaaaaaaagaaaaaacgtgttagctagaagaaaattattccgtcttcacatgccccaaagcctgggcattttgtttcactgtcattttacataagtaatatgacagaaagaaccacagagaataaaaaagatctgcctttttttttctgaatctgaagctatacgagttttggcaatcttattttccttatctacaactcagagataagaccatcagttctatctgtttttaaggattaattytgaagataaagtgaaactatgttaaatatttctgtaactagaaagtttcattcctctatatcctattacatttattatttcttgaatataatataaaaaattatctctgcagacagtcaaaatttccattaagtgtctgagaagcaagactggcaccttaatctatgtccctggggtaagtattacagcaccacggtgtgcattgtactgaaatgagtacccgtggtgatgtgtacccagttcctttttctttccattactctttcttctaaactctatagcaccaaaagtagaaggcag

SEQ ID NO: 171519 - DNA, 601 bp, Human
gggagcctgatgcaggaaaattgcttgagcccggaaagcagaggttgcagtgagctgagatcatgccactgcactgcagcctgggcgacagaacaagactccatctcaaaaaaagaaaaaacgtgttagctagaagaaaattattccgtcttcacatgccccaaagcctgggcattttgtttcactgtcattttacataagtaatatgacagaaagaaccacagagaataaaaaagatctgcctttttttttctgaatctgaagctatacgagttttggcaatcttattttccttatctayaactcagagataagaccatcagttctatctgtttttaaggattaattttgaagataaagtgaaactatgttaaatatttctgtaactagaaagtttcattcctctatatcctattacatttattatttcttgaatataatataaaaaattatctctgcagacagtcaaaatttccattaagtgtctgagaagcaagactggcaccttaatctatgtccctggggtaagtattacagcaccacggtgtgcattgtactgaaatgagtacccgtggtgatgtgtacccagttcctttttctt

SEQ ID NO: 171520 - DNA, 601 bp, Human
ggcatccttgtcaacaattaattgaccataaaggtaagggtttatttttgaacactcaattttattacactggcctacatgtctatatttatagcagtaccactgtccaattaagaccactatcttaattactgtagttttaaaataaattttgaaatcagaaagtattagtccttcatagttcaagggtgttttatctgtttgggtctcttgtattttatttatttatttatttatttatttatttatttatttatttatttttggtgacagggtctcattccatcacccaggctggagwgcagtggtgtgacctcagcttactgcagcctcaacttcctgggctcaggtgatcctcccacctcagcctcccaagtagctgggactacagacatgtgccaccacacctggctaaatttttttttgtattttttttttggagacagagttaaaactacaaaaattagccaggcattgtggtgggtgcctataatcccagctacttgggagcctgatgcaggaaaattgcttgagcccggaaagcagaggttgcagtgagctgagatcatgccactgcactgcagcctgggcgacagaacaa

SEQ ID NO: 171521 - DNA, 601 bp, Human
gagatagacacttgtactaaaaacatttgttgaaaaaagactattctttccttgctgaattatcttggcatccttgtcaacaattaattgaccataaaggtaagggtttatttttgaacactcaattttattacactggcctacatgtctatatttatagcagtaccactgtccaattaagaccactatcttaattactgtagttttaaaataaattttgaaatcagaaagtattagtccttcatagttcaagggtgttttatctgtttgggtctcttgtattttatttatttatttatttatttatttatttatttatttatttatttttggtgacagggtctcattccatcacccaggctggagagcagtggtgtgacctcagcttactgcagcctcaacttcctgggctcaggtgatcctcccacctcagcctcccaagtagctgggactacagacatgtgccaccacacctggctaaatttttttttgtattttttttttggagacagagttaaaactacaaaaattagccaggcattgtggtgggtgcctataatcccagctacttgggagcctgatgcaggaaaattgcttgagc

SEQ ID NO: 171522 - DNA, 601 bp, Human
catggagatagacacttgtactaaaaacatttgttgaaaaaagactattctttccttgctgaattatcttggcatccttgtcaacaattaattgaccataaaggtaagggtttatttttgaacactcaattttattacactggcctacatgtctatatttatagcagtaccactgtccaattaagaccactatcttaattactgtagttttaaaataaattttgaaatcagaaagtattagtccttcatagttcaagggtgttttatctgtttgggtctcttgtattttatttatttatttatttatttatttatttatttatttatttatttttggtgacagggtctcattccatcacccaggctggagagcagtggtgtgacctcagcttactgcagcctcaacttcctgggctcaggtgatcctcccacctcagcctcccaagtagctgggactacagacatgtgccaccacacctggctaaatttttttttgtattttttttttggagacagagttaaaactacaaaaattagccaggcattgtggtgggtgcctataatcccagctacttgggagcctgatgcaggaaaattgctt

SEQ ID NO: 171523 - DNA, 601 bp, Human
tcacatggagatagacacttgtactaaaaacatttgttgaaaaaagactattctttccttgctgaattatcttggcatccttgtcaacaattaattgaccataaaggtaagggtttatttttgaacactcaattttattacactggcctacatgtctatatttatagcagtaccactgtccaattaagaccactatcttaattactgtagttttaaaataaattttgaaatcagaaagtattagtccttcatagttcaagggtgttttatctgtttgggtctcttgtattttatttatttatttatttatttatttatttatttatttatttatttttggtgacagggtctcattccatcacccaggctggagagcagtggtgtgacctcagcttactgcagcctcaacttcctgggctcaggtgatcctcccacctcagcctcccaagtagctgggactacagacatgtgccaccacacctggctaaatttttttttgtattttttttttggagacagagttaaaactacaaaaattagccaggcattgtggtgggtgcctataatcccagctacttgggagcctgatgcaggaaaattg

SEQ ID NO: 171524 - DNA, 601 bp, Human
tttttcacatggagatagacacttgtactaaaaacatttgttgaaaaaagactattctttccttgctgaattatcttggcatccttgtcaacaattaattgaccataaaggtaagggtttatttttgaacactcaattttattacactggcctacatgtctatatttatagcagtaccactgtccaattaagaccactatcttaattactgtagttttaaaataaattttgaaatcagaaagtattagtccttcatagttcaagggtgttttatctgtttgggtctcttgtattttatttatttatttatttatttatttatttatttatttatttatttttggtgacagggtctcattccatcacccaggctggagagcagtggtgtgacctcagcttactgcagcctcaacttcctgggctcaggtgatcctcccacctcagcctcccaagtagctgggactacagacatgtgccaccacacctggctaaatttttttttgtattttttttttggagacagagttaaaactacaaaaattagccaggcattgtggtgggtgcctataatcccagctacttgggagcctgatgcaggaaa

SEQ ID NO: 171525 - DNA, 601 bp, Human
ttattttttcacatggagatagacacttgtactaaaaacatttgttgaaaaaagactattctttccttgctgaattatcttggcatccttgtcaacaattaattgaccataaaggtaagggtttatttttgaacactcaattttattacactggcctacatgtctatatttatagcagtaccactgtccaattaagaccactatcttaattactgtagttttaaaataaattttgaaatcagaaagtattagtccttcatagttcaagggtgttttatctgtttgggtctcttgtattttmtttatttatttatttatttatttatttatttatttatttatttttggtgacagggtctcattccatcacccaggctggagagcagtggtgtgacctcagcttactgcagcctcaacttcctgggctcaggtgatcctcccacctcagcctcccaagtagctgggactacagacatgtgccaccacacctggctaaatttttttttgtattttttttttggagacagagttaaaactacaaaaattagccaggcattgtggtgggtgcctataatcccagctacttgggagcctgatgcag

SEQ ID NO: 171526 - DNA, 601 bp, Human
gcatgcacaagcatcaacagtggcgatcagggcaggcctgccctcagggccccggatggatgagcatgtggtagtggtggcagctatgagtggggcaggccaatatgcaggtatccggagggtgtatgtgggcactggagacagtctgcctatggaagtcctgtcctcaggccctatgaaggtgcacacagttgtgaagttggagtggaggggaggttgttctgagttgcagcagcccagaacaggcagctctaaggctctggggagtatcagtactgggggcagccaccctggtgtgctmtatcacctgttccccagggtgtagtgcactgcataggccagaatcctggggaccaagccacaatgccagatttagctgtcattgtggtgttgcagctttctaggtgaatacaggggttataagtgggactttggggatgtgaaaatgcaaggcccgttgggcctcagggaataatgtagtctggtgggagttgggttctcaaagtggctccatgctgcagctgctttggtctcggggagtgagtgggagccagtgtgagttccctctctgcaacaattcacttgcacagaccctaggcag

SEQ ID NO: 171527 - DNA, 601 bp, Human
tgacactggctgcagttgttgctggcagctgtgacaaggacttgctggggacaaggtcaccaggtgggctggtccttgggcatgagtgatgttgctggtaaactaggcatgccagtccttgggcccttgggtagtatacactggcaccagtaatggctgtggggtgacccaggtaggctgatcctcaagccccaggcagcatgcttggacattagtggtagctgaggagggccaggttggcatgtgtttgggcccctggacagtgtgcatagcactggcagtgacaatagcagtggcaggrcagccttgggcccgtgggagtgaagacaccagaagtagtgtttgtaggctgggcagaccagtccctaggatcttggatggaatgcctagatgaggagtacagcagcaggttgagtggcctgtctctgggggcctgggaagtgcacatgtgcagtggtagtgaccatgacagcagatggcagcaggtaggcatatgtcagtggcaatgaacatggtaggcctgtcctcagtcttctggctagtggacaagggggcatgtggtggtgagaaggatgggctgatcctcaggcttcaaaatagt

SEQ ID NO: 171528 - DNA, 601 bp, Human
ctggatataggagttttggctggcagtattttcctttcagcacttggaatagatcattctcttttctcttgggctgtcagacttctgttggaaaatctgctgttagtctgatatggcttcccttacatgtaactgaattcttttctcttgctgtttgtagaattctcttttactgttgcctgtttgactaaaacatgcaccagaaaagatctttttagatgaaatatgtttaggaatctttcacctttctgtatctggatgtctatatcttccaaaagacttgggaaattttcagttattrtttcattaaataggttttctatagctttgcccatctcttctccttctgaaaatccaaatatatctgtttactttatagcatcccatgtgtcacatggatgttcttcactccttttattttcttttggctttttaaaatttttttggttttttgtttttattggggctgggttattttggaagctctatcttcaagtttaattatttcttctgcttgatctagtctactgttgaagatatcaattgtatttttaaaaattcattgaattcttcagttctacaatttctgtttggttctttc

SEQ ID NO: 171529 - DNA, 601 bp, Human
tattcctaggtattttttgtagctattgtaaatggcatagttttcttgatttctttttcagctagttcattattggtgcgtagaaatgcaattttactgaacttgtgtatcacttctaagagattcttttttatggggtctttaggttttcttatatacaagatcatgttgtttacaaagagggaaaatttgacttcctgttctccaattttcataccttatatttctttctctttcctgatttctgactaggacttccagtactatgttgaataagagtggtgaaagcagacatctttgycttgtctcagttcttagaggaaaggctttcagcttttcccgattcagtatgtatgttagccatgggtttgtcatatatgacccttattatattgatgtatgctctttctgtgcctaatttgttgagtctttaacatgaagggatgctgaattttatcaaatgctttttctgcatctagtaaaatgaacatttggcttttgtccttcattctattgatgtaacatatcacatttattgagttgtgtaggttgaacaatcactgaatctctgggattcctatttgatcacggtaaatgatca

SEQ ID NO: 171530 - DNA, 601 bp, Human
ggctgtactaatttacatcctaccaacagtgtataggagtttccttttctctgcatctttgccagcatttgttattttttgtctttttgataatagccattctaactggagtgacatctctcattgtggttttgatttgcatttccctaacaattagtgatgttgaatgctttattcatatatttcttggccatttgtatgtctccctttgagaaatgtctgtttagtttctttgcccactttttaaatgggtttttttttgttttgttttgttttttgctgttgatttgtctgagttccytgtatagtctgtgtattagtcccttgttggataaatagtttgcaaatattttctcccgttctacaggttgtctcataactgttgattctttcctttgctgtgcagaagcttcttagtttaatataatcccatttacctatatttcttttttgtcacctgtgcttttaaagtcttacccataaaatatttgcaaacactaatgtcctgaagtgtttccctatgctttcttctactggttttatcattttcattttacatttaagcatttactccatcttgagttggtttctgtctatggtg

SEQ ID NO: 171531 - DNA, 601 bp, Human
ttgtgaacattcaaaatcctctcatctagctttttgaaaagacacaataaattatagttatccatattcactgtaaggtgctgcagaacaccagaacccattccacctatctagctgtaatttttgtatctgttaactaacctcgtcccatctttctctatcccctactcttcccaacctcacccacaattctactctccatttccataagctcaaaatgtttttttggcacccacatatgtgtgacaacatgtggttattgatctttctatgcctgattagttgtgtttaatataatgtmctccaggctcattcatgttgttgcaaatgacacggatgcattctttttttatttcattgtgtatatgtactgcattttctttaaccattcatccattgattgacatttaggttgattctatatattagctattgtaaatcgtgctgtaataaacatgtgagtgtcagcaactttttaatatcctgacttcgctggctttggataaatactcagtagtgggattactaaactgtatggcagttctatttatagttttctgagaaacctccatgatgttttccataatggctgtactaattt

SEQ ID NO: 171532 - DNA, 601 bp, Human
gtgtacaatgggtaatgatcaaatcagggtaacaagtgtatcaatcacctcaaacatttattattactttgtgttgtgaacattcaaaatcctctcatctagctttttgaaaagacacaataaattatagttatccatattcactgtaaggtgctgcagaacaccagaacccattccacctatctagctgtaatttttgtatctgttaactaacctcgtcccatctttctctatcccctactcttcccaacctcacccacaattctactctccatttccataagctcaaaatgtttttttrgcacccacatatgtgtgacaacatgtggttattgatctttctatgcctgattagttgtgtttaatataatgtcctccaggctcattcatgttgttgcaaatgacacggatgcattctttttttatttcattgtgtatatgtactgcattttctttaaccattcatccattgattgacatttaggttgattctatatattagctattgtaaatcgtgctgtaataaacatgtgagtgtcagcaactttttaatatcctgacttcgctggctttggataaatactcagtagtgggattacta

SEQ ID NO: 171533 - DNA, 601 bp, Human
atattccatccaaactgagcattatcttggaaagaatttagggaaaacagtcacaggaaggagaacataatagaggtgaagaggcccctttgtctttatttttaatggttttatttagataaaattcacataccatagaattaacccattcaaagtatacaattcagtggattttacagacgattcagagaattacagaatcatcatcacaaacccttttagaatagtttcatcaccccacgaagaaactttgtattccattagcagtcagtcttcatctctctccctccctgcgtcagtsataggcaaactactaatctagtcttcacagatttgcccattctgatgtttcatataaatggaaccatattcccatgtttccttctaagagatttattaatatcatttgagttctccatttaggtctataatccattttttccctttttctagttgatatttaataattgtatacatttatggaacgtagaatggtatttcaatgtgtgtacaatgggtaatgatcaaatcagggtaacaagtgtatcaatcacctcaaacatttattattactttgtgttgtgaacattcaaaatcctct

SEQ ID NO: 171534 - DNA, 601 bp, Human
catttaagacactcttttgaaaaatatctgatggaaaaccaccaaacctacctgaaaatttcagcaaaaggagaactaatattccatccaaactgagcattatcttggaaagaatttagggaaaacagtcacaggaaggagaacataatagaggtgaagaggcccctttgtctttatttttaatggttttatttagataaaattcacataccatagaattaacccattcaaagtatacaattcagtggattttacagacgattcagagaattacagaatcatcatcacaaacccttttagratagtttcatcaccccacgaagaaactttgtattccattagcagtcagtcttcatctctctccctccctgcgtcagtcataggcaaactactaatctagtcttcacagatttgcccattctgatgtttcatataaatggaaccatattcccatgtttccttctaagagatttattaatatcatttgagttctccatttaggtctataatccattttttccctttttctagttgatatttaataattgtatacatttatggaacgtagaatggtatttcaatgtgtgtacaatgggtaatg

SEQ ID NO: 171535 - DNA, 601 bp, Human
tgcttttttttaaattagaaatctaacccaatgtattaaatggggagagcaagaatactataaatgactccagaaaatctctgtttctacaaaggaccagaaaagcagccactgcaataagagtgcaaaacaccatgaccaaataaggaaggatctggacactgattacttaaagtaacttaatggattcagatctgtgggcccaatgaagtttattacgcagaaatttgaaaataggctgaagacatcacagagctctaccaatcataacagagaaggcatggaaagctggtgaaaatgytggaacgagtttctttttacatgttgttcaatttttatttttgcaattagagctatataaaaatcaacagaatgtatgtcaatataaataggtcaaaagccatgagcagaaaataaagagttcaaacagcaagcataagcacacaatcagtgaatatgaaataattgatttttcagaaacatatacagatattgctaaagatgtactccctttaaagtaacagaaaaatcatattaattcattcactcattataccaacatttgattggatactcaacatgtacctggcagtgaaccaag

SEQ ID NO: 171536 - DNA, 601 bp, Human
acacactaaatgagggttaaatactaacttaaaaaacgattaagaaggagcagtgttctatttgtactattgtagggagtctatgatggctgacacaatacggagatcttcaggggaaacattttgattgggtttcccagacgctctgacctcttcgacactacttgttctgaactgtacatctgatacatttccttcatctttgcttcttataatgtcttatatctacttagcatctaaccatttcatattttcctcttattttcctaaactagagaactgaacaaatgaaatagaaaaktattcaaagatataatacaggaacgtttctgtgaaatagagaattcaatagtaaggtagaaatggcacaccatgtatcaggggaaaaggttattaaacttcaatattaaattaaaaattctataggcaccaagcagaaataaagtaagtctcaagggaccaaaaagaggccaatttcaaatgtccctaacaagaggattagatataagaaaataaaaggttctgaaggggaaaatgtaacccaggtttattttgtacagaataatttgctcaaattctcattatcagcagaaacaatcct

SEQ ID NO: 171537 - DNA, 601 bp, Human
taatatcacaggaaagcttttgcctatgattctcacaaattagtgaactttaaggcatcatttttccaattacctttcaggtaaacataacagaaaaaaaaggcttcatttgtggaaaagaatggcaaatccttgccatcagtaggttaatctttgcttatgttatttccttcacctaaagttacctccggcaatctccacatgtcctaattccacccatctttcaagatggagttacctgttcttcaaaaatttctcaatcctggctgtacattagaatcacctggagatgttttgaaamattatcaatgtccagagtctactccaggccaaatatatggaaagcaaatggcttatgtttcatagaattaatgttttcttcttaattaaaataaaacaaaaacactaacaaaaatccctgcggccgattaaaaaaaaaaaatgctccattttccaataatagagtaggaaatttgaagtccttacagtattgctccccctcttctttcagaatgagttttatatttacaattgggtgtttcttaactgtttacatgaaggaaaggagacatatccaaggatgagtgctagagacaaacat

SEQ ID NO: 171538 - DNA, 601 bp, Human
tgatctgaagccctgacaaagttgggtttattattttcatctggtagctacctgtgactcactgctcttaattactattccttcaaaatatttatattatgtttcttgtgtctcacaatcaatatttataggcttgaaatacacattttaagcctgtggtcaaagcagaaacataaaaaccaggattgtactgttttgctctttttcaatatcattgctattatcagacatgttttcaataaatcctgttttgtttaatatcttgccatggatgggcctgtctaacagaatcagagtggawgggcttattatgctataaatgatgagttgcaggatgttatcaagaacaatatcttactcttctctaatatcacaggaaagcttttgcctatgattctcacaaattagtgaactttaaggcatcatttttccaattacctttcaggtaaacataacagaaaaaaaaggcttcatttgtggaaaagaatggcaaatccttgccatcagtaggttaatctttgcttatgttatttccttcacctaaagttacctccggcaatctccacatgtcctaattccacccatctttcaagatggagtt

SEQ ID NO: 171539 - DNA, 601 bp, Human
tgatgggtgcaccaaaatctatgcatgtcaccaactaccacctgtttcccaaaatcctattgaaataaaaaaaattaaaaagtagatgaacatagagggctactgaaaggcacagaaatatacctgtagagacgtattagatatattagggtgtaacagcaagtgggagaagttgaaattaaaagcatttgaaagtaaagaataggaaaaagggtcagaacttcaggaataatttaaaagtggaggaaagaaagttttctatactatactttattgataaaggttctacttcttcaaacayttggaaattattgaaatacagcctaatgttcattttgcaagtgaagtcaataggtaagatggtttacccaaagtttctagctagttggtgacagagacacaactagaatttagttctcctgacacaatactaattattcttactactttactgattcttctttccttgtctccttcctatccttatttttaatgtcacattacttcgaaaattgtgagaaaaatctcctatttattatgacaaaggttgttgactctcaccaccataggatccatcatagagcacttagaaactttcagg

SEQ ID NO: 171540 - DNA, 601 bp, Human
aaattccaaatttattatgttcttccacacatgtaaaattcccataaggctctgcttgtgaaaacaattgctaccattttgaaaagtttataaggaaaacatgtagaatggatgagtagcttaaaggagtaataagatacaatatctgaatatttttaagaaaaaaagtaataaaacaaaatgatacattggactttggggactcaggggaaaggatgggggttggtgagaaatagaagactacacactgggtacagtgttcactgcttgggtgatgggtgcaccaaaatctatgcatgtmaccaactaccacctgtttcccaaaatcctattgaaataaaaaaaattaaaaagtagatgaacatagagggctactgaaaggcacagaaatatacctgtagagacgtattagatatattagggtgtaacagcaagtgggagaagttgaaattaaaagcatttgaaagtaaagaataggaaaaagggtcagaacttcaggaataatttaaaagtggaggaaagaaagttttctatactatactttattgataaaggttctacttcttcaaacatttggaaattattgaaatacagcctaatg

SEQ ID NO: 171541 - DNA, 601 bp, Human
ccattagaattttactttactaccttttttttcctatttacaaatccaactatttatcatgttagatattctgaatttcctcttcagaaccaccttccaccttctgtaccctgctctgtaccccaggaagatgacttttctgtactgcatcaaatcattcccctgcactctagtttccagttgggtttggccaatggtaaacgatggcaggtgaccagagtgggagaggagagaaagtctggtttattcattctcttggtttgctctctgctgatctgtgatttggcagtggcttattctyccacctaaggcaagagatcccacagtgggcccttcccactgttaaagctttccctaggttccatcccttcccttgctccatcaagattgacagtgttagtggttcccaccattgctagtccctagggcttcaccatcccttagtggtttccttaagattgcccacaactttgttaagaagtctcccactgagtgtggcattaagttcctgctggggccctgactgatatgctaatatacataaaggccactatgtagtccctttctttgagtcagtgttgtagaataaacagaccactgg

SEQ ID NO: 171542 - DNA, 601 bp, Human
ttatacttcttaaatgcttcgaggaggcttttttggctccccaatatgttaggtgtatttgatacaaattcctaaacaactccgtatttctcttttcaaaacacttatcatgcttgaaatgtataattaaagtccacctttcaaacaagattacaaattccctgtccacagggaatttgttttgaatttctgactcgacttaaagacattgcctggtatatagcaggtgcttaataaatattggctgaatgaacgaaataaagcattccattccatgtgcatattataaacatatttgatrtttttgcccttcaaccaagatcatagttctctgagggagggaccatgttttatacttgagtgtccttagcagtgcctacaaaagggtatgtgctagataaatacagattaacaacgttctcttatctaaaactttctacagcagaagaaagtataaagtctcttcaaagtacacattttctgctacatctcactatgtcttagaaattcccccttgtgcttaatatacatacacacataagtgtatgaacatatatgcaaacaaaacaagcacaaatgaaacctttccattagaatttta

SEQ ID NO: 171543 - DNA, 601 bp, Human
atcttctctgcccttctactagtacgcccctgcaaacaccctcatctctactgcccccagctgcccttcaccttactatcctctatgacctgaataacttcctacttatacttcttaaatgcttcgaggaggcttttttggctccccaatatgttaggtgtatttgatacaaattcctaaacaactccgtatttctcttttcaaaacacttatcatgcttgaaatgtataattaaagtccacctttcaaacaagattacaaattccctgtccacagggaatttgttttgaatttctgactygacttaaagacattgcctggtatatagcaggtgcttaataaatattggctgaatgaacgaaataaagcattccattccatgtgcatattataaacatatttgatgtttttgcccttcaaccaagatcatagttctctgagggagggaccatgttttatacttgagtgtccttagcagtgcctacaaaagggtatgtgctagataaatacagattaacaacgttctcttatctaaaactttctacagcagaagaaagtataaagtctcttcaaagtacacattttctgctacatctcacta

SEQ ID NO: 171544 - DNA, 601 bp, Human
agttataatagattactttcactttgttaaatatgccatgatctcttttctccctgggccttttgaacacatgatcttctctgcccttctactagtacgcccctgcaaacaccctcatctctactgcccccagctgcccttcaccttactatcctctatgacctgaataacttcctacttatacttcttaaatgcttcgaggaggcttttttggctccccaatatgttaggtgtatttgatacaaattcctaaacaactccgtatttctcttttcaaaacacttatcatgcttgaaatgtrtaattaaagtccacctttcaaacaagattacaaattccctgtccacagggaatttgttttgaatttctgactcgacttaaagacattgcctggtatatagcaggtgcttaataaatattggctgaatgaacgaaataaagcattccattccatgtgcatattataaacatatttgatgtttttgcccttcaaccaagatcatagttctctgagggagggaccatgttttatacttgagtgtccttagcagtgcctacaaaagggtatgtgctagataaatacagattaacaacgttctct

SEQ ID NO: 171545 - DNA, 601 bp, Human
gataaaggacaataccacactccctttactttctgctccagttataatagattactttcactttgttaaatatgccatgatctcttttctccctgggccttttgaacacatgatcttctctgcccttctactagtacgcccctgcaaacaccctcatctctactgcccccagctgcccttcaccttactatcctctatgacctgaataacttcctacttatacttcttaaatgcttcgaggaggcttttttggctccccaatatgttaggtgtatttgatacaaattcctaaacaactccrtatttctcttttcaaaacacttatcatgcttgaaatgtataattaaagtccacctttcaaacaagattacaaattccctgtccacagggaatttgttttgaatttctgactcgacttaaagacattgcctggtatatagcaggtgcttaataaatattggctgaatgaacgaaataaagcattccattccatgtgcatattataaacatatttgatgtttttgcccttcaaccaagatcatagttctctgagggagggaccatgttttatacttgagtgtccttagcagtgcctacaaaa

SEQ ID NO: 171546 - DNA, 601 bp, Human
attgatatagaagtatcagtaagctgaggcagtagatgaagaagtttgaaagtaagtgctattgctgacagagattaagaaattccagcagtaagaatacacacatacatacacataaagaggtgtaaaatttatttcctaattattcacataattctgtgatactttttgtattctacttttggcaacaatcaatttaaaatggttctatctttataaaattgctaataaagaacacttgccaatttccttttaaaagatgttattactttaatatacagcaaaacatgacagaaaattscgaacaattcagctattttcttaaattagaagtaaaaaataaacttcggaaaaaattttgagaaaaattcattcttgtgcttatttctcagaaaaactttagaaataaacacatcaacataaagttttagttcaaaatggtaataatagaagtccaaattttatattcataatttttccatttgatggagtgattcatttacttagaatattttaatacctttctagtgctgtaggataaaggacaataccacactccctttactttctgctccagttataatagattactttcactttg

SEQ ID NO: 171547 - DNA, 601 bp, Human
tataagtgaacccacacagttcaaatctgtgttgctcaatggtctactgtatactgaaaaattagtacataaaaatttatagtcaccactgtattgcaactgttcccttcctgcaaacaaatgaatccccaccatactattagtttcttcctgagaagaatccccttgctatttatgtttaataatagtttttggttatttttccatttgcagaacatgcagtctggtcaccattccaagccttttcaagatcctgtcttactccatgctttgcatcttctctattctgagcacacactcyatgctaatactttcctcacaggctggaaaaatgtgcttttctccaatcctgctatgtctctgtcctatccattctgggagatgctttcccaatgtcacctccattataaaattgtccctcgtgtgcaaccctaccctctcaagtagaaataacctcacttgtctcagatgtagaatggctttgcacaagactttcttttggtgcttagcacattgtctcttgtagtatgtctccgtgccttaccccctttctaaactgaaagctttttcaaagcaggatctgtttaaaagtcaactttaa

SEQ ID NO: 171548 - DNA, 601 bp, Human
caatagtacagtatgtactataatcttatgcagttatgatgtaatactacatctttacatttgtttacatttctctcaactgcaagtggtagtgccgggtagagtcagtgtttttgtgcataagtttttttataaatttcaactttttgcaatatatttgtatatattttatagtagtaaatgatgaaacagactagtatctacatttttttaaacttttatttttggttcaggggtacatgtgtaggtttgttatacaggtaaacttttgtaacaggggtttgttgtacaggttatttcrtcacccaggtactaagcaaactacccaatagttatttttttctgatcctctcccacctcccaacctgcacactcaaggaggccccagtgtctattgtttccctctttgtgtccatgagttctcattatttagcttgcacttacaagtaacaacatgcaatatttgcttttcttttcttgtattagtctgctaaggataatgacctctagcaccatccatgtcccttgcaaaggatgtgatgtagttctttatggctgcatagtattccatggtgtatatgtaccacatttctttatccaa

SEQ ID NO: 171549 - DNA, 601 bp, Human
aataggacttcaacagcaacaagaggtggttatgaaattattgcaatagtacagtatgtactataatcttatgcagttatgatgtaatactacatctttacatttgtttacatttctctcaactgcaagtggtagtgccgggtagagtcagtgtttttgtgcataagtttttttataaatttcaactttttgcaatatatttgtatatattttatagtagtaaatgatgaaacagactagtatctacatttttttaaacttttatttttggttcaggggtacatgtgtaggtttgttatayaggtaaacttttgtaacaggggtttgttgtacaggttatttcgtcacccaggtactaagcaaactacccaatagttatttttttctgatcctctcccacctcccaacctgcacactcaaggaggccccagtgtctattgtttccctctttgtgtccatgagttctcattatttagcttgcacttacaagtaacaacatgcaatatttgcttttcttttcttgtattagtctgctaaggataatgacctctagcaccatccatgtcccttgcaaaggatgtgatgtagttctttatggctg

SEQ ID NO: 171550 - DNA, 601 bp, Human
aagaaagtaaataaactagaactggaagatctaaaaataccgtaacatgtagaacaaagagctaaagagtagaaaatatgaggagatcaagtaatatatgatatagaatgtgaaaatctaaattaatcagagtacctgagggagagaataaagagaatggggagaataaagagaatggggaaaggtaaattttgaagtaccagattgtgaaactccctgaagtaatgaaaaatatgaactcacgatatcaagcacagcatccaccaagaaatataaataaaacaaaatccagaattagacrcttagtcatgaatccacagatagcacagagatcataaaagcagagagagaagactgacactatatagaagtaatagaaaccagaacacaatggaataatattttcaatggattgagaaataataactgtcatcctagtgtggtacactcagaaaagctatatttttataatgctaatgagatcaacacaaaccaagagacttctccatgaataacacaaaagaaaattctaaaagtgcattactgaaacaaagaaaaatgaacccagaataacctaagattaaaaaaataggaaacaaag

SEQ ID NO: 171551 - DNA, 601 bp, Human
gaaatgagagtaggtaggaaaaaacataatagatttagctcaccaagggcatcaaatactagattttacgacttggaatataaaatatacataggacatttaaagaagtaaagaatgacatcacaaaatacaatgagagccaattaaaaactgatgagggatatttggaaaagaaaatagaacctttataaatttttaaaaaatggttgaaagtaaaacaaaacagcagatgggttaaataaaatattagatgccactaaagaaagtaaataaactagaactggaagatctaaaaataccrtaacatgtagaacaaagagctaaagagtagaaaatatgaggagatcaagtaatatatgatatagaatgtgaaaatctaaattaatcagagtacctgagggagagaataaagagaatggggagaataaagagaatggggaaaggtaaattttgaagtaccagattgtgaaactccctgaagtaatgaaaaatatgaactcacgatatcaagcacagcatccaccaagaaatataaataaaacaaaatccagaattagacgcttagtcatgaatccacagatagcacagagatcataaaagc

SEQ ID NO: 171552 - DNA, 601 bp, Human
ttctgtgcctggtttatttcacttagcataatatcatctgggctcattttaaatattttactaatacaatattttacgttgcatccaaatagcacaaagtagcaagaatcagtagagactactaaactggacaaatcagatgccaagttcatttttgtttgtttattctaaagtattccagtttggcttacctatattgatcaaaacaacttgataatttccagactgtcattgtgctataggcaaaaaatatctatcattcagcttctggcagtaggctggaaggatcctcatgaaaaayaaacaaaaaaagtagattttgcataaaatataattttcataacactgctgggcttaaaataggtgaggaaaatctccaaggggcctaagcaaaaataaaagcataaacgttgagctaaaagcttaactatgagctgaaagcgcatacttaagataggatagcttgagggtaaatgccagtctctgcactgtggtttggagatttagctttaccttagcagcaaggaagataagctgaaaatgagattcttggattatacctgaaaccctggaaggggctaaatttgttctaggtttgtaa

SEQ ID NO: 171553 - DNA, 601 bp, Human
agatcatgcagtaattgtctttctgtgcctggtttatttcacttagcataatatcatctgggctcattttaaatattttactaatacaatattttacgttgcatccaaatagcacaaagtagcaagaatcagtagagactactaaactggacaaatcagatgccaagttcatttttgtttgtttattctaaagtattccagtttggcttacctatattgatcaaaacaacttgataatttccagactgtcattgtgctataggcaaaaaatatctatcattcagcttctggcagtaggctrgaaggatcctcatgaaaaacaaacaaaaaaagtagattttgcataaaatataattttcataacactgctgggcttaaaataggtgaggaaaatctccaaggggcctaagcaaaaataaaagcataaacgttgagctaaaagcttaactatgagctgaaagcgcatacttaagataggatagcttgagggtaaatgccagtctctgcactgtggtttggagatttagctttaccttagcagcaaggaagataagctgaaaatgagattcttggattatacctgaaaccctggaaggggcta

SEQ ID NO: 171554 - DNA, 601 bp, Human
agaaataatagagaaacttatctgtaaagaaacttatctccaaataaggttacattcagagatactgggggttaggacttcaaagtatcttaggaagaggtacacagttaacccataacactcactctcctaaataatctgttcactagattatgggagtggtccgcctgtgatctaacagtccacagaatgcattaagaaaatgctcagaagcagtgaatccatatacccatctaatattacaacaactttcaccattcttgattccttttccaagttttatttttctccttagcacttrctatctaccgtactatttattttactaccttttctcatttatgtctatcatgatgataggatgctagatccataagagtagcgatttctatctacatgttccttgctatgttttctaccatgtggaacagtacacgccatgtaggcactctatagatattaatggaatggttaacttatatgaacttaatcaaccgtaagtaaagattattaactattggaaaaatagacaaaatatcttttaatgtcttagactttttaatgagtcaattctctactttcccttcaattttccattaca

SEQ ID NO: 171555 - DNA, 601 bp, Human
atgttttcctgacatctttaaaataataaatgaacctatataacacaattgttatttggatgcacattggttaatatttacaaattttctacagtagtccctaatttatcataaacattatatatttgttaaattaaatgaaagcagctatacagtgggctagaagtaattttagagcccttagctcagcacctactattgtcctacatactattaagctgtctatattagtttgctagggctgctgtaaggaagtatcacgaattgagtggcttacacaacagaaatttactgccatatrtattggaggctatgagtctgagatcatggtgttgacagatctccattctctctcctaggttctggtagttccttggcttgcagcagcataactctaatttacacatggcattctccctgtgtttgtgtctgtgtccaaatatttccctttttgtaaggacagaggtcatactggattagggcccaccctactggcctcattgtaacttgattatttctgtaaagaaataatagagaaacttatctgtaaagaaacttatctccaaataaggttacattcagagatactgggggttaggac

SEQ ID NO: 171556 - DNA, 601 bp, Human
taagatggtaaaatcacaagataggagactggattccacagtctctctcgcagcagggctgctcagtagaggcacccaacctgcctcagacctatgatgtgagcaagaaataaatgtttcctgttttaagggactgggatttcacgattgtttgttatagcagctagcaatacttaccttgactaatataccaggtcttggtaagaaatcattttcccccaactccatcatacacttgagatgtgatctagactcgcacctcctccatactaagaatgtggtgaaaagaatccatcaagaktctttcccaacccagtctgactatattcactctcattttaattaatatacttcccatttttaggttctatgccataaattaattaaaggcaagtcccaagattaacacatattttaatctataattctgaatccaaagctttgcttaaaggacaaatatgcagttggttttatgctcgttcaacattaatcattatgaattataatttcatatcaatttttatctctttgaaagtaattgtatgtgtagtttgcattccagtcagatggttttaaagcctttcaagtattctctaaataa

SEQ ID NO: 171557 - DNA, 601 bp, Human
tgtgtctgtgagggtgttgccaaaggagattaacatttgagtcagtggactgggaaaggcagacctaccctcaatccgggtgggcaccatctaatcagctgccagcgctgccagaataaaagcaggcagaagaaagttgaaatattaaactggcttagcctccaaggctacatctttttcctgtgctggatgcttcctgctctcgaacaacagactccaagttcttcagctttgggactcagactggcttccttgctcctcagcttgcagatgtcctaatgtggaacctcaccttatgatygtgtgagttaatacttcttaataaactctcctttatacatttatcctattagttccgaccctctagagagccctgactagtacaatgaagtttaaatgaaataatacatatcaaaagcataggccagtacccacatatacatgtacacaacaactactatcaattattattgttgttattaagcattatgacaatgataatgattattcagctggcatatgaaagatactaccaacaggtactattaattatgaaactattaactatgaaattatgttgaagaatttataatacatttta

SEQ ID NO: 171558 - DNA, 601 bp, Human
gactttaaagcctagttccactacttgctggctgagtgacgacaggctgatcacatggtctctcagggtcttagcatcctcatttgtaagactgggataatgataattttaacagaacaggatcaggatgaatatgatggttaatattgaatgtcaacttgattagattgaaggatgcaaagtattgaagaatgcaacaattctattaagctggaagttaagattgccacctggatattttgagctcctcctacctttagaaggtaagttagggaggctaagaagggagttacagtgtttsgttggggtgactgacctggactatcaagatgaaatcagtccactacttcaaaatggaggtaaggaagaatatgtgtggaatacaggagatcccttagagtgtcttttagtattaccatgccctgtgacgtgattaaggtcaatgggaaactagaagaacacaatccaggcaggactacaaatagcccagatccttcaggactgaaggtttgggtcactacaccaagtaaaaaaccatggcctgctgaggtgcttgctgaaggcaaagggaatacagaatgggtagtagaagaaggtagtc

SEQ ID NO: 171559 - DNA, 601 bp, Human
gacctacacagcccaccatagacggctctgtgccagaatatgttttcaaaagaatgaagactagaatgtggagttcagtggaatcccagagctagcacatgaacaagtccatcaagtagcctgtaaatacattaatcaaagatgaatcacagagctatttcaacaaatactccagaaagtatttgttttaacaactttattaatgattttcctccaacattcgtgaaaacattagagatgtaaaggggcccttacattttcagtcgcactgctatattttataagaggaattatatgattkctttgtttccaatttggagatttgagtgctctgggcatatccttaatatttgccaagagtctgctcgacgaacaaagtcaatctgtgactcaataataatcttctgattatcccttggatttgtacagcatgttggaattttcaaagtttccacataccttgttgcattttatcgtcctgcagtggtgtggaacacacaatcacaattactgtaatcacggaagctaagataagggagggttgggtgagttgccagagatcacacagtttataaattaagagagccctgattggggcctg

SEQ ID NO: 171560 - DNA, 601 bp, Human
aatcttatgagaaaactcttttgttcctttaagattcaagccttcatgccaatctggtcccaacgcactgcctacattatctgatttagatttgcttctagcttcctttttccttccttcagttgtatatctggttcttttatatgcaattttagcctctgatttttcagcaatgagctttgaagtcaagaattcagctgctcctgcatcgaagaaagtattccctatagctttatctttaatggcccaaatcacttcacagccttcaatttcatacactaactcaagtgcgataccaccrttccctaagatcattattcttttagctttagtaagctgtttctgaaattcctgagcactgtctgtatcacggattcctaatacataaggatttccttcacatatcaactttggtttagctccagcacacagagtttcttatatacatgctgattgccatcttctgttacaatgcagtgttcttcactcttcagttgctttacgccagattctataaccttgatgttgggaaagcgtttttctaacatggtacttgattgttcttcaacatcaaattcttccaatattttagaaatctgct

SEQ ID NO: 171561 - DNA, 601 bp, Human
tgtcaccggcagcatagatatcaggaagggatgtgtgcatatgatcatccactttcaggccaccatcttctcctagatcaaaactgttaccatggagaaaaggttctatattcggtgtaactcctgtagcactgacaatgaaatcgcagccatatatcttttcattggtcaattccacatagacaggccacatctctgtattagttgtaactgacgtatggtctcttggaaaagtgaaggactttttcttcaaaattctaaactcatcctgaaggtagattttctttacttcacacatagyttcaaggtgaatcttatgagaaaactcttttgttcctttaagattcaagccttcatgccaatctggtcccaacgcactgcctacattatctgatttagatttgcttctagcttcctttttccttccttcagttgtatatctggttcttttatatgcaattttagcctctgatttttcagcaatgagctttgaagtcaagaattcagctgctcctgcatcgaagaaagtattccctatagctttatctttaatggcccaaatcacttcacagccttcaatttcatacactaactcaagtgc

SEQ ID NO: 171562 - DNA, 601 bp, Human
gaggaacaagtcaggggtgtttgtttaatatattgcttagtaataaggatagtgttttggcattctggctgacttgcattaaatatttaaaacaaataactagaatttaggctgggacccaagttggcaaaacccactgttacatactgagaatcctggctgttgcataagcagaattaagaaaatttgagtacaaaaggaattttctaaaggaataatagaacagttgcttagtctatggctaaagaaatacagagagctgctaaacttagttttatttattttgcaaattttaggattyatgtagaaattcaagacttatctttttacattaccatacgaacaatttttttctttgctttgctaaatattaaaattttaattgaccatgacacagaagtaaaattatgaatttttccactattattgtttatttatttttcttttctcaacttttattttaggtccaaggagcacatgtgcaggtttgttacatgggtaaattgtgtgttgctgtggtttggtgtacaaatggttttattacccaggtagacagcatagtacccaacaggtagtttttcgaccctcaccctcctctcag

SEQ ID NO: 171563 - DNA, 601 bp, Human
tttcaaggaaatattacaaaaacaattctgcacaaagcactaacacagtgtcacacaggaatgaacgaaacctcctcagtgtaatagagagccatttggatgtgtaaaatcttattggccattctgacccagccaatttaacacagaatattctgataaagccttaaaaaagactaacatccaattattattatgtgtttgtgtattattttatgttatcattaaattattattattttacgttaaaatttatttgttcttccattcctcgtttcaattctgtggattaagggtgaggaamaagtcaggggtgtttgtttaatatattgcttagtaataaggatagtgttttggcattctggctgacttgcattaaatatttaaaacaaataactagaatttaggctgggacccaagttggcaaaacccactgttacatactgagaatcctggctgttgcataagcagaattaagaaaatttgagtacaaaaggaattttctaaaggaataatagaacagttgcttagtctatggctaaagaaatacagagagctgctaaacttagttttatttattttgcaaattttaggattcatgtag

SEQ ID NO: 171564 - DNA, 601 bp, Human
tcagtaaatcatacacattaaaggcacagaactaaaagttttccttgctttaaaaccaacagttagcctgaacccctggggtgcttttgtcaccacactgtcattcacacatcccatgggagatgtgggttctatttctacatatctggtgtatataactacacttcaagaagctataataaatatatagcaccaccattcaatgttctgcaaagacagaaaattctacacttttttcaaggaaatattacaaaaacaattctgcacaaagcactaacacagtgtcacacaggaatgaacraaacctcctcagtgtaatagagagccatttggatgtgtaaaatcttattggccattctgacccagccaatttaacacagaatattctgataaagccttaaaaaagactaacatccaattattattatgtgtttgtgtattattttatgttatcattaaattattattattttacgttaaaatttatttgttcttccattcctcgtttcaattctgtggattaagggtgaggaacaagtcaggggtgtttgtttaatatattgcttagtaataaggatagtgttttggcattctggctgac

SEQ ID NO: 171565 - DNA, 601 bp, Human
aattttccaaatatgaaatgtttatgttttgcttttagagtctttattcaattttacttaacaagcattaaattttatgctatgtggagaatattaaatttatatgcagtctttaataccttacacaaacaaactgccttttttcccacagggtgaaaatgattttatttttcagcacatacacacaatcagtaaatcatacacattaaaggcacagaactaaaagttttccttgctttaaaaccaacagttagcctgaacccctggggtgcttttgtcaccacactgtcattcacacatmccatgggagatgtgggttctatttctacatatctggtgtatataactacacttcaagaagctataataaatatatagcaccaccattcaatgttctgcaaagacagaaaattctacacttttttcaaggaaatattacaaaaacaattctgcacaaagcactaacacagtgtcacacaggaatgaacgaaacctcctcagtgtaatagagagccatttggatgtgtaaaatcttattggccattctgacccagccaatttaacacagaatattctgataaagccttaaaaaagactaaca

SEQ ID NO: 171566 - DNA, 601 bp, Human
aggttcaaatgattttcctgcctcagcctcctgagtagctgaaactacaggtacatgccatcatgcctggctaatttttgtatttttagtacagacagggtttaaacatgttggccagactggtcttgaagtcctgacacaaatgatccacccgcctcagcctcccaaagtgccgggattataggcatgacccactgcacctggcctagcctaagcactctaaatatgcaggaactaaagcagaaaagatttgcctttttactgaagtgaaccatagaaaagtgtatgtgtgaggaggggwtattaactcaaggctaattatgctactgtttattcaatagattgaaatgttgcctttgttgagatgagatactgtataattcatattgtttattcattaaataaacaaaaataccaaaaatatagccttttagacaatttatctctgtgcttttttattttcttgtgtgtttgcatttagtttcatttctattctttaaatctcagaaattcattctaaaaatggatttgaattcttttttgataaataagccataaactacataaccaagtcaatttaatgttccatgattagatgcca

SEQ ID NO: 171567 - DNA, 601 bp, Human
atagtagaaatggcaaaaagcactagaattagatgttgaagatgtggctgaattgctgcaatctcatgataaaacttaaatgaatgagaagttacttcttacagatgggcaaagaaagtggtttcttgagaagcaacctactcctgctgaagactcagtgaacactgttgaaatgacaacaaaagatttagaatattacctaaaattagttgataaagcagcacagagtttgagaagacatattcaaattttgaaagcaatactactgtgaatacaatgctatcaaacagcattgcaagcyataaggaaatgttttgtgataggacgagtcaatcgatgcagcaaacttcattgctgtcttactttaagaaattgttagagccacccaaccttcagcaaccactaccctgatcagtcagtagccatttacatcaaggtaagaccctccaccagcaaaaaagattatgacttgatgaaggctcagataatcattagcatttttagcaataaagtttttttttattaaggtatatacatttttcagacataatgctattgcaaacttaatggactacagtatagtgtgaaaagaactgtaaat

SEQ ID NO: 171568 - DNA, 601 bp, Human
atggataattgtggtatggattgtggtatatacaagcatacctcattttattgtgcttcactttattgccctttgcagatattgcatggttttacaaattgaaagtttgtgacaaccttctgttgaacaaatctactggtgatatttttccaacatcatatgctcatctcatgtctctgtgtcatattttggcaattctcataatatttcaagctctttcattattatatgtgttatggtaacctgtgatcagtgatccttgatgttactatggtaattgttttggggcaccacaaaccamacccgtataagacagtgaacttaatcagtcaacatcgtgtgtgttctgagtgccccaccaacgagctgttcccagttcttctccctctcctcagagctccctatcacatgagaacaacaatattgaaattagaccaatgaataacactacaatgacctctaagtgttcaagtgaaaagaaaagttgcagggctctcactttatatcaaatgctagaaatgattaagcttagtaagaaaggcatgtcgaaagctgagataagcagaaaactacacctcttaagtcagtgagccaagttgcg

SEQ ID NO: 171569 - DNA, 601 bp, Human
aatggataattgtggtatggattgtggtatatacaagcatacctcattttattgtgcttcactttattgccctttgcagatattgcatggttttacaaattgaaagtttgtgacaaccttctgttgaacaaatctactggtgatatttttccaacatcatatgctcatctcatgtctctgtgtcatattttggcaattctcataatatttcaagctctttcattattatatgtgttatggtaacctgtgatcagtgatccttgatgttactatggtaattgttttggggcaccacaaaccrcacccgtataagacagtgaacttaatcagtcaacatcgtgtgtgttctgagtgccccaccaacgagctgttcccagttcttctccctctcctcagagctccctatcacatgagaacaacaatattgaaattagaccaatgaataacactacaatgacctctaagtgttcaagtgaaaagaaaagttgcagggctctcactttatatcaaatgctagaaatgattaagcttagtaagaaaggcatgtcgaaagctgagataagcagaaaactacacctcttaagtcagtgagccaagttgc

SEQ ID NO: 171570 - DNA, 601 bp, Human
ggaataaacctaagtgtccatcaacagatgaatggataattgtggtatggattgtggtatatacaagcatacctcattttattgtgcttcactttattgccctttgcagatattgcatggttttacaaattgaaagtttgtgacaaccttctgttgaacaaatctactggtgatatttttccaacatcatatgctcatctcatgtctctgtgtcatattttggcaattctcataatatttcaagctctttcattattatatgtgttatggtaacctgtgatcagtgatccttgatgttacyatggtaattgttttggggcaccacaaaccacacccgtataagacagtgaacttaatcagtcaacatcgtgtgtgttctgagtgccccaccaacgagctgttcccagttcttctccctctcctcagagctccctatcacatgagaacaacaatattgaaattagaccaatgaataacactacaatgacctctaagtgttcaagtgaaaagaaaagttgcagggctctcactttatatcaaatgctagaaatgattaagcttagtaagaaaggcatgtcgaaagctgagataagcagaaaac

SEQ ID NO: 171571 - DNA, 601 bp, Human
ttaaatgggcaaaaggcctgaatacagacatttctcaaaagaagacatacaaatagccaagagaaatatgaaaaaaatgtccaacatcactaatcatcagataaatacaaattaaaactacaatgagatatcacctgatacctgttagaatggctattaaaatgatgaaaaataatgagtaccagcaaaatgtggagaaaagagaacccctgtacactgttggtgggagtggaaattagtacagccatgatgacaaacagtatcaacattcttcaagaaagtaaaaatagaattactataygatccagcaatctcactactgagtatatatttaaaaaatgaaatcaaatgacagtaatctgcaccccatgttcactgcagcattaaacactatagccaaaatacggaataaacctaagtgtccatcaacagatgaatggataattgtggtatggattgtggtatatacaagcatacctcattttattgtgcttcactttattgccctttgcagatattgcatggttttacaaattgaaagtttgtgacaaccttctgttgaacaaatctactggtgatatttttccaacatcatatgctc

SEQ ID NO: 171572 - DNA, 601 bp, Human
ttataatcaaggcgagaacaaatcacgaatcaataatctaagtgtctacctcagaaaagaaaaatataagagcaaaataaacccaaagcaagcagaagggaggaaacaaaaaccataagagaggtaatcaatgaaattacaaacaggaaaacaataaagaaaatgagcaaaaaaaaatggtttctttgaaaaaacatcaataaaatcagtaaagtctagcaacactgatgaaaatgacagctaagtaaacaaaaatcaacataaggaacaagataggggttatcactatagataatatagmcattacaagaataataaggggatatcacaaacagctttacattaaaaaatttgacagtttaaatgaaccaatcccttgaaaaaaacccaaactaccaaaactcaaccaagatgaaactgataatctgaatcattttataaccattaaaaacatgaaatgtataatttaaagttttttgaaaaaaaaatcttcaggccaaatagttttgctggaaaattctaacaactatttgaaaaagaattaacaccattttgtcagtgtcttccagaaaataaaaggggaaggaacatttaaatgtgg

SEQ ID NO: 171573 - DNA, 601 bp, Human
tatttttgcctatcttgagcatggcctaatccatgctctcatggagcttcaggttttataagaaaatcatttgatgcagtgttacataatagtttgaaaagaaggatttggaagaagtcaggtctgaatttgaatttcaactctcctgaaaattaagtgggaaaactgacctacgttcagttccctatcctttcaaagcctcggtttccttatctataaactggaaaagatgataatgatgttgaggaggatgatgcctgtagctaactcaacacatctgtgagtacttgctattgcccakgtactgtgctgagtacttaattaatacttaatttatactttgttactgaattttactcttttgctagctattactatcctcagttttaagatttagggaggttaagagatttgtaaagaatacaagctaataagcagtaaggtcaacactcaaacccaaactggactgactccaaaggaaacactcttaaccactgtagaagcctgaaggtgaaggagagagaagcgaagcaattacaattttaaatataaatcaatgtgatggcaaaacaaccttaaagagatgttcacaatgggcagt

SEQ ID NO: 171574 - DNA, 601 bp, Human
tatttatatataggtttttttagaattaaagagatctcacttaataatgcagtgcaaaatactgattagccatatttgacaatacaatgcatattttaatataacttgctatttgtttttaactgtcaaaataaaattcttagtttatattggaaccccattttctaagcaagaataattatgtggtaaaaagttacctagaattcaacaagtttaattttttaataaaaataaacttagaggagtagctatatagaatttttccttactgagcaatatcatgattcttcacagttatctrtgtcaacacaaacgaactcatattgaaagtttactcataaagaagaaatacctgtattatctataaaatttctaaattaaagagttgtcaattatttagtatcaagtttaagtaaaaaaatcaatttaattcacatgacaatttactattaaaaaacatttatatgtaagtaactaaactcccttaccttataaatatccaaaaatccacactggtggtcaaatctggtgtacagttcattcagcatgctgattacttgcatgggagtacactgggcacatatggctgtgaagccaacaa

SEQ ID NO: 171575 - DNA, 601 bp, Human
aaatcccttatacatacttcatactgaatgtttaccactcagaagagattcaattaaaatatttaacattggctacatagtctacataatgaaactaaagagctcatttccccaagaagacacaccttcataaaaacaccttctggatgataatataaaatttacaaagtgaatcagacaagttctttccaaatctgcttatgtgaagatcatactgtaaaaataagtagctggtcaatatgtattagtaaagaagaaaataaaacctgcagctcacaactatttatactaaaagtacttrattcccttcatataaaaaaagccctatgccctgacattgtgcaatctacgtaagattctaggtaaagttgtagagttattgattaggtagatatggagctaaatgactcaaaatattgctatgatcttagtaagaaattaataaggagttcaccaaatcaaaccaaccatggtggttggcaccaattttggaaatttttccattatgtagcttggaaaattaaggtacttcctcaaaaactcattagtcatttgagcaatagctagagtatttatatataggtttttttagaattaaaga

SEQ ID NO: 171576 - DNA, 601 bp, Human
agactgaaggctgcactgttggcttccctactttttgaggttttggaactcggactggcttccttgctcctcaacttgcagatagcctatggtgggattccaccttgtgactgtgtgagtcaatactccttaataaactccctttcatatatacatctatcctattagtcccatccctctagagaaccctgattaatacactagcattgaagatatgttaagaacaccaagccctggaatctttagttgtaattaattgcaaaatttcctaaacaagtttagtttaagaaaagttgtgaamtagaattattatatgtgtgtgtgtatatatatatatttatataaacattttgtaagttaaaacttgttgattattattcatgactatatgaaactgtccacggtttaataatatataggaaaatttgaagatcatacggagtatttctactgtttttctgtgagatgtcctaactcacaagggaatgaatgcttgatgtctaagaaatcaaatcatattttaaaaccttgaacctgttttggcatactcagaagcatcacatttcttcttttctcaaaatctaactgatacttatgtttg

SEQ ID NO: 171577 - DNA, 601 bp, Human
cactatgaaagccccatgtgggccactccatctagttcttttctcttggcatttagttttacctggcttcctttcacatttctaacataaaaggtgggctgtaccttatttttctctgtggtatggttattctacataattacccaaattctatacatactttcaatctagcaaaactcttttcatttcataaaataagacttgtggtccttacaaaaaattctaccacctctgggattctttgtttcaatagccattaaaaatctggcaaatagttcatggtttaaaatagcactgtgtrtattttctagaaaatacactagaatgtttatgaagattacaaatcaggctggtcaaatagaagttttctaatttatatccctcctaatgcatttctcctaatgtactttttttatcctatacaggactaatatcattttgtctttccctctctggccaaaccattactgctatggatttagcatatattgtatttccagtctggatctcccaaactcaacctccctaatcctgaataagcagccaaagctgccctatacacctatcctagatacatgtacttactagctgtgatagttaa

SEQ ID NO: 171578 - DNA, 601 bp, Human
attctgacttgtgagctacattatctggatttaacctttccaaaactcagttttcttatccgaaaatgtacataatgccacatgttattcaaggagggattatatgagatcatattttattcttttctaaaaagctctgggcctactaggtatgtgtgtatatatacacacacacacatacacacacacaaacataatcacataacacacatccctgtatgtctagatagatacacctgtctgagaagttctaatggcagctaatatttacatttactactatgtaccagatggtattctmaactctttataggaaagctcactgaaatgcttatgatgtaactgtgagactgatgcactgaatatctttattttatggggtatagaactggagaaaagtcaagttaaagtgcttaaaggtgaaaagatggggatgctaaagattgtatttaaaatagcactggaacactgcaaccatggcagaatggaatcagagaaaggcaaagtctttctccctgcttatctaaaatcaaaggctttcccaaagacaaatgtaaaacaaagcaaaatgtacatgaatttgcttcaatagtcaatgcca

SEQ ID NO: 171579 - DNA, 601 bp, Human
agagaactaacataaatctgaaacagtgctcaatttaaaaagtgtgtgcactgatcattaaaagagaaaatatgtaaatcttggggaaaaatgaagcagttactctttactaaatggaactggcatttcatgctgcaaatgacgtaaaatggcatatacatatttataaaattccaacaataacctaagtacctaagtactttgaaaggcaacaaaacaaggtggaagtgaagcatttcatttttctgtgaaatctatttcatgctgaagtgatatccttgagaatctactgcattttctrgaggctggctgaaggtccagcgaagaagagagggctttagtagcttcctatcaagtggcaagacaaatcaaaattcttgaggcataaagctgtgtagccctaaaactctatgtcagaaacatctgttttcagatgtttgatgaggttgccatattcagttcccctttgacactgtagacttgtcctgtgcaccctctgattctaagcttaattctgtccagggaaaagactctgcttctttatcaaagtttgtactgatacccatatttatactttctatctagacatgttgcctggttt

SEQ ID NO: 171580 - DNA, 601 bp, Human
gtacataaaaatgcctgcagatatacaacacacacactcacacagacacacgcgcttcccatataggaccagatatacctgtttggaaagtaataatagctaatatgtacatttactaccatgaaggagacactgttttaagcactttacataaatctcatttaaaagctcacaaaataaaactataaagtgataaaattagtctcttatttacagatgataaaatgaggcagagagattaaataacccatgaaaggtggaatgatgagaaatccaactagtgcactcaagatagcactgsgattccacagccttgtctgaatggattgaaagaaacatatcttacccttgcctcttccttatctccaaccaaagtgctcgccaaaggcaaacgtataaatgaggttaaaccctcttcaggtaatttttacagcattatggtattttgaaactgacaatataactcctgccatagaaaagctattggaacagaatgcttatctgtgactttcaccttacttcctacagcatataaatgagttcttttctattcattaaaattgttctaaaaatacatgctaatttccataacattttaaag

SEQ ID NO: 171581 - DNA, 601 bp, Human
aacactttgaaaaattcagcaagacacatcattaatattaacttctgcttagcaactaaaagtattttagccttctaactgtcttcagaatatgccacaacactaaaagaaatgttctctgaatatagaagaaaaataattcaggctgccgtattagaatataaaaatagacatttggggttcagtttcatagtattggtcacagacatcccacgagtcattctggctttcagaaatattgtcatctttataaattccatattgtaattcagagtatgcagatggaagcatctttaagaawctttgaggccccatgaagatgacacaaataatgcatttcggaaagctatttatctccctccctccttttatttctctatccttccttcacagtctttggcatacaatgcaattctaataacctaaaagaataaatccaaataaataagcattttatctatttctagtaagcgttggatacacaatgtttatgtacataaaaatgcctgcagatatacaacacacacactcacacagacacacgcgcttcccatataggaccagatatacctgtttggaaagtaataatagctaatatgta

SEQ ID NO: 171582 - DNA, 601 bp, Human
taaggacttctctacaatggttattctagttagccattcgtctaatcttttttcaaggttttaacttctttgcgatgtgttcgaacttcctcctttagctcggagaagtttgatcgtctgaagccttcttctctcaactcatcaaagtcattctctgtccagctttgttccttgctggagaggagctgcgttcctttggagggggagaggcgctctgatcaacattagacagatcaacgagacagaaagttaaaaaggatatccaggaattgaactcaactctgcaccaagtggacctaayagacatctacagaactctacaccccaaatcaacaaaatatacattcttctcagcaccacatcgcagttattccaaaactaaccacatagttggaagtaaagcactcctcaacagaaattataacaaactgtctctcagaccacagtgtaatcaaactagaactcaggattaagaaactcactcaaaaccactcaactacatggaaactgaacaacctgctcctgaatgactactgggtacataatgaaatgaaggcaaaaataaagatgttctttgaaaccagtgagaacaaagacacaa

SEQ ID NO: 171583 - DNA, 601 bp, Human
tgtgtcttttattggagcatttagcccatttacctttaaggttaatattgttatgtgtgaatttgatcctgtcattatgaatttagctggttattttgctcgttagttgctgcagtttcttcctagcatcgatggtctttacaatttggcatgtttttgcagtggctggtaacagctgttcctttccatgtttagtgcttccttcaggatgtctcagcatttgcttgtctgtaaaggattttatttctccttcagttatgaagcttagtttggctggatatgaaattctgggttgaaaatycttttctttaagaatgttgaatatcggcccccactctcttctggcttatagagtttctgctgagagatcagctgttagtctgatgggcttccctttgtgggtaacccgacctttatctctggctgcccttaacattttttccttcatttcaactttggtgaatctgacaattatgtgttttggagttgctcttctcaaggagtatctttgtggtgctctctgtatttcctgaatttgaatgttggcctgccttgctaggttggggaagttctcctggataataacctgcagagtcttttc

SEQ ID NO: 171584 - DNA, 601 bp, Human
tatatatttaggatagttagctcttcttgttgaattgatccctttaccattacgtaatggccttctttgtctcttttgatctttgttggtttaaagtctgttttatcagagactaggattgcaactcctgccttttttgttttccatttgcttggtagctcttcctccatccctttattttgagcctatgtgtgtctctgcacatgagatgggtctcctgaatacagcacactgatgggtcttgactctttatccaatttgccagtctgtgtcttttattggagcatttagcccatttacmtttaaggttaatattgttatgtgtgaatttgatcctgtcattatgaatttagctggttattttgctcgttagttgctgcagtttcttcctagcatcgatggtctttacaatttggcatgtttttgcagtggctggtaacagctgttcctttccatgtttagtgcttccttcaggatgtctcagcatttgcttgtctgtaaaggattttatttctccttcagttatgaagcttagtttggctggatatgaaattctgggttgaaaattcttttctttaagaatgttgaatatcggccccca

SEQ ID NO: 171585 - DNA, 601 bp, Human
aattccaaacaatcatttgctgaacaagttttttgtgtcaactgcaacaaatatgtgagacctataatactgctcccattttatagatgcagaagctgaacacagataagttacgtgacttactcagttatgtgacaaagatataattaaaatcaggttttcagactttatcttcaataccctttcccctacatttagctaccattgcactgtcataggcaactacaacagtcctcatctgggctctctctgatcgtcaaaggaccttatattaagcagagggctgaaatatgcccgactrgatatgaggcgatgacactaattatggaatttggtaagggaaaaagagagaagcacgaagttgccctttgatgacagcataaaaagctatccaatattaaactctgactatcacaggaaaatataacattaaaaatgctttggacaatcttaagaacagcattatcttaatagacagctttcatagactccaacacatgtgcacctatgcatgtgcatgccctccatcccaacacatactcacagctaaatcagcagtctcacagcgattttgtttcaactgatttatctttttccaact

SEQ ID NO: 171586 - DNA, 601 bp, Human
ttaaatgtcctcactacacacacacacacacacacagaaacacaaaggtaattatgtctgataatagatcaactatgtattaatttgattgtaataatcattatacaatctatgcatatatcaaattgtcacattgtcaaccttaaatttatactatttttatttaattattaatataacccaaaaaagctggataaacacataaaatccaataaataaaatccaaatctaataaaataaatatctcaatagtgttattacccaatgcctagattagcacttaaacacagtatgtgactgrtaattatttattgaaaatgaaagtaatgaataaacatataaaaaatttagcatggtacctagcacatattaggcattcaactaatatcagtccctgtcccttctttcatagcaaattcctaaagacattctctctgatcttggtcttctttcatatgaataactccagatggagtcaattgctgatactgttgattaatttacaacaattttccacatatatatcgttattttgaattatgaatagacaaattccaaacaatcatttgctgaacaagttttttgtgtcaactgcaacaaa

SEQ ID NO: 171587 - DNA, 601 bp, Human
gggtcagctattatggaaaacacaatggaggttcctaaaaaattaaaagtaaaattataattttcagcaactccacttctggatacatatccaaaggaaatgaaatcaggattttgaagagatatctgcacttccatgttcattgcagcattattcaaaatagccaagatgtaacatcaacctgtgtctatcaacagataaatgaagaaaatgtgatacacacacacacagatgtatgtaaagaaatattcagccataataaagaacaaaatcctgccatttgtggatgaatctggaggamattaagctaagtgaaataagccagacacagaaagataaatactatatgatctcacttatgtggaatccaaataactctctgagtttctcatatgaacagagagtagaatggtgtttgccaaggggtgagggtggaagaaatgggaagatgttagtcaaatggcagaaattttcagttataaagactacattctggggatctaccatatagcatgctgaccatagtaactaatactgtattttatacttgaaatctgctgagagtagatattaaatgtcctcactacacacacacacacac

SEQ ID NO: 171588 - DNA, 601 bp, Human
gtaatgaaaatagtatggtgattgcatataaacagacacatacaccaatgggacagaatgagatcccagaactaaatctacacaatcttttacaagggcaccaagaaaacacaatggaggaagaatcttctcttcaataaattggttgggcagctagatagggttggggaaatgaaattagatccttctcttatgacatacagaaaaatcaactcaaaatggaataaagacacaaatgtgagtcccaaaactgtaaaacttttagctaaaaacataaggacaaagctctgtgacactggcyttagcaatgagttttttggatacaacaacaacacagtcaacaaaagcaaaaattagcaagtgggattacatcagactaaaaatattctgcatagcaaaaaaaaagcaatcaacataatgaaaaaggcaacctacagaaggggagaaaatatttgcaaatcacaggtctgatgaggggctaatatccaaaatattcaaagaactcatacaactcaatagcaaaaacaacaaacagcccaatttaaaaatgaacaaaggacctgaataaacagttttcaagagaatacctaaaaatggccaa

SEQ ID NO: 171589 - DNA, 601 bp, Human
gactccatctcaaaaaaaaaaaaaaaaaaagcttacccactatcatcaagtaggcattatccctgggttgcaaggttagttcaacatacacaaatcaataaatgtgattcatcacaaaaacagaactaaagacaaaaaccacatgattatctcaagagatgcagaaaaaggctttcaataaaattcaacatccattcatgttaaaaactcccaataaaataggtattgaaggaacatacctcaaaataataagcatcacaaatgacaagcccaaagccaatatcatactgaatgggcaaaagctggaagcattctccttgaaaagcagcagaagacaaggatgccttctcttgcctatcctattcaacacagtattgaaaaagaaattaagaaaatgatcccacttaaagtagcaacaaaaagaataaactacttaaaattaatttcatcaaggatgtgaatgatgtgtacattgaaaactataatatattgattaaagaaattgaagacacatcagtggaaaaatatctgttcatggaatggaaaaattaatattgtaaaaatgtccataaaacccgaagtgattacagattcaatgcaa

SEQ ID NO: 171590 - DNA, 601 bp, Human
tgtaatcccagctactggggaggctgaggcaggacaatcacttgaatccaggaggcagaggttggagtgagctgagatcacaccattgcactccagcctgggcaacagagtgagactccatctcaaaaaaaaaaaaaaaaaaagcttacccactatcatcaagtaggcattatccctgggttgcaaggttagttcaacatacacaaatcaataaatgtgattcatcacaaaaacagaactaaagacaaaaaccacatgattatctcaagagatgcagaaaaaggctttcaataaaattcarcatccattcatgttaaaaactcccaataaaataggtattgaaggaacatacctcaaaataataagcatcacaaatgacaagcccaaagccaatatcatactgaatgggcaaaagctggaagcattctccttgaaaagcagcagaagacaaggatgccttctcttgcctatcctattcaacacagtattgaaaaagaaattaagaaaatgatcccacttaaagtagcaacaaaaagaataaactacttaaaattaatttcatcaaggatgtgaatgatgtgtacattgaaaactataatat

SEQ ID NO: 171591 - DNA, 601 bp, Human
aagtatccccagtcctcagcagaataatacatttgattcctttagaacaccaataaaatttggtttttatatatcttatactaaactcatttacgtttcataccagaagagctggtaccattcctactaaaactattccaaaaaattgaggagggactcctccctaactcattctgtaagggcagcatcatcctgataccaaaacctggcagagatacaataaaaaaagaaaaaaaacttagggccagcatccttgatgaacactgatgcaaaattcttcaacaaaatactggcaaactgmatccagcaacaaatcaaaaagcttacccactatcagccgggcgtggtggctcacgtctgtaatcccagcactttgagaggctaaggcaggcagatcacgaggtcaggagttcgagaccagcttggccaacatagtgaaaccccatctctactaaaaatacaaaaattagccaggctcagtggtgggtgcctgtaatcccagctactggggaggctgaggcaggacaatcacttgaatccaggaggcagaggttggagtgagctgagatcacaccattgcactccagcctgggcaacagag

SEQ ID NO: 171592 - DNA, 601 bp, Human
acagtcagtggaaacttctgttcttccatcttgatccacccctcaataattcattttttaaaggagaccatcttaacccataaatcctacaatttttatatatctacggaattactatcttttattttcagaataaatatagatttaaaaaaggcctcccctagtccctcttccagaagtcaaatttgtcacatgcttccaagtccacctctcatgccacatcttttctgaaagtatccccagtcctcagcagaataatacatttgattcctttagaacaccaataaaatttggtttttayatatcttatactaaactcatttacgtttcataccagaagagctggtaccattcctactaaaactattccaaaaaattgaggagggactcctccctaactcattctgtaagggcagcatcatcctgataccaaaacctggcagagatacaataaaaaaagaaaaaaaacttagggccagcatccttgatgaacactgatgcaaaattcttcaacaaaatactggcaaactgaatccagcaacaaatcaaaaagcttacccactatcagccgggcgtggtggctcacgtctgtaatcccagc

SEQ ID NO: 171593 - DNA, 601 bp, Human
ttcagcgatatgaagtttaaatcagatactgtgagtattcacctgattctggttcttatggaggtatttgtgtgtgtgtgtgtgcatgtgcacacgtgcttgttgaatttggtgtccctgtgaaggagacagtcagtggaaacttctgttcttccatcttgatccacccctcaataattcattttttaaaggagaccatcttaacccataaatcctacaatttttatatatctacggaattactatcttttattttcagaataaatatagatttaaaaaaggcctcccctagtccctcttycagaagtcaaatttgtcacatgcttccaagtccacctctcatgccacatcttttctgaaagtatccccagtcctcagcagaataatacatttgattcctttagaacaccaataaaatttggtttttatatatcttatactaaactcatttacgtttcataccagaagagctggtaccattcctactaaaactattccaaaaaattgaggagggactcctccctaactcattctgtaagggcagcatcatcctgataccaaaacctggcagagatacaataaaaaaagaaaaaaaacttag

SEQ ID NO: 171594 - DNA, 601 bp, Human
gtctccttctctccagtgtacaaatttctccatgctttgcagctactacagggggaattgggaaggtatagtgtcaacaattgaggactgtctttcccacagtcttcagtgcctctttcagcgatatgaagtttaaatcagatactgtgagtattcacctgattctggttcttatggaggtatttgtgtgtgtgtgtgtgcatgtgcacacgtgcttgttgaatttggtgtccctgtgaaggagacagtcagtggaaacttctgttcttccatcttgatccacccctcaataattcatttyttaaaggagaccatcttaacccataaatcctacaatttttatatatctacggaattactatcttttattttcagaataaatatagatttaaaaaaggcctcccctagtccctcttccagaagtcaaatttgtcacatgcttccaagtccacctctcatgccacatcttttctgaaagtatccccagtcctcagcagaataatacatttgattcctttagaacaccaataaaatttggtttttatatatcttatactaaactcatttacgtttcataccagaagagctggtaccattccta

SEQ ID NO: 171595 - DNA, 601 bp, Human
taaatgctttaaattgcattcaatttctacacttaggggtcagaagtggcccttaagcaagttttcaattgcaaaattcaggacaacctgcataagaatcacccagaaggtatttgttaaaaattagattcccaggctccacttggatttactgaatcaaaatatggatataagggccagctatctgcattcacaagcttcagttgttttaaatgattcccaaagtctgaagacttctgtatatgaagtgagttaaaaatagtacaatattcaccccgatatccaccttttttttttttttaaagagcagtggctttcagaaaggagaaaagcacttctaacctgaccccagctattcccatgtactccttctctgttctccactccatccatagggtaataaacttttccagatatttccttgtttgttgaaagtgcagactacaacaaccagtccaaatgtgcacatgcacacacgtacacaccacacatgctgagaatctggcacagtaggcattcaatgatccaaagaaagtttgttgagctcaattaaacacacccaagctcattgtacataatgatttagcaattcaaatggaaa

SEQ ID NO: 171596 - DNA, 601 bp, Human
taaaactttgaagaatttgcctatctcagtttatcttttctcaaaacttcagaatcaaaatctttacattattccagaaataaaggtggtgtaaataaatatattagagctatgcattcaccttgtttttttgtttttttaagacagggtctcactctgcctacttagactggagtacggtggcatgatgtgggctctctgcaacccctccatcccgggttcaagcaatcctcccacctcagcctcccttgtagctgggactacaggcgcatgtcaccatgcctgccttttttttttttttaatttttgtagagacagggtttcaccatgttgcccaggctagtctcgaactcctgggctcaagagatttgtgcacctcagcctcccaaagtgctgggattacaggcataagccaccacgcccatcccatttaccttgtttgtttattttagttttagatcatttaaaagaatttcttttagctcctaattaaatttcattcccataacatttttctccttgccctctaggctaatacttaagaaatatctgggaacttcttggatatttgggcacagatggaagaaagaagtcggggtga

SEQ ID NO: 171597 - DNA, 601 bp, Human
tctcccacctgttcgtgaatggcactgggtaagaataaagatggctaaactaagcatggagatggggaaaagataatgcttatgcaaatgtctgaaaaaacttacattattttctgaacatagaagaggaggcttaagtactaaaaatacatacaactgctcccttacatattactatagctgcttttataaaactttgaagaatttgcctatctcagtttatcttttctcaaaacttcagaatcaaaatctttacattattccagaaataaaggtggtgtaaataaatatattagagctrtgcattcaccttgtttttttgtttttttaagacagggtctcactctgcctacttagactggagtacggtggcatgatgtgggctctctgcaacccctccatcccgggttcaagcaatcctcccacctcagcctcccttgtagctgggactacaggcgcatgtcaccatgcctgccttttttttttttttaatttttgtagagacagggtttcaccatgttgcccaggctagtctcgaactcctgggctcaagagatttgtgcacctcagcctcccaaagtgctgggattacaggcataag

SEQ ID NO: 171598 - DNA, 601 bp, Human
gggaatattatgagaacacttaagaagctcatgagaccaacagtgcaaaacttatcacttgatcatcaggaaatatgcattaaaactgattcaaatacccccagatctatcattatattcaaaaatttcactttaagacctgttttctgatgccagaaaaatgaaaataaaattatactataagaatagaaagacaatgcaatatgagttggcaaaagttttattccaaagactaaaatatacttcctggaaataattctcactgaggaagacacccatcaaagaataaacatctaaaatrtgcctatttaccattttacccctaataagacaatgttctttgctaatcttcacattatcccacccgttcatatttgtatacactttgaaaatctatctatgatgctattagctgtgtacttcaaaacttatttctggtagtcagatatcagaacatatagtcagtaaattgcctgcacaaatcaaaatgctttgcagtagctctgaacatccaagttcctagagcacaatcacttcctgaaatgtctatcaccatcatcatcctcatcagcatctcaattatcttttcagaaaaaaaaaa

SEQ ID NO: 171599 - DNA, 601 bp, Human
actacaatattaaaaagatatactgcatgaaattatatgagcactaatttagggaatattatgagaacacttaagaagctcatgagaccaacagtgcaaaacttatcacttgatcatcaggaaatatgcattaaaactgattcaaatacccccagatctatcattatattcaaaaatttcactttaagacctgttttctgatgccagaaaaatgaaaataaaattatactataagaatagaaagacaatgcaatatgagttggcaaaagttttattccaaagactaaaatatacttcctggaaataattctcactgaggaagacacccatcaaagaataaacatctaaaatgtgcctatttaccattttacccctaataagacaatgttctttgctaatcttcacattatcccacccgttcatatttgtatacactttgaaaatctatctatgatgctattagctgtgtacttcaaaacttatttctggtagtcagatatcagaacatatagtcagtaaattgcctgcacaaatcaaaatgctttgcagtagctctgaacatccaagttcctagagcacaatcacttcctgaaatgtctat

SEQ ID NO: 171600 - DNA, 601 bp, Human
ggagatgcttccagcataaatataccaagaattattataaaatattctgttatttttaatatcaaaaattaaatttccatgtaaaagcattccaacactacaatattaaaaagatatactgcatgaaattatatgagcactaatttagggaatattatgagaacacttaagaagctcatgagaccaacagtgcaaaacttatcacttgatcatcaggaaatatgcattaaaactgattcaaatacccccagatctatcattatattcaaaaatttcactttaagacctgttttctgatgcmagaaaaatgaaaataaaattatactataagaatagaaagacaatgcaatatgagttggcaaaagttttattccaaagactaaaatatacttcctggaaataattctcactgaggaagacacccatcaaagaataaacatctaaaatgtgcctatttaccattttacccctaataagacaatgttctttgctaatcttcacattatcccacccgttcatatttgtatacactttgaaaatctatctatgatgctattagctgtgtacttcaaaacttatttctggtagtcagatatcagaa

SEQ ID NO: 171601 - DNA, 601 bp, Human
aacacagcgagactccatcatctcaaaaaaaaaagaaatgggactatgtttttttcatctctgtattcacagagcttagcataatgtctataatatagctatttattaaatatctcatatttattgaatatttgctaaatgaataagtcaatcaaccatgctaaccataatcacaataagtaattttcactgtttgcttattttcaccattcattttatgagcgccatctagatctgtgtgctatgtagatctgtataggaaaaatatgcgtcagtgatggagatgcttccagcataaatttaccaagaattattataaaatattctgttatttttaatatcaaaaattaaatttccatgtaaaagcattccaacactacaatattaaaaagatatactgcatgaaattatatgagcactaatttagggaatattatgagaacacttaagaagctcatgagaccaacagtgcaaaacttatcacttgatcatcaggaaatatgcattaaaactgattcaaatacccccagatctatcattatattcaaaaatttcactttaagacctgttttctgatgccagaaaaatgaaaataaaatta

SEQ ID NO: 171602 - DNA, 601 bp, Human
tattgggccaggtgcagtggctcactcctgtagccccagcactttgggaggttgaggcagcggatcacgaggtcagcatatcgagaccatcctccaacatggtaaaaccccatctctactgaaaatacaaaaattaactgggcacggtggtgcgtgcctgtggtcccagctagtagggaggctgaggcaggagaatcgcttgaacccagtaggcggaggttgcagtgagccgagattgcaccactgcgctccagcctggtgacagagtgagacttggtctcaaaaaaaaaaaaaaaaaaaagtggcacatatacaccatggaatactatgcagccatgaaaaaggatgagttcatgtcttttgcagggacatggttgaagctggaagccattgttctcagcaaactaacacaggaacggaaaaccaaacactgcatgttctcactcataagtaggagttgaacaatgagaacatgtggacacagggacagggacatcacatgctggggcctgtcggggggtggggggctaggggtgggatagcattaggagaattatctaatgtagatgacaggttgatgggtgcagcaaaccaccatggt

SEQ ID NO: 171603 - DNA, 601 bp, Human
tgctgaaaaacatgtcggcaaaacatcaataaattaagcaattagactactgtttataatcacagcagagtttgcaaacagccacagtcaaatactgacatctcactccagggttgttcaataacattatcactagagatgatcattgaaattaggaacaactataatataaaataattatcccccacgaaaacaggactgtcagtattttgcctagataatttccaaataatcgccttttccagagccatcccttcatctccttccaactttcaagtattcctttggaaagcattttttycccagtttttccacctgaagaaaattgttccacacttttagatatatctgtaatttttcgtcaggtctgttctttcttactcttaaaaattgtaacgcctaatgtttcttaaatattcataccccataccattgcgtcaaccactttatgtacattgtctcattttatcttcacaaatatcctacatgaaagaaacaagtattgggccaggtgcagtggctcactcctgtagccccagcactttgggaggttgaggcagcggatcacgaggtcagcatatcgagaccatcctccaacatg

SEQ ID NO: 171604 - DNA, 601 bp, Human
cctggcatggtggctcatgcctgtaatcccaacattttgggaggctgaggcaggaggattgcttgaggccaggagttcacgaccagcttgggcaacatagagagacccccatctctactaaaaagttttttttaaatagtcaggtgtggttccacatgtttgtggtcccagctactccagagactgagttgggaggatcccctgagcacaggaggttgaggctgtagtaagctgtgatggtgacactgcactccagcctggacaacagagcaagaccctgtgtcttgaggaaaaaaaaaaagaaaatcagattctcccttgggaagaataaaaaggaaacagtcataatgctgttcttccatattttcagccagcagaagaaatatcatattgatccagggtgaaaaagttctactcactttttataaaagcagttctaattaaagtcaacatgaactgatttttcagaatgtattgtatagatagaccatatttatgaatgctttatagatatagtccagaagtagcctctgagtttcattagagtacttattgaacaataatttacttgagtatttataggctgaaaaaacaaaatgct

SEQ ID NO: 171605 - DNA, 601 bp, Human
tgaggtaaaagacatggcaaaaagttgcaaatataaaagaatacttacttgtgcagcaaaggatcagagagataaaaactataatcatccaaagatataatagctatcactgccacaactaaataaagttctctactttctcctaccagttggtaacatttaattcagtttattgagcatgaatgtctagaaccatgatacagcttctgttaattcatcaaataattccttaggctaataaaacagttatagttcaagacatttgcaccccaacaaaggagtacaaagattgaatgaaatwtaataatactgaagaattattatgaagaaaattattttctggactaaatgctattaagtcaatttaattccttgatctattttctgtatactacatataaattgattctaatattttacatttattctaatattttacatttccagttgtgtccctctgaaaatattttaattggcatgaattctttcccattgaaactttacagtgatgatttgggactcattaagcagtagtttgctcatattaatttctgccagtatagttttcttttatggtcattatttctataaaccctcatta

SEQ ID NO: 171606 - DNA, 601 bp, Human
tccctggacaggccttcttaaccacaaagtaagagttttcacaaactacagttaaaatgaagagaaaaataacacagaacaatgtttggatatagtgtgctacagtaacacaactagtgaagagattttaatatagcacaggatgctgcgctgcatagagcacagtgtgatcactaatcataacctcataataggtattctcactggtgtaatgaggcaggtctactttacttcattatactttgggtagcaaaattactaatttgtattttgagtgctggggtaaaatatgagcatgggmtaagtttagtatttttcaaaaggacaagattatgaatatgcaatttagagtaagagaaagatgagaaaacacaataaaagaaatggagaatactataagtttattaaaaacctggaagtcaatgtatttacttatttatatgtgaggtaaaagacatggcaaaaagttgcaaatataaaagaatacttacttgtgcagcaaaggatcagagagataaaaactataatcatccaaagatataatagctatcactgccacaactaaataaagttctctactttctcctaccagttggtaaca

SEQ ID NO: 171607 - DNA, 601 bp, Human
atctctggtgcatttctggctaagctaaaccacaagaaaagaaggatgggtgtcttagccccagttcagtaaagcaaaaagggtgaatttacagtcatagttgcaacgttttttcagacaccagcagcaagtcagaaaacatctggagacctcaggcaaatacatttggctctagaatctggcataaattggccatcaaaacattgccatagagatggatagaaatatgtttgcctgagataatttttaaatctaaatatcaatctacttgaacacactaataactttcccagtgtaaaayaggaattagtaattttggagcaaatttttgaaggcataaacaacccttgaagcaccaagtttaaaagggaagctttgccatgattgtttgtggctgatacattatgcttagagctctgataaactgtatatttttaaaatatggtatgactcttgcttccctggacaggccttcttaaccacaaagtaagagttttcacaaactacagttaaaatgaagagaaaaataacacagaacaatgtttggatatagtgtgctacagtaacacaactagtgaagagattttaatatagcacagga

SEQ ID NO: 171608 - DNA, 601 bp, Human
gttgatcttcaaatttccaacttttaaaagcttacaaaatgttagttattcacaaccaaatttcctaagctactatataattatccttttgtaaattatctctggtgcatttctggctaagctaaaccacaagaaaagaaggatgggtgtcttagccccagttcagtaaagcaaaaagggtgaatttacagtcatagttgcaacgttttttcagacaccagcagcaagtcagaaaacatctggagacctcaggcaaatacatttggctctagaatctggcataaattggccatcaaaacawtgccatagagatggatagaaatatgtttgcctgagataatttttaaatctaaatatcaatctacttgaacacactaataactttcccagtgtaaaacaggaattagtaattttggagcaaatttttgaaggcataaacaacccttgaagcaccaagtttaaaagggaagctttgccatgattgtttgtggctgatacattatgcttagagctctgataaactgtatatttttaaaatatggtatgactcttgcttccctggacaggccttcttaaccacaaagtaagagttttcacaaac

SEQ ID NO: 171609 - DNA, 601 bp, Human
aaagaaaaactacaatattatttctccttcttctggccttatcttcttcattagcttccctggtgaatttcacatgttcagatcctattgctaactagttagataacttaagtataatcaaatacttttttgatatctttttatcatgtatgaaatgagagttgatcttcaaatttccaacttttaaaagcttacaaaatgttagttattcacaaccaaatttcctaagctactatataattatccttttgtaaattatctctggtgcatttctggctaagctaaaccacaagaaaagaargatgggtgtcttagccccagttcagtaaagcaaaaagggtgaatttacagtcatagttgcaacgttttttcagacaccagcagcaagtcagaaaacatctggagacctcaggcaaatacatttggctctagaatctggcataaattggccatcaaaacattgccatagagatggatagaaatatgtttgcctgagataatttttaaatctaaatatcaatctacttgaacacactaataactttcccagtgtaaaacaggaattagtaattttggagcaaatttttgaaggcataaacaa

SEQ ID NO: 171610 - DNA, 601 bp, Human
ctaaaggttaaaaggagaaaaaaatccacgtcaactttggctaaattctatatgaataatgagaggctctcacagaaggaagacaggaactgaggaaagaattaatagttttaaaagattaaaaaggaaacagtaaaaatagtaatactctgataataaagaaatgacactcaagaggtcaagataattggaccttctgccacagatttgtgcaattttccacctctttcatataataacctcaaaacacactttccaaattatacttcttctatcatgatgaacaattgccagaaaaagmaaaactacaatattatttctccttcttctggccttatcttcttcattagcttccctggtgaatttcacatgttcagatcctattgctaactagttagataacttaagtataatcaaatacttttttgatatctttttatcatgtatgaaatgagagttgatcttcaaatttccaacttttaaaagcttacaaaatgttagttattcacaaccaaatttcctaagctactatataattatccttttgtaaattatctctggtgcatttctggctaagctaaaccacaagaaaagaaggatg

SEQ ID NO: 171611 - DNA, 601 bp, Human
atagaaaatactaaaggttaaaaggagaaaaaaatccacgtcaactttggctaaattctatatgaataatgagaggctctcacagaaggaagacaggaactgaggaaagaattaatagttttaaaagattaaaaaggaaacagtaaaaatagtaatactctgataataaagaaatgacactcaagaggtcaagataattggaccttctgccacagatttgtgcaattttccacctctttcatataataacctcaaaacacactttccaaattatacttcttctatcatgatgaacaattgmcagaaaaagaaaaactacaatattatttctccttcttctggccttatcttcttcattagcttccctggtgaatttcacatgttcagatcctattgctaactagttagataacttaagtataatcaaatacttttttgatatctttttatcatgtatgaaatgagagttgatcttcaaatttccaacttttaaaagcttacaaaatgttagttattcacaaccaaatttcctaagctactatataattatccttttgtaaattatctctggtgcatttctggctaagctaaaccacaagaa

SEQ ID NO: 171612 - DNA, 601 bp, Human
taggtgacaagagcgaaactctgtctcaaaaaaacgaaaaggagaaatctggacacagatacatccatgcccacagggagaatgccatgtaaagattggattttatgctgccaaggaactaccagaatctagtaatagtagagagacctggacagctccttccctagtgtcttcaaataaaacatgtcttcaaataaaacggccaacacgttgatctcgggattctagcctccagaacagtgagacaacaaatttctgttgttctaagccacttagtttgttggttctttgttatgtcagrcacagaaaactaatatactcaaaatagactggaaacctaagaatggataaaggcttatacatcacagtgatgagtgagaatggtagaatagaaagtggcagaagaacaagtaatgtgactatgaaaagacatttggagttgagattatgtagttggaacaattctaagctatgatgagtttggaggcatggctatatgtgaatttctaaagtgggccgaacttcaaggaatgatacataaaacgatcgtttatgtgagcatatattttttataacagtcatagtttttcactttttaata

SEQ ID NO: 171613 - DNA, 601 bp, Human
tcgagaccagcctgcccaacgtggcgaaaccctgtttctactaaaaataccaaaaattagccagtcgttggggcaggcgtctgtaatcccagctactggggaggctgagacaggagaattgcttgaacctgggaggcgaagcttgcagtgagcagacattgcgccacagcattccagcctaggtgacaagagcgaaactctgtctcaaaaaaacgaaaaggagaaatctggacacagatacatccatgcccacagggagaatgccatgtaaagattggattttatgctgccaaggaactaycagaatctagtaatagtagagagacctggacagctccttccctagtgtcttcaaataaaacatgtcttcaaataaaacggccaacacgttgatctcgggattctagcctccagaacagtgagacaacaaatttctgttgttctaagccacttagtttgttggttctttgttatgtcaggcacagaaaactaatatactcaaaatagactggaaacctaagaatggataaaggcttatacatcacagtgatgagtgagaatggtagaatagaaagtggcagaagaacaagtaatgtgacta

SEQ ID NO: 171614 - DNA, 601 bp, Human
atgcattcttaatgggtattttattaccatgattatgtaattttcaccagtaatgtccatcaattccagagcaagaattttctacttaggtagctctgtatgatggaagacaagaataaaattagaagggtgataggagccatgttgagataggagataatgggattcttcttttctagataagaaggtattatggatggaattgtgccctacccccttaaattcatatactgagttcctaatcctcagtatctcagaatttaacattaattagaagtagggtaattgctgatataattartcaaattgaaaattattaatatgagttcctaccagagtaggggggaccccccaatccaatatgactagtatccttataaaaaggagaaatggccaggtgtgatggctcatgcctgtaatcccagcactttgggaggccgaggtgggcagatcacctgaggtaaggagttcgagaccagcctgcccaacgtggcgaaaccctgtttctactaaaaataccaaaaattagccagtcgttggggcaggcgtctgtaatcccagctactggggaggctgagacaggagaattgcttgaacctgg

SEQ ID NO: 171615 - DNA, 601 bp, Human
gagatgaaaggcagagaagatatttgaagaaagaatagtgttggggaggggtgtggaaagaatgtcaaatttattcatattgatgtcttctagcatttcatttagttaggaaaggaggggtctgtttggagtaagagtagcaaagttaaaagtcaaacaaatgtagtgactatgctcactacctagatgatgggatcatttgtatcccaaacctcagcatcacacaacatacccatgtaacaaacatgcacatgtaccccttaatctaaaataaaagttgaaattattgaaaaaaaaaaaagcaagtatttgcaacagtcatagctaggggatggtgaaacaagatccctacagatttaaggcccagttgagttcaaaacatatgcattcttaatgggtattttattaccatgattatgtaattttcaccagtaatgtccatcaattccagagcaagaattttctacttaggtagctctgtatgatggaagacaagaataaaattagaagggtgataggagccatgttgagataggagataatgggattcttcttttctagataagaaggtattatggatggaattgtgccctaccccctt

SEQ ID NO: 171616 - DNA, 601 bp, Human
cctcagttggaaatgcagaaatcatccatcttctgcattgatctcactgggagctgcagaccaccactgttgctattcggccatcttgaaagctcaccagaatataggtttcaacaactagcttgagaacacattaaaggtacttactgattaggatttagttcttatttcctaggcaatgaagagtcaacagagtggctttccattattttttgatcataaacaaagcagcagcatgtagcatagttagagagggaagctttcaaagaaaatgacatttttgcattaattacagaggagrttttgttgacacactggggccagtcaaaggggagagatgaaaggcagagaagatatttgaagaaagaatagtgttggggaggggtgtggaaagaatgtcaaatttattcatattgatgtcttctagcatttcatttagttaggaaaggaggggtctgtttggagtaagagtagcaaagttaaaagtcaaacaaatgtagtgactatgctcactacctagatgatgggatcatttgtatcccaaacctcagcatcacacaacatacccatgtaacaaacatgcacatgtaccccttaatct

SEQ ID NO: 171617 - DNA, 601 bp, Human
agtgatggacgcccctccccacaccaagctccagcattccaggttgatcacagactgctgcactagcagtgagaatttcaagtccatggatcttagcttgctgggctatgtgggcgtgggacccactgagccaggcaccggagggaatctcctggtctgctggttgcgaacacagtgggaaaagtgcagtatttgggtaggagtgtatcattcctcccagtatagactctcatggcttcccttggctaggaaagggaaatcccccaccccttacacttcacaggtgaagcaacgccacacmctgccctgcttcggttcgccctccataggctgcacccactgtccaaccagtctcaatgagatgaaccaggtacctcagttggaaatgcagaaatcatccatcttctgcattgatctcactgggagctgcagaccaccactgttgctattcggccatcttgaaagctcaccagaatataggtttcaacaactagcttgagaacacattaaaggtacttactgattaggatttagttcttatttcctaggcaatgaagagtcaacagagtggctttccattattttttgatcataaacaaag

SEQ ID NO: 171618 - DNA, 601 bp, Human
tcaggcccctcagctgcaggtgtattggagtttgctgaaggtccactccagaccctgtttacccgggtatcaccagcggaggctgcagaacagcaaatattgctccctgatcgttcctctggaagctttgtcccagaggggcacccatgagatgccagccagagctctcctgtatgaggtgtctgtcagcccctactgggagatgtctcccagttaggctacatgggggtcatggacccacttgaggagacagtctgtctgttaacagagctcgaatgtggtgttgggagaaccactgctrtctttagagctgtcaggcagggatgtttaagtctgcagaagctttgcccacagctacccctttccccaggtgctctgtcccagggagatgagggttttatctataattccctgactggactgctgccttttgttcagatatgccctgcccacagaggtggaatctagagaggcagtcagccttgctgagctgcggtgggctccacccagttcgagcttactggcagctttgtttacactgtgggcataataccacctactcaagcctcagcagtgatggacgcccctccccacaccaagc

SEQ ID NO: 171619 - DNA, 601 bp, Human
ctgttagtctgatgagcttccctttgtgggtaacccgacctttctctctagctgtccctaacattttttccttcatttcaaccatggtgaatctgacgattatgtttcttggggttgctcttctcgaggaatatctttgtggtggtctctgtatttcctgaatttgaatgttggcctgccttgctaggttggagaatttctcctggataatatcctgaagagtgttttctaactggattccattctccctgtcactttcaagtacaccgatcaaacgtagatttggtcttttctcatagtmccatatttcttgaaggctttgttaatttctttttactcttttttctctaatcttgtattctcactttatttcattaatttgatcttcaatcactgatatcctttcttctgtttgatagatttggctattgaagcttgtgtatacttcatgaagttcttgtgctgtgtttttcagctgcatcaggtcatttatattcttctctaaactgcttattctagttagccattcctctcatctttttccaaggctttttagcttcctggcattgggtgagaacatgctcctttagctcggagaagt

SEQ ID NO: 171620 - DNA, 601 bp, Human
atgtctttatagtagcatgatttataatcctttgggtagacagacagtaatgagattgctgggtcaaatggtaattctggttctagatccttgaggaatcaccacactgtcttccacaatggttgaactaatttacactcccaccaacagcataaaagcattcctatttctccaaatcctctccagcatctgttgtttcctgacttttaatgatcatgatgttaacaggcatgagggcatgagatagtatctcattgtggttttgatttgcatttctctaatgacaagtgatgatgagcaytttttcatatgtctgttggctgcataaatgccttcttttgagaagtgtctgttcatatcctttgcctactttttgatggggttgtttgtatttttcttgtaaatttgttgaagttctttatagattctggatattagccctttgtcagatggatagattgcaaaaattttctcccattctgtaggttgcctgttcactctgctgatagtttcttttgctgtgtagaagctcttcagtttaattagatcccatttgtcaattttggcttttgttgccattgcttttggttttagtcatgaa

SEQ ID NO: 171621 - DNA, 601 bp, Human
atagtactgtatcacatcccagggttctgagctatggttcttaagagaccacgtgcaaaaacatttgccagtattttctaatttgccagtattttctcaaaataaaataaaataaaataaactttcatatttttattttaaaatataaagtcaatattatattccccaaatgctaccagagtggatttatttgtagaattaaattataaaataaatttcagtttatttagtaccttgtattaagcacatggtagtgtcttgataatattttatatgtaaaaccaatgtatgaaaaatgaawaaagaattaacaaacgtatatcaggatataattttccatattttgctgcagaattttatatatttctacattgataaatctgtttaattcacaaataataaattccttgcactatgatatacaaagatgaacaggacatagtcccaaacaggaaagttctcacagcctagtacatacaacacaggaatttacacacacaatttatttgcaagttacaatatgttaaataccaacagtaaattgtgacaaagttatcagtttcctaaggaagaaggaagtaattgctactaaggagatagt

SEQ ID NO: 171622 - DNA, 601 bp, Human
tcgaagttttattctcctgtggttactatcatgcatcaaatcattaaatagcattctcttctctattcccttagggattcccttcatgggacttgacacaggaccaggttttcaatgtgtctgagtagtactgatgtgaatagtactgtatcacatcccagggttctgagctatggttcttaagagaccacgtgcaaaaacatttgccagtattttctaatttgccagtattttctcaaaataaaataaaataaaataaactttcatatttttattttaaaatataaagtcaatattataktccccaaatgctaccagagtggatttatttgtagaattaaattataaaataaatttcagtttatttagtaccttgtattaagcacatggtagtgtcttgataatattttatatgtaaaaccaatgtatgaaaaatgaataaagaattaacaaacgtatatcaggatataattttccatattttgctgcagaattttatatatttctacattgataaatctgtttaattcacaaataataaattccttgcactatgatatacaaagatgaacaggacatagtcccaaacaggaaagttctc

SEQ ID NO: 171623 - DNA, 601 bp, Human
tcatgagctattacaaagctaaaattttaaattattatgcagtaaagtccttgctgcaattagaaaacagtaccaattcaaactgcataaaaatacaaaatgacactactataaatgaaatgaattcagcactataaatggtttctaaataagaaagatatttgattcataccaattaccccataactaagggatttttccagtgtagttgttttagcaccatagtggatgtaaaaaaaaaattatgtattttcatcacaaattaagctcttaattagacatgcgatttccttttttttttctataatatttctttcttttctcttgcgaaatcttttcaaggtgtccctggattacaagaatagaaacacacttgatggatcctacttgtcaatcaaattgacagctataaaataaaatcagtcattctgctaaagtataacttttaaggatgaatttttagctcagaaatttaatcatatgagtgcttctgaaataaaatgatgatgcctggttaattctatgtgccactgcatattaattcacacatctcctctttaagaataccattttaatgggatattgtcactgtgtaaaatgt

SEQ ID NO: 171624 - DNA, 601 bp, Human
gtccaatcaagttgacacctaatattaaccatcacaacaaaacaaaatattgaatattttcatgagctattacaaagctaaaattttaaattattatgcagtaaagtccttgctgcaattagaaaacagtaccaattcaaactgcataaaaatacaaaatgacactactataaatgaaatgaattcagcactataaatggtttctaaataagaaagatatttgattcataccaattaccccataactaagggatttttccagtgtagttgttttagcaccatagtggatgtaaaaaaaaaattatgtattttcatcacaaattaagctcttaattagacatgcgatttccttttttttttctataatatttctttcttttctcttgcgaaatcttttcaaggtgtccctggattacaagaatagaaacacacttgatggatcctacttgtcaatcaaattgacagctataaaataaaatcagtcattctgctaaagtataacttttaaggatgaatttttagctcagaaatttaatcatatgagtgcttctgaaataaaatgatgatgcctggttaattctatgtgccactgcatattaat

SEQ ID NO: 171625 - DNA, 601 bp, Human
tggaagtgagaaggagttaatgtccttggagtgttaaccaatatagaagaaccagtggatatatgttcttgcctgctcttccctagacagataatttaagaggtattctctatgcctcttaggagcaatccccagtggaatctagtccacattgctcacagaggcatgaccttgaaaacgtactcgtacattgccctttcctccttctcactcttcactctcattcctgaccctgggatctccttccaagtaaactacctacacccaagaccttatctcagattcttgagaactcacaccrttatatcatgtaaacatctagcactaaatacaccagtaaatatgattgtattagggttctccagaggggcagaaacaattggatctatgtatacataggagagagtttattagggagaattggatcacatcattacaaggtgaagtcccatgataggctatctgcaagttggggagagaagcctataatttctcagtccaagttggaaagactcaaaaccagaaaagctgacagtgcagccttcagtctgctgcagaaggcctgacagccctggggaagccactggtgcaagtcacagat

SEQ ID NO: 171626 - DNA, 601 bp, Human
ttggataatgatgggctcacatatacaatggcaatcccttaagattataatactgtattttcactataccttttcttgtttggatacataaatacttaccatcatgttacaactgcctacagtattcagtatagtcacatccggtacaggttaagtagcctaggaggactaggctgtatcaggtagcctaaatttgcagcaggctgtaccatctaggtttgtgtaagtgcactctgtgacatttgcataatgatgaaatcatttaatgattcatttctcagatcatatccctgtcattaarcgacacataaataactgtaatgtatgtattgtccacaagagaaaatatttgaaatctattgtttttggtgctatttgggtgtcaagttctcctttgggctgcggaatcaatcatgttacataacccctgcctaacagaatccctctgctgctccacctcacagcctctgcacccacctctgagttcagccatagctactggactgttcttaggagcttttaggcttgttctatactgatcaccttttgccttgaggtaagttaatgcagcctggaagtgagaaggagttaatgtccttgg

SEQ ID NO: 171627 - DNA, 601 bp, Human
gtagaacagaatagaaaacatcagacctcattgtgcacagcaagggtattatttcataaatttttgtctctgtatgcccagtagaatcatatacagtcatgtgtcacataatgacattttggataatgatgggctcacatatacaatggcaatcccttaagattataatactgtattttcactataccttttcttgtttggatacataaatacttaccatcatgttacaactgcctacagtattcagtatagtcacatccggtacaggttaagtagcctaggaggactaggctgtatcagrtagcctaaatttgcagcaggctgtaccatctaggtttgtgtaagtgcactctgtgacatttgcataatgatgaaatcatttaatgattcatttctcagatcatatccctgtcattaagcgacacataaataactgtaatgtatgtattgtccacaagagaaaatatttgaaatctattgtttttggtgctatttgggtgtcaagttctcctttgggctgcggaatcaatcatgttacataacccctgcctaacagaatccctctgctgctccacctcacagcctctgcacccacctctga

SEQ ID NO: 171628 - DNA, 601 bp, Human
aacagaataacacagcgtagaacagaatagaaaacatcagacctcattgtgcacagcaagggtattatttcataaatttttgtctctgtatgcccagtagaatcatatacagtcatgtgtcacataatgacattttggataatgatgggctcacatatacaatggcaatcccttaagattataatactgtattttcactataccttttcttgtttggatacataaatacttaccatcatgttacaactgcctacagtattcagtatagtcacatccggtacaggttaagtagcctaggagsactaggctgtatcaggtagcctaaatttgcagcaggctgtaccatctaggtttgtgtaagtgcactctgtgacatttgcataatgatgaaatcatttaatgattcatttctcagatcatatccctgtcattaagcgacacataaataactgtaatgtatgtattgtccacaagagaaaatatttgaaatctattgtttttggtgctatttgggtgtcaagttctcctttgggctgcggaatcaatcatgttacataacccctgcctaacagaatccctctgctgctccacctcacagcct

SEQ ID NO: 171629 - DNA, 601 bp, Human
acatgatttccattatttttaatacgctaatatttaccttcttaggtaaattaattatcttttcggccaatgttttccaaaccatggatttaaaaattactttagggagttatgaagagcagtgtttaattaaatagaacagaataacacagcgtagaacagaatagaaaacatcagacctcattgtgcacagcaagggtattatttcataaatttttgtctctgtatgcccagtagaatcatatacagtcatgtgtcacataatgacattttggataatgatgggctcacatatacaatrgcaatcccttaagattataatactgtattttcactataccttttcttgtttggatacataaatacttaccatcatgttacaactgcctacagtattcagtatagtcacatccggtacaggttaagtagcctaggaggactaggctgtatcaggtagcctaaatttgcagcaggctgtaccatctaggtttgtgtaagtgcactctgtgacatttgcataatgatgaaatcatttaatgattcatttctcagatcatatccctgtcattaagcgacacataaataactgtaatgtatgtat

SEQ ID NO: 171630 - DNA, 601 bp, Human
ttctgaaacactgacagatgaaatctagaaccatggtacacatttaaaccatgctactctattttctaatttcttaagaattgagtctttcttgaccttaaaactatgacctttatttctaaacatctcactgtatatggcttaggttacatgatttccattatttttaatacgctaatatttaccttcttaggtaaattaattatcttttcggccaatgttttccaaaccatggatttaaaaattactttagggagttatgaagagcagtgtttaattaaatagaacagaataacacagygtagaacagaatagaaaacatcagacctcattgtgcacagcaagggtattatttcataaatttttgtctctgtatgcccagtagaatcatatacagtcatgtgtcacataatgacattttggataatgatgggctcacatatacaatggcaatcccttaagattataatactgtattttcactataccttttcttgtttggatacataaatacttaccatcatgttacaactgcctacagtattcagtatagtcacatccggtacaggttaagtagcctaggaggactaggctgtatcag

SEQ ID NO: 171631 - DNA, 601 bp, Human
gcaataactgcttaaggattagtactaatagtgtttattagaaacagctgtgtactcagttgtagaacacatccagcagtagctggcaaaaggcacatgacattctgggtttttgcattttttccctttatccaccccttttggggtttattctccaataactggaagataatcaattacaactgagatttggtgaaatattgatattgattggtaacctgtgagcacacactcctgtgttatctttcccatgagacagatttacaggagtgctggggtgggatggggaggtcgggcttcyaggaggagctgtgtacacaacagcaaaggtggagcttgtaagcatgagggatctgatggaaagttatggcttgtgtgagggttactattcccttacttgttcacttactctttaaactgtactctgttgagacaagtcttacaacagcagtgcttgcagatcactgtggctgtgatatccttaaacacaacagctgacagtagaaagaggcagcaaagctcatagaaacttgatgggatttcccatattcttaagctctcatttcctccaaagaaaatgcaataagaaagaataaagaag

SEQ ID NO: 171632 - DNA, 601 bp, Human
catactgagttgtgcaaatagtcactgtcctttaagaatcaaaagatgtgggttttttttgtttgtttgttttgagatggagtctcgctctgtcgcccacgctggagtacagtggcgcaatcttggctcactgcaagctccacctcccgggttcacgccattctcctgcctcagcctcccaaatagctcggactacaggcgcctgccgccatgctcagctattttttttgtatttttagtagagatggagtttcaccgtgttagccaggatggtctcgatctcctgacctcgtgatctgcycgcctcggcctgccaaagtgctgggattacaggcgtaagccaccgcgcccggcccatgaaataataaatgtgagaaattctaggtttgaaaagttaaataaattttttaaccttgatacttttcagaatctgtagtaggcaacactttgcgaaagttactttaccaccaaattgtcatttcacaagacaccaattgacttgacaatgaggtcagtttttcagattgctatactggaggatctactgcaatgaggagaaggcaataactgcttaaggattagtactaatagtgtttattag

SEQ ID NO: 171633 - DNA, 601 bp, Human
aaggattatactcaaggaagtaagtaataaccaatatgcatagctgtatcctctgttttccttctccctataagtgaagctcattaccttttcagtacccaaatccgtttcactttgatgctgatctggaaccagctggatggaaacaggaaaggagaaaaggagttcactcctctggggcttgaaaagtcacaccgagacaccaagtgaatcaagggacaaaaataaaaaatcagtactgtgacattttttatttgcatatacatatagccatgattttgtagtttatggccaatgtcaytgaggttgacattggtggtacaataaaaaaattatctggcataggaagctctgtcatttgaagggatgagagaatattccaagggaacttggagaaagcatcgtagaaaaaggagtgtaaaggcacccacgtgataaaaaatggcacgctgggcaaaaccttattttccatactgagttgtgcaaatagtcactgtcctttaagaatcaaaagatgtgggttttttttgtttgtttgttttgagatggagtctcgctctgtcgcccacgctggagtacagtggcgcaatcttggctcact

SEQ ID NO: 171634 - DNA, 601 bp, Human
gagcttgctagcgcttccccaacattcaaaaatagtaatttgtcatcatagaatgatggagtgggggatggggcagaacttatattatgatccatataaaagcagctaattgtgtacctcattaaaaattatattttggtgggtactcatgttgtcaacatggataatgattgacttctctttgtccttaaactgctatatactttagttaagcattactactttgacatttctgaaaaggctgcctcatcaaatattttgaattttaaaaaaaatcttgtgagtgtaaactactttgtakaaaattatttaaaatactatctaaaacactgttaattatgaaggaaaagaataaaaattattagatttaagagagaaaaacaggttaaatttaccatgagttaacaaagtacagaaaaaaggaaaggattgaacgatttgccatggtttatcctctgaaatattcacaataagtgcaacaagcagttactatattactatatttagactgaaaactagtttctgtatttttatttaatggcattctatatttaaaagggtcttactaaaccccacagtgttctagggtaatgtgtagtga

SEQ ID NO: 171635 - DNA, 601 bp, Human
ggtattacattagacaccaataaattattggaaatagaggaggtaagggaccaaaataaaagatgataagttttgtactattgttgtcagaattatcctggagaaagcaaacgtaatgcttttaacaaaagtgtggtgattctactagcaccacccacatatggatatttagaaaaaagtttacaatggtgataatgatgagaagacaaatacatgtaacctttcctcattttgcagtcacaagcaattatcatgaagatgatagattttaccattaaataaaatgtcaacaatcaagtgyactgaatccttttagttcttaatctagataattacttcatgaatttgacttgcattcacttccacatagtgcatacagctagacagataaaactgaatgaagttatgacatttgcatgtataacaaggctgttcatttttgttctctccaactatttatcacttgattaaaaatatgaccccactatacctacttagtattacttacctagcaattactgcctttcaattgcatgccattttattcacagttcatgttgttatcaaaatacactcaacaaaatcaaataataagtgggga

SEQ ID NO: 171636 - DNA, 601 bp, Human
gtcaggctggtctcgtactcccaacctcaggtgatccacctgtcttggcctcccaaagtgctgggattacaagcatgagccaccaagcctggctccaatttatgatattatagttagtctagctgcacagtcttggagcagagagcatgccctctttaactctagtgtcctttattgcaatgctgtccaatagaaaaacaatgtaggcctcagatgtaggagatgtacacaatttcaaaatttctaataggcatgttaaaaacaaaaaagtccaactaattaaatagcattttatttaatrcattcaaagtattatcagttcaaactgtaatcaaattaaaaatcattaatgactttttaaatattcttattttggagaaagtcttcaagtctggtatgtagtttttatttacagcacatctcaattttgactagccatatctaaagtattcaatagtcacatgtggctagtggctaccatattggacagcagctctggagctgcacactgaagcatacatgtgagctggggaccttacatttttattgaacaaaaaaggcagtgcagtggaaagatcagcaacatgtgatggtattgtgt

SEQ ID NO: 171637 - DNA, 601 bp, Human
ctcgttacccaggctggagtgcaatggtgtgatctcggctcactgcaacctccgcctcctgggttcaagtgattctcctacctcagcctcctgagtagctgggattacaggcatgtgccaccatgcctggctaattttgcacgtttagtagagacagcgtttctccattttggtcaggctggtctcgtactcccaacctcaggtgatccacctgtcttggcctcccaaagtgctgggattacaagcatgagccaccaagcctggctccaatttatgatattatagttagtctagctgcacrgtcttggagcagagagcatgccctctttaactctagtgtcctttattgcaatgctgtccaatagaaaaacaatgtaggcctcagatgtaggagatgtacacaatttcaaaatttctaataggcatgttaaaaacaaaaaagtccaactaattaaatagcattttatttaatacattcaaagtattatcagttcaaactgtaatcaaattaaaaatcattaatgactttttaaatattcttattttggagaaagtcttcaagtctggtatgtagtttttatttacagcacatctcaatttt

SEQ ID NO: 171638 - DNA, 601 bp, Human
actgacatagcatctttctagtctgccgtaagtaccactacctttacacctcattgagaggcactttttttttttttttttttgagatggagtcttgctctgtcaccccggctgcagtgcaatggcacatctcagctcactgcaacctccgcctcccaggttcaagtgattctcctgcctcagcctcccaagtagctgggattacaggcacccaccaccatgtccggctaatttttgtattttttagtagagacggagttttaccatgttggtctggctggtctcaaactcctcacctcasgtgacccacgtgccttggcctcccaacaatgtgctgtgattacaggtgtcagccaccatgcccggcctgagaggaacctttttttctcagtgggagtaggtaaggaagtagaaacagatgcttttaagaaaaactggtaagaagcttaaaatattttctggatagatttttatttttctatggttggccatagagcagtgatgtgataaaataatatttgaggtgactgtttcagcagcctgtttcttgtcaccaagacttaacttacactgtcttctgtacttgaaatgctaacaccat

SEQ ID NO: 171639 - DNA, 601 bp, Human
cgactgacatagcatctttctagtctgccgtaagtaccactacctttacacctcattgagaggcactttttttttttttttttttgagatggagtcttgctctgtcaccccggctgcagtgcaatggcacatctcagctcactgcaacctccgcctcccaggttcaagtgattctcctgcctcagcctcccaagtagctgggattacaggcacccaccaccatgtccggctaatttttgtattttttagtagagacggagttttaccatgttggtctggctggtctcaaactcctcacctyaggtgacccacgtgccttggcctcccaacaatgtgctgtgattacaggtgtcagccaccatgcccggcctgagaggaacctttttttctcagtgggagtaggtaaggaagtagaaacagatgcttttaagaaaaactggtaagaagcttaaaatattttctggatagatttttatttttctatggttggccatagagcagtgatgtgataaaataatatttgaggtgactgtttcagcagcctgtttcttgtcaccaagacttaacttacactgtcttctgtacttgaaatgctaacacc

SEQ ID NO: 171640 - DNA, 601 bp, Human
ttcctaggtattttattctctttgtagcaattgtgaatgggagttcactcatgatttggctcgctgtttgtctattattggtgtataggaatgcttgtgatttttgcacattgattttgtatcttgagatgttgctgaagttgcttttcagcttaagaagattttgggccgagacaattgtaaatatacaatcatgtcatctacaaacagagacaatttgacttcctctcttcctaactgaattcccagggaatcaaccaaaaaaggatacatttcaaaattatttagcaaacagtggtcraacataaaattaacatttatttaacacttacagagtgccagacactatgttttaccttgtttctaattcttagactttactttttacagattagggaattgaaagtcagagagggtaagcagcttgcctacaacctaagggcagcacaggccagtgcctgaattcaaacctgtggaggatactgcactgcctgagctataaccctcaattctcttttatgctcctaattagtttcttattatctataaaacatgtcttttagaattgattttccctactttcttcatttctatctgcctc

SEQ ID NO: 171641 - DNA, 601 bp, Human
ttttaaaggtagaaagtacaggattgccttttatctccaaacgtgacacttacagtgatcattgcattttgcttgtttctgatgatcaggtgctaccagacagtctctttcatctggggagcataccaccacattgctctcagggaagccagtccttcagcagtatcttttgtctatggagggcaggactagcctacagagggcagctccactgactttactaacattgttggtacccatcctagtagcaaatcccttagcactttggtaactcaaactgtcattgcttttcattgtagaygcacattttgatttttaaaacaagtacaaaaaaagaacaaaaatttatcagttttatcactcagtatcccagcaagaaacagatggtacactcaaagtggtttaatgaatagaagagaacttaacatacttactctggctcccccgtgatagttaactagttaattgtatggctttagatagtatatccactttagaatgcttattcatttgaggtttttgattacttctttttaaggtagatttggtggctccacttctcttagagtggaccatctctttttctttttttaaattatac

SEQ ID NO: 171642 - DNA, 601 bp, Human
ttcatatacctgttttccatttgtgtgtcttcttttgagtagtgtctattcagatcttttactcattttttaatcaaattattagttttttttcctattgagttgtttgagctccctacatattctggtttttaatcccttgtcagatagatagtttgcaaatattttctcccattctgtgggttgtatcttcacttttttgattgtttcctttgatgtacagaagctttttaagttgatgtgatcctattggtccatttttgctttggtcaccagtgtttttgagctactactaattgamtcttttcccactccaatgtcctgcagagtttctacaatggttccttttagtagtttcatagtttgaggtctaagaatttaaatctttaatctattttgatttgatgtgcctatggtgagagacagtggtccagttcgtttttctacatatggatatccagtcttcccagaaccatttattgaagagacgatcctttcctcaatgcatgttcttggcacccttggcaaaaatgagttaactacagatgtataaatttatttctgagctctctattctgttctattagcctatgtgtctatt

SEQ ID NO: 171643 - DNA, 601 bp, Human
ccaaattctttgccctttagttacactgacctgcttctctctacttgagagagaacagaaagtcaaaatcaaagatatattttgcttacctcatgcctctgcccttagcctgccttggcctaaggatatataagaatatcctacaaacttgagggtgttgctctgtcctatcttttatgtacccttttacaataggtttgaaaaaaataaatgtatttcatagaatgtaagactccatcaatagcaaaaggtatgagtattttgtgtaccaccaggaaaaaattaaaccatgacatgtttkcatatcttagtatttcctttaacaactgctaaaatatttgactgatttagatatattttttattatattcattctagtcacacataaaaagaaaatataagcacaataatgctgtgaagttattgccaaagttcctcattttcagggtctaactcttctgaatcacttttcaagttggaggtattgttgtccatgttttcccacctgtttcattctctgggacatcaagaatatttcttaagaggtttcactcttcaggctttgaggttggaacatctcgattttagcggaagatgagca

SEQ ID NO: 171644 - DNA, 601 bp, Human
tttctcaagaagttaactcctcaaacactggtcaaggcatcattctctcttcttcccttaccagaaagtctcaccatttagtacctctttaagagaatagctgcttaaagatcatatataaagtaattactttttattaaaatgcgatgaaattttaagtctagtttatgaaagcagcacttactagactgaagatacagaaagactggctctgaagaacagagatacggagcagacacatgaggtttagaagtactgagcgagctgaccgagtggtggggacaggccaggggaactgattggaactaatttggaaaggaggaggagcttggacagggaatacagccctcaacagctggggagaaagactgaggaagcaggccaggagaaggaaccttggcaatgagatgcccaaacttggatatcgaaggcaatcagggaatctctcttagaaatattatcagtcctctcttgaaaatgcattcctcaactcctcctaggggagcattcctctatctcctagagactctgaaacatttggccacatgtagactgtaggctataactggttagtcacagtgtatgactgtggatgtgaata

SEQ ID NO: 171645 - DNA, 601 bp, Human
ccagactgtaagcaatattttctcaagaagttaactcctcaaacactggtcaaggcatcattctctcttcttcccttaccagaaagtctcaccatttagtacctctttaagagaatagctgcttaaagatcatatataaagtaattactttttattaaaatgcgatgaaattttaagtctagtttatgaaagcagcacttactagactgaagatacagaaagactggctctgaagaacagagatacggagcagacacatgaggtttagaagtactgagcgagctgaccgagtggtggggayaggccaggggaactgattggaactaatttggaaaggaggaggagcttggacagggaatacagccctcaacagctggggagaaagactgaggaagcaggccaggagaaggaaccttggcaatgagatgcccaaacttggatatcgaaggcaatcagggaatctctcttagaaatattatcagtcctctcttgaaaatgcattcctcaactcctcctaggggagcattcctctatctcctagagactctgaaacatttggccacatgtagactgtaggctataactggttagtcacagtgta

SEQ ID NO: 171646 - DNA, 601 bp, Human
aacatatacacacaaggcaaatggatgcagaagtcatttcttaatggaagctgaatgataacatcaatttaagagaaaagatatcagaaacaagattggaataaaatgtagcctagatttcataaaaacaatagccttactttccctgtctcattcatctgctacaaaatcacatttagaaatttagtccctgagaaaaataacacaggaatggaaaattcagatttggaataatcacagacaactgtaatctaagattatttgttatactttctttcaacactataatggtttcaaaaaygcttgttttccagcgagtaacataaaccaccaaacacattgctgttcaaacttgccaaaaggacatgttatgtatcacggttttttaaactgctggttgcaatcttttagtgagttgtaaggctaggagttttatttttttaaatgaatcttttttagttagatgtactttttatatacataaacatatatgtgtgctctgggtcaggatgtaaaatgtatttattatgagttgtagtcaaaatatttgaaagccattgtttagagactacgaatatgctaacaatgtttaatgaatatt

SEQ ID NO: 171647 - DNA, 601 bp, Human
tttggtttcgttgcaattgtttttggcatcttcctcataaaatctttgcccagtcttatgtctgaaatggtatttcttaggttatcctcctgagttttttatagttttaggttatacatttatgcctttaatgtgattcatcacctaaagagaactaaaaacaaaaaccacatggttaactcaaaagatgcagaaaaggcttttgataaaattcaacatcctttcatgttaaaaacctcaacaagctaggcattgaatgaacatatttcaaaataataagagccacctatgacaaatccayaatcaacatcatactgcatgggcaaaagctggaaacatttcccttgaaagccggaacaagacaaggatgccctctctcaacactcctattcaagatagtactagaagtcctggccagggtaatgaggcaagagaaagaaaaaaaaggcatccaaataggaagagaggacgtcaaactaaccctgttttcagacaatatgattctatacctagaaaaccccatagtctctaccctaaaactccttgatctgataaacaacttcagcaaagtttcaggatacaaaattaatatttaaaaatc

SEQ ID NO: 171648 - DNA, 601 bp, Human
attgatttatttcacttattcattcattcaccaaatatttgttgagtttgtaatacatgctttatattgttccatgtgctaggtatagaggaataaataagacagatgagatgtctgcttttatggtatttaaagtaatggagacatgctataagcaaataaataaaaattccatactgccacaaattcattttttaaagtcttttattctttttaaaacctgggaaggaattaggtgggaggaagatatggggattgaagctagaaggaagaattggtggggactgctgtcttactgccrttatccaatacatactctgagcgttatcacttcagattgaggatcttttaagtcttttcagtgttcctaattacctgtttgtgtaaaaagcattgccaaatgaatgactaaaatatgtttttttttaaatttctgtgggctgggtgtgtgactttgcaaatgagcaactttgccaggaaactgagaaatatattcaaaaaatcttacttttgtcatagggactatgtcttgctgagaaaatggaaaggaaattagaagatacagccattttgtggaaactgctctttagaagttcaggaa

SEQ ID NO: 171649 - DNA, 601 bp, Human
gggatgcagcccaccttgagagtttcctggctcagagtcctctgaagcaggctcactgaatctgtcaaacagaagccagccactggcatttttccacatctgcaagatgagaacatgtgatggatgacatgaacttctccattagatgaccttagcttcttgatcttggaagaaaaccacattcttaatttcttatgcccctgaagaattttcaatctactaaacacggtactcaggtcacatttttcaaggactcctttgctccagtcatttaaaaagaattcagtgaaaaaagatatayacatttatggaaaaaaaatcacaggtttcttaaaaataaaaggaaaaacaacttatattcagaaactagactttgtacactaaaatcgcttaggaagtatcttgccaattttgccttctaaatgtctccatattttctgcttttctccattcctactgttcctactttagcagggattttcctcctcttacctggccaatcacactaatctaatttctccacctgactccagccaatttccccttcaaatttccaatacacagctaccaaatggttctttctaaaacattctaagacatt

SEQ ID NO: 171650 - DNA, 601 bp, Human
ttgtggtgagccaagtcatcctgacaacatgagaccagattcaagagctgtccaaattcaagagctgtcctgtgggatgcagcccaccttgagagtttcctggctcagagtcctctgaagcaggctcactgaatctgtcaaacagaagccagccactggcatttttccacatctgcaagatgagaacatgtgatggatgacatgaacttctccattagatgaccttagcttcttgatcttggaagaaaaccacattcttaatttcttatgcccctgaagaattttcaatctactaaacacrgtactcaggtcacatttttcaaggactcctttgctccagtcatttaaaaagaattcagtgaaaaaagatatacacatttatggaaaaaaaatcacaggtttcttaaaaataaaaggaaaaacaacttatattcagaaactagactttgtacactaaaatcgcttaggaagtatcttgccaattttgccttctaaatgtctccatattttctgcttttctccattcctactgttcctactttagcagggattttcctcctcttacctggccaatcacactaatctaatttctccacctgac

SEQ ID NO: 171651 - DNA, 601 bp, Human
cttacccattgcaataccccatttttcagctggtaggctggaacagactaggattttatgaactgtaagggcttttaacagattctgaaaggcatcaagagtataagattgactaagtatattttatttattgtgataacactgcatcctcccacagtgcctgacacataaaaagcagatcaggctgggcgtggtggttcacgcctgtaatcccagcaatttgggaggctgaagcaggcagattgcctgacgtcaggagtttgagaccagcctgaccgacatggtaaaacctcgtctctastaaaaaacacaaaaattagccagtcatggtggcgggcacctgtaatcccagctacttggggggctgaggcaggagaatcgcttgaacctgggaggcagagggtgcagtgagccgagaccgggccattgtactccagcctggacgacaagaacaaaactccatctcagaacaaaacaaaaacaaaaaccacagaaaaacagatcaataagtgtatatatattgggtaagcaagcaaaaattaagtagcacattgacagattgtatttctgttttagagtattaatatgggctacaggatgg

SEQ ID NO: 171652 - DNA, 601 bp, Human
ttcctccttttatatacccatccacagactgtgcagtactctgggggcagggagaggacgaggaaaagtagatcttacccattgcaataccccatttttcagctggtaggctggaacagactaggattttatgaactgtaagggcttttaacagattctgaaaggcatcaagagtataagattgactaagtatattttatttattgtgataacactgcatcctcccacagtgcctgacacataaaaagcagatcaggctgggcgtggtggttcacgcctgtaatcccagcaatttgggagsctgaagcaggcagattgcctgacgtcaggagtttgagaccagcctgaccgacatggtaaaacctcgtctctactaaaaaacacaaaaattagccagtcatggtggcgggcacctgtaatcccagctacttggggggctgaggcaggagaatcgcttgaacctgggaggcagagggtgcagtgagccgagaccgggccattgtactccagcctggacgacaagaacaaaactccatctcagaacaaaacaaaaacaaaaaccacagaaaaacagatcaataagtgtatatatattgggtaa

SEQ ID NO: 171653 - DNA, 601 bp, Human
agtttccttgagacctcagcacatctgttttcgtggcaaacacaaaacagtttgggtggcaacccaggctcatttatagagcattttatataaactttttatataaaataaaaagtgcttgtgaggggcaatgggactccaaaggcaaacgactttgtcttgggcgttggtcattccagaagcccttgcagcagcatggtgctggggtggagggcattttaagcttatgcacgccaaaagatgtgttagctttttggaaggtgtcataggctttggaatctgacccatcatttatttattrtattatattggcaatcttggcaagttaaacattttgataatcctctttcttaacccttttttttcattattagagatgaacgatgcataatgataatgtatgtttatacaaacccctataaaactgattaaatagtcatgcagtgttatcaagggaacagaacaagggaaagtgttttctgaaaagttaaattgttttaagattttgaaaaataacagaaagctaaaataaaattcaaagacatacaatatcaaatgtaaatcaaactgtcataactaagcctaaggaggtatgattacc

SEQ ID NO: 171654 - DNA, 601 bp, Human
atattagcaactaggacagaactgtgaaccctcctcagacttaatgcattccagttagtgtaagacagaagtttccttgagacctcagcacatctgttttcgtggcaaacacaaaacagtttgggtggcaacccaggctcatttatagagcattttatataaactttttatataaaataaaaagtgcttgtgaggggcaatgggactccaaaggcaaacgactttgtcttgggcgttggtcattccagaagcccttgcagcagcatggtgctggggtggagggcattttaagcttatgcaygccaaaagatgtgttagctttttggaaggtgtcataggctttggaatctgacccatcatttatttattgtattatattggcaatcttggcaagttaaacattttgataatcctctttcttaacccttttttttcattattagagatgaacgatgcataatgataatgtatgtttatacaaacccctataaaactgattaaatagtcatgcagtgttatcaagggaacagaacaagggaaagtgttttctgaaaagttaaattgttttaagattttgaaaaataacagaaagctaaaataa

SEQ ID NO: 171655 - DNA, 601 bp, Human
gattgaatatgcatgtacttagaaataaccagcatataacttagcggttgaaaaaaaagatcattttgtgttagaaatgtagacagctgacatatttaacaacatagtgacatacttgaagcacacacaaactgaccactataatgaagagtaatagcagaattcaaggatgaaaaacatatttaaggaattcaagaaaacaattgtgacttttttctataatttgattttgattctcatatgtagaaaagaattggaaacctttctctgacatccagtctttggctatctaaccaatggsactaaggatacacttattctactaatcacatttatagcattaatcaaatcattctgtgatattttagttagtaataaagacgtctatattgtataattgcccagattgaaatctaccttgtattaatatccttgttagtggcttcatttttaataaagtctgttaattgctaaaacttcaaagctcttagaagtttctatcttgagactaccactggaaaatattcctacttacttatcaattcactcagttaataaggaaaatcattttctgtcaaaatgcagctcttaacagataatc

SEQ ID NO: 171656 - DNA, 601 bp, Human
actccgtctcaaaaaaaaaaaaaaaaaaaaaaaaagagtaaatctcaggaattataagagagctataaggagagatcctcttttcccccagctagtgcaggatacatttgtgaacacggtacagcgttctagtgaacggctagagccaatttgacaccatagttgtcagagtgagggggactggggctgcagcagatccgcttgtagagcctgaggataaggccaatgctgggaagggaaaccaaagagaacaacagagatgccaagttcatggtaatatcaattttgcagctatatctakcctcttagagagctagtcctacttctgggcttctgttatttgagtcagtggattcctttaattgtttatgccagcttatttattttgtcacttgcaaaagaaggactcttaaaagatactctagctgtgtgaattttaggcattcagctacctctgtgaagttttcattcataagataataatgataataccttcttggcatgattaatactttcttaggtgggctgttagcagaatcaactgagagaaacaacaggcccatagtagacattcgaaaagatctaagttcctttcccccac

SEQ ID NO: 171657 - DNA, 601 bp, Human
gatcctttagtccagctccctcattttacaaatagactgaagctcaaaagagcacaatgaaaacattacattagtgttaggctcagctctagatcttagttcacttggctccgagttcagcgcattataaaaaatgcccaaatttaagtgatgcctcaggctgtttcttctgggcccatcagacttaatcagataaacaaaatcagatttaatctggttttacctacttcatctacacagaagagttagcatattccaattgaaactcagaaaatactagttacacaattattaaatccarcaccagaaaccttccatcccttctccatcttactgttcatgcttttctacactaaatatttcctgactgctctactcagcacactccctaaactgcttgctgcattcaagcctgtgagcttttactcttattgattgcctcatctaaaatacatccaatcttaatcacagactctgttctaagtgctcagagtataaacagaaataagtcttcatttgttgttttagagttttcatttgctgtaaaagatacaatagctaattgaaattatgatcattgctacaaagttaaagtataaaa

SEQ ID NO: 171658 - DNA, 601 bp, Human
acatgctgagtagcagtattcctcttaaacaaactaagtgtaaagcacctttctctaaaatcagcaaagcacactacaatattagtatgtttcttttttttttttttttttttttttgagacggagtctcgtcctgttgcccaggctggagtgcagtggcgcgatctcagctcactgcaagctccgtctcccgggttcacgccattctcctgcctcagccttccgagtagctgggactacaggcgcccgccaccacgcctagctaatttattgtatttttagtacagacagggttttaccktgttagccaggatggtctcgatctcctgaccttgtgatctgccctcctcgacctcccaaagtgctgggattacaggcgtgagccaccgcgcccagcccaacattagtatatttctttgggtttgtttactttcagaaggccaatttatattgttatcttgtgcaatgcatgtttgctagaagtacacccaaactttagatgctaagactgtccgtttgagattctaattactacagcgatcttttcaagcaggaggagagcagaagtgagtattacactgacacattttacactcttttt

SEQ ID NO: 171659 - DNA, 601 bp, Human
tccctcacaccagggctcaagtagtttcttcacatatgtgcactaatcactaccctgcagaatacgtaatgaggatccttggaagatgtcagagggtctttttgcaactcttacttctctgatactctgtctatgacctttagcctccttggtctcccaagactctcagctccatctcttcaactcaagaagtttgttgggtatctcctggtttgcccctccctgagccacagcctggatgcctctcaaggcatttagctaggacaatcatagggctcatttaatttgtttcttatctctmaggaatcactatcttccattgtctaatgtccactgtcatgaaaactgttcttttgtatgttttgtcctgattttaaaaagtttttttaaagatgagactgcaaatctagtcactgtactccatattggctggaagcagaagtgagacctactttttaaaaaaagtaaactatttgaaaaacttaagcctgtttctgatgagggattctctatttggactgaaagcaaaacatgctgagtagcagtattcctcttaaacaaactaagtgtaaagcacctttctctaaaatcagcaaagcac

SEQ ID NO: 171660 - DNA, 601 bp, Human
ctttatcttaattcttctatatataacatatcttttacttctggttgcttttaagtttttcttttatcatcagttttaggtaatttagttatgatttaccttgatgtttttttcttgtgttttgggtttgttgagctcttggatctgtgggtttatagtttttatcaaatttggtaattttctatttctttgaatatttttttctgtctacctctccctctcagagattccaattacacatatgttaggagcttgaattacttccaaagtccactgatgatctattcatttaaaataattktctccatttatttgggataatttctattgctatgtcttcaaatttataatattttcttttgcaatgtctaatttgttattaatcacattcaacatatttttcatctcagacattgtaattttcctctatagaagttcaatttggaatttttaaaaatcttccaggtatcaatttagcttttgaaaatatggaatacagttaaaaatcaccgttttaatgcccttgtctgctaattctaagatctgtttcagctctgtacctatccatttggattaatttttctcttcattatgagtccca

SEQ ID NO: 171661 - DNA, 601 bp, Human
ataacatatagttatgtatattatatacatgtatataactatatgtatataatatatagtacatgtatataatatatagttatatataatatagttatatacatgtatataatatatagttatatataatagttatatatattatatacatgtataaagtatatagttatatataatatatacatgtatataatatatagttatatataatatatagttatatatattatatacatgtatataatatagttatatatataatatatagttatatatattatatacatgtatataatatagktatatatatataatatatagttatatatattatatacatgtatataatatatttatatatataatatatagttatatattatatacatgtatataatatagttatatatataatatatagttatatattatatacatgtatatagtatatatatttctttactgctgaatattcgacatttagtatagtacctagagtaaagcaggtattcaacattagtgataaatgttgaataaattggctgaattccccatttaactccattttaaaatggagttaaaatagagacttcaacccttg

SEQ ID NO: 171662 - DNA, 601 bp, Human
aacatatagttatgtatattatatacatgtatataacatatagttatgtatattatatacatgtatataacatatagttatgtatattatatacatgtatataacatatagttatgtatattatatacatgtatataactatatgtatataatatatagtacatgtatataatatatagttatatataatatagttatatacatgtatataatatatagttatatataatagttatatatattatatacatgtataaagtatatagttatatataatatatacatgtatataatatatagktatatataatatatagttatatatattatatacatgtatataatatagttatatatataatatatagttatatatattatatacatgtatataatatagttatatatatataatatatagttatatatattatatacatgtatataatatatttatatatataatatatagttatatattatatacatgtatataatatagttatatatataatatatagttatatattatatacatgtatatagtatatatatttctttactgctgaatattcgacatttagtatagtacctagagtaa

SEQ ID NO: 171663 - DNA, 601 bp, Human
attttgaaaatattgagatttctattataatgcagatccttaagaacatttgctctcctgtattttaaacaggtatacttaagaaggacagagactgtgggaaatgacaaacctatattcacctctcagtcatgtcagatttttcatgcactctcacagagtgcaaataaaagtttgtgtcacaattactatctatcttttgggtttgggcagttctactcataatatcttggagaatgacaggatcaagaaaaagaacagggactcacagatgacagcatagcagcccaaaacaaaggcmaagacaggaaggaggaggccagagaacacttactggtaagtggttgggctgacattgatgcgccgagggtgacttcccgactcgaatttgcttgccagtgtgacattatttccaaacaggcaataacgtggcattcgcaccccaacaactccagccagcacggagcctgagtgaattcctatcctcatctaaagaagaatgaaagaggaaaaggaacatatttgtttccatttggtatgcaattattttaatgaaaggcactgctaattaataataataataataaaaaaaaactatgag

SEQ ID NO: 171664 - DNA, 601 bp, Human
gattatctttaagataaaaagaatttaatgttttactctgtacctggtatagcagagcattcaaaatcccaaagtccaaaatgctccaaaatctgaaactttttgagaaccaacacgatactgaaaggaaatgctctttggaagatattggatttcagattttcaaatttgggatgctcaccaggtaatatgcacaaatattccaaaactcaaaaaatttcaaaccgtaaaacacttgtggtcccaagcattttgagtaaggtataatttatatatatataaatttaaagactttatttawttattcaaaaaaacagtccaaccaccttttctattgtatttcttccatttttataaacagaaacattttgaaaatattgagatttctattataatgcagatccttaagaacatttgctctcctgtattttaaacaggtatacttaagaaggacagagactgtgggaaatgacaaacctatattcacctctcagtcatgtcagatttttcatgcactctcacagagtgcaaataaaagtttgtgtcacaattactatctatcttttgggtttgggcagttctactcataatatcttggaga

SEQ ID NO: 171665 - DNA, 601 bp, Human
ggggtgaaggtgcagaacaataacacaacagtaagcttcagtgtatgcagtagttgaaatgatttcattcctcagaccttgttaatcactaaggatcatcataaactgtgaaaaagactacaaaaactctgagtcaccaccaaaatgcacagacttgtatggctggcagagttttttttttttttaatacatcactatgtaaacaaagccagctactgttatgatgtctaagcaacagggcatgaactcctcctcacacaggttgggcccattcttttacacatcttttttttttttttttaagtgaagttgtcacagaagacataaatctacactaagttacacaaacatggaaaataagtatcaataccatgatgggaataaatggaaccatgtaataggatatgagtgaggtagctgatcttcagtaacttttttcatcgtatagagcagaaagtatcagaatcactgatctctactagagaatttgacaaaattcaatttgccatggtaattgttgtcagatcatctgtaatatgcccagaattgtgttgggaaaattgggagaagtttaaaagatgcaaatcctcttataaatatc

SEQ ID NO: 171666 - DNA, 601 bp, Human
gtcagctcaacgtgtctatctatggctctgtttgattttggggggcctgggggtgaaggtgcagaacaataacacaacagtaagcttcagtgtatgcagtagttgaaatgatttcattcctcagaccttgttaatcactaaggatcatcataaactgtgaaaaagactacaaaaactctgagtcaccaccaaaatgcacagacttgtatggctggcagagttttttttttttttaatacatcactatgtaaacaaagccagctactgttatgatgtctaagcaacagggcatgaactcctactcacacaggttgggcccattcttttacacatcttttttttttttttttaagtgaagttgtcacagaagacataaatctacactaagttacacaaacatggaaaataagtatcaataccatgatgggaataaatggaaccatgtaataggatatgagtgaggtagctgatcttcagtaacttttttcatcgtatagagcagaaagtatcagaatcactgatctctactagagaatttgacaaaattcaatttgccatggtaattgttgtcagatcatctgtaatatgcccagaattgtgt

SEQ ID NO: 171667 - DNA, 601 bp, Human
acaggtaatgttggacattctacagaatgtaattcagggataaaatagagatttcaaactctcatgagcttaatactgggttttacttcataaattatatttgttctaagaatctacccacctgtcagctcaacgtgtctatctatggctctgtttgattttggggggcctgggggtgaaggtgcagaacaataacacaacagtaagcttcagtgtatgcagtagttgaaatgatttcattcctcagaccttgttaatcactaaggatcatcataaactgtgaaaaagactacaaaaactytgagtcaccaccaaaatgcacagacttgtatggctggcagagttttttttttttttaatacatcactatgtaaacaaagccagctactgttatgatgtctaagcaacagggcatgaactcctcctcacacaggttgggcccattcttttacacatcttttttttttttttttaagtgaagttgtcacagaagacataaatctacactaagttacacaaacatggaaaataagtatcaataccatgatgggaataaatggaaccatgtaataggatatgagtgaggtagctgatcttcagt

SEQ ID NO: 171668 - DNA, 601 bp, Human
taaaataatgtttgtgttgttgaagccaacagtaagtaattaatctaattagtaagcaatcacatatatatgattacttactaattagattaattatatactatatatacgattacatacatatatatgattacttattaagtaatgattacttagtaatcatatgtatatagatatacatatatgattcccacatttaagcagaggtacataattcaattaatcatgtgattaattgaattaattatgtaccttagcttaaatttgggaatttcccatgtacacagccaatttttaatcrtatgactatgatttagacagtcatcagtaagggacttttgttaataaaaacacataggaataaactgattactatctcagctcttagtcacagctcaaaatgcacctttgaccaaattaccaaacccattctttctctcaaatttccagatgaggtctgtaatcctactagcacacatcattcatcatggctaaatttataaattatgagattcaagtgaaggaataagatggtttcttcctccatggaaagaacaggatgaagcagtaaatgaatgtctaatatgttccaagtataagg

SEQ ID NO: 171669 - DNA, 601 bp, Human
gagttttgtaagagatgatatgtgggtatctgtgtctgagggcaggttatgcagtgagaggactgcagtcatctttataaaaactgcttatttctcaggatagcttcttagtcttctcaagccaagggctctactgcttcttaaatatagaaatatcattcagtcctacactagattcctgtcttcaggaatctatatcttaagtcccagtaaaaatcctttacaggccagaggtctcatttgtgaaagttctttttcctccctagattttgcttacataatttatatggtttttttttttcaaatcctcaaagacaagtatgcagaagtaagattggggctatatttccaggcaggttttagcatttaaattttcccttcttgtaggaagaataacccccacctcccaagatgtccacatcccaatccctgaaaaatgtgaatatgttaggtctcatggtatgacgtttaatattgagtgtcaacttgattgaattgaaggatgcaaagtattgttcttgggtgtatctttgagagtgttgccaaaggagattaacatttgagtcagtggactgggaagggcggacccaccctcaagctg

SEQ ID NO: 171670 - DNA, 601 bp, Human
atcctataaacatgtactataatgtgtcagctaaaaaatttaaaaagtaattattgtttttttccatgttatttcaagtagttatcaacccatgggacagcttggccacagataagatctcaggctttagagtagggcagctacgggtttgaattatgactcccgcacttatttagctcaatgttcttagtgacttatttaacctaagtttcagtttttctcatctgaaaaacaaagataatcacaattcagaactcacactcttgctgtaaggattaaatgacaatataaataaattgtmagtaattcaataaatgtttgctgtgactatgatgagatattggagctaaaagatgcatgagagctcatctaggacatcaaatagcttaaccaatattagatgcagttctcttaattcctagggtaggaattatgcactgtatcaaactcttgcacaaaaatgtggtctgtgcaattttaaacttggtgctagaggtctaaagagaaattaaatattataacttcttgagttttgtaagagatgatatgtgggtatctgtgtctgagggcaggttatgcagtgagaggactgcagtcatct

SEQ ID NO: 171671 - DNA, 601 bp, Human
tgttctgtagcacttggggtgaatagggttaatgataatttattgtgtattttcagaaagctagaagagcagagtttgaatgttcctcacacaaagaaatgataaatgtttgaggtgatagttatgctaattatcctaatttaatcattatgcattgtaaacacttatcaaaatattactctgtatcctataaacatgtactataatgtgtcagctaaaaaatttaaaaagtaattattgtttttttccatgttatttcaagtagttatcaacccatgggacagcttggccacagataagatctcaggctttagagtagggcagctacgggtttgaattatgactcccgcacttatttagctcaatgttcttagtgacttatttaacctaagtttcagtttttctcatctgaaaaacaaagataatcacaattcagaactcacactcttgctgtaaggattaaatgacaatataaataaattgtcagtaattcaataaatgtttgctgtgactatgatgagatattggagctaaaagatgcatgagagctcatctaggacatcaaatagcttaaccaatattagatgcagttctcttaatt

SEQ ID NO: 171672 - DNA, 601 bp, Human
tatcaaatcactagtgcagatgagcatgttgatttttttttttaagaaaaggctacagaaaaactactagataagaatttcttgaagtttctttggatctttccccacattaagcgtccataggaagaagagtaaatatttataacatagtatctcatccttgtataataattatattgacaaaggaacagaagcagagtttctagctagtgtttttgactagtattactgattattaaactatatcgaaggtatagtttaatgaaataaaaactatacccaaggaatgtcatcattcttyaattattccattcgtctttctctgaatttaccagaaagatatgcattcctccaaattgtttataaagtaaattcctaaaagcaagcctatattcccagtaaattattatatgcattagagacatgcttatacaaaatgttttttagcctcacagaggcaacagacaattttttttttcacttggaagcttccacttgccacaagtttgtcccatatactcatgttcatttcagagctagagacagagatactaatatagttagaaatacagacactccaaataaacacgttagaaataat

SEQ ID NO: 171673 - DNA, 601 bp, Human
gcagcccccaaaatcctcaacagtaatacttttatctatgttctaccttggattttgagttagatattacttgaattgtttccacagccaaacatgtttaacacttacttttctaaagaacttggcctttttagctaaactgtggacatctaaaagaaccttcagaaaggattattaaagctgtgttaattacaaaataaatattgacctccaggccactagaaatggtgccatttttaatggagaaagggaaaggaaaatgtaaggagtgactttttcttttgctttaaatcatgcttamttaccttagtaactaattttcaccttatagtattttagataatgtggaaaatttacttaagcttggcattctttgtaaacgttatttatgacatatatttatgtatatgattcccacatttaagcagagttgccaatcacagtatttatacttcaaggaaattctttctgtgtgtgaaattaacagatgtctcccatataaataggaattatcgacatgaataccagattaatgcctttaaattctgaatcctggaactaggtaattaactttttagccctgccgtcatgagaagagaga

SEQ ID NO: 171674 - DNA, 601 bp, Human
tagcctaaatgtattctaaggagatcatgcaaattttaataacttcagcccccaagaaggcaaatcaacctaggaaaatatttggaggctaaaaaaagggcatacttttttccttttctttaagagttcaaccgacttcttatatgaacaatgttttatagaaaatattccttgcaaattccactaaaattatgcttctcagaaatactcatttttgtggagagaaactaagagaggagaagaggtataggtaggctcagtatatctaatctcttacattttagagtttttctttcccccrtacaggttagatagagacaaattagttgatggcattagttaagtcgcttaaattctctggtttcttaatttccttgtggaaaaagaaagattttactctaatttatttcaaagattagttacagctctaacatttagggaagcttgagaatttataaagtattcagtttatagaggatcatacaaagcagcgtgatcaaacatgttagttttagacttgcaaatctgaaaaattttcaagtaagatctccagaggaaacactgtcatgttggctaatatcacaaaaactgattacaaagc

SEQ ID NO: 171675 - DNA, 601 bp, Human
tattttctatattattcaaccaatcagaaatagttagcctaaatgtattctaaggagatcatgcaaattttaataacttcagcccccaagaaggcaaatcaacctaggaaaatatttggaggctaaaaaaagggcatacttttttccttttctttaagagttcaaccgacttcttatatgaacaatgttttatagaaaatattccttgcaaattccactaaaattatgcttctcagaaatactcatttttgtggagagaaactaagagaggagaagaggtataggtaggctcagtatatcyaatctcttacattttagagtttttctttcccccatacaggttagatagagacaaattagttgatggcattagttaagtcgcttaaattctctggtttcttaatttccttgtggaaaaagaaagattttactctaatttatttcaaagattagttacagctctaacatttagggaagcttgagaatttataaagtattcagtttatagaggatcatacaaagcagcgtgatcaaacatgttagttttagacttgcaaatctgaaaaattttcaagtaagatctccagaggaaacactgtca

SEQ ID NO: 171676 - DNA, 601 bp, Human
acctgagacttcagctttcttttagacattaagccaaatatcactcaggcatacacttaccaccttcctctcttccatttttaaatcctcttccagtctttgtgtgtttgtatgtgtatatgtcattttgttccaacaaaatggaagagaggacggtggcaagtgtgtacctgagtgatatctggaagccattttgttgtcgtttcaaaaaagattaattattaacttccgaaaagggtaatgataaactcagggcctcaatttgcttaattagaaatttctgttgttacaaattattcayctgaatatctttttttgctaaggaatgcatttggattctattgtaatagcattgggcactgcatttttgggtgtaggagaaggacgacggttctgaaagatgaaaataaaagacatcaagacacattatgttttcctaagtgttgtaaagttcctgaatttttcctatttaccttcttctttctacttgagtggaagaaaggaaggaactctgccctgtatttctgctttgtgcttcactgctccaagatctgatgcagtctgaagataggtccaatggaactgttgttattgagtcggc

SEQ ID NO: 171677 - DNA, 601 bp, Human
ggccgggcacggtggctcacgcctgtaatcccagcactttgggaggctcacaaggtgggcagatcacgaggtcaggagttcgataccagcctggccaacatggtgaaaccccatctttattaaaaatacaaaaaaaattagccgggcatgttggtgcgcccctgtaatcccagctacttaggaggctgaggcaggagaatcacttgaaccgggaggtggaggttgcagtgagctgacatcatactactgctctacagcctgggtgacagagcgagactcagtctcaaaaaaaaaaaaaaaagtaaaaaaataacagatgctggcaaggttttggagaaaaaggaacatgtatacacagttgttgggaatgtaaattagttcagccatggtggaagacagtgtggagattcctcaaagacctaaagacagaaataccatttgatccagcaatcccattactgggaatatacccagaggaatataaatcattccattataaagacacatgcatgtgtatgttaattgcagcactattcacaatagcaaagacatggaatcaacctaaatgtccatcagtggtagactggataaagaaaatgtg

SEQ ID NO: 171678 - DNA, 601 bp, Human
aattttaaaaactagagctatagtattttgattgctaaaggatataatggcagttaaaaaaaaccacaaaatgatgatattcattcggtatataaaaaacaagtctccttctaacatttcaaaattctttcaaaagccttatcccattttattcacataatatagttgtatgcaaaagctaaaagtataaactatgcatccaacaaaggtctaatatctagcatctataagaaacataaatttacaggaaaaaaacacaaccccattaaaaagtgagcagaggacatgaacaggcatttcygaaaataagacacacatgaagccaacacgtatatgaaaaaaagctcaacatcactgatcattagagaaatgcaaatcaaaaccacaataagataccatttaacaccagtcagaatggctattattaaaaagccaagggccgggcacggtggctcacgcctgtaatcccagcactttgggaggctcacaaggtgggcagatcacgaggtcaggagttcgataccagcctggccaacatggtgaaaccccatctttattaaaaatacaaaaaaaattagccgggcatgttggtgcgcccctg

SEQ ID NO: 171679 - DNA, 601 bp, Human
aagactctttttcaaaacactaacaacattggaataaatttattctttaaacttgtccagtttcatgaaaggttcagtttgatacttgtatctaaaagtgtggcccaacaattcaatttaattcaacagctcttgatagactgtttcttattgcccaagaaaagcctcctagacacttctgtgaatataagaagtggaacacatctaaaaagctcacagttttgtcaacagatatagaaacagaataaaagaatttttaaaaaaacccaataaatgaacaaaacacagagtaatatcaaartatagaacgtaataggctagatgccatcagaaaagtagacacgaaaattgcagaagtctagaagaaaaaaagtatttgcagtgggaggaccacaaagctttcatggactagatgttatttaaaggcatatacagtttcaacaagtggataaggaaaacaatgtaaccaaagggttagaaacaagaatattgtaaagtttctaaccatatgatagcattacccagtgaggtaagaatgagggttaaggctggggcagtaggttaggaaaaagttttaaagccctaaactaagagtttagac

SEQ ID NO: 171680 - DNA, 601 bp, Human
gttggccaggttggtctcgaactcctgacctcaagtgatccacccaccttggccttccaaaatgctgggattacaggcatgagccaccgcacccggccatgattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttcttttwgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaa

SEQ ID NO: 171681 - DNA, 601 bp, Human
attacaggcatgagccaccgcacccggccatgattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagcyagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagattt

SEQ ID NO: 171682 - DNA, 601 bp, Human
ccatgaacatttgtgtacaaatttttgcgtggacatttattttcactcttcttgggcatatatctaggaaagagattgttgggtcatatggtaactctttgtttaacctttcaaggaactgtctgactgttttccaaggcagctgcactattttacattcccacctgcaatgtaggaaggagggttacagtgtctcttataccctcactgatactcgttattacctatctttttaatcttagccatcctggtggatgtggagtggtaactcattatagctttgatttgcatttctctaatractaatctaatatcttgacatatgttctttcagatgctttttctgtgcacatatttacaggtaatacttttcttccccacactggaacatatagatctatgtcaatcagcttaattctgcaacattattcttaattggctgcgtagtatttctctgaatggaatggatgtaccataatttgaccactcaatcatttagatattgaggctgtttttatttttttttattttttcactacacagatatgtttttattttcattataaaaattataacaatgtaatgaactttcttgttgcta

SEQ ID NO: 171683 - DNA, 601 bp, Human
agcacagtcttcccagcagtttcttgtgctttccaatctctattcaaacgtgtgaggctgcataaagatcgcttctcagagaagcctagataatagaaaacctatgctgaaattacagaaatctgatgtaatattgacatgaaaaagtcagtatcagaataggctttcttttgtgtgagcatcttattgctaccaagtgaagcagccatagcttactgtgtggggcccatcagtttatgcttggtcattaaaatgggccttacagttcaaaggagttgtcctgtgctgatcagtaatgcgcgtttccttggcactgacattaaaagaatgttggcttcatcaaaggaattggcagtggctacattatcatcgtcttcatcaaaggacattttttaaaaccattagaactgggctgttcaggagatctattatataacatggtgactatagttaataacaacatattatatacttgaaaatggctaagagagtagatttgaaatgttctcaccacaaaaaaatgataagtatgtaaggtaatggatatgttaattagcttgatgtagccattccacaatgtatacatacgtcagaacatcat

SEQ ID NO: 171684 - DNA, 601 bp, Human
cccttcctcctggattcaagcgattctcctgactcagtctcctgggtggctgggattacaggtgtgcaccaccacgcctggctaatttttgtatttttagtagagacagggtttcactatgttgaccaggctgttctcgaactcctgacctcaggtgatccacctgcctgggcctcccaaagtgctgggattacaggcattagccaccacacctggccctgacccttgttatcaggtagtcaacctgggaatcagttcttgaaatgtatgtctgaaattgacaagctgcatttttttttttggcaaaagcaacatttctgaaacccctgataaggaacattcagctttcacacgttctgaatctcagaggagcttgcagggtcttccctgctgtacttaccattgcagggggcaacaaggcagtggtaagtggaaacaaaccaaaacttcagtgataaggctgctgaaatcaagccctgtgttttttgtttgtttatttgtttgttttattttgagacagagtctggctctgttgctcaggttagagtgcagtagcactgtcttggctcactgcaacctttgcttcccaggctcaagcaat

SEQ ID NO: 171685 - DNA, 601 bp, Human
cccaaaatgttgggattacaggtgtgagccaccacgcctggccttatttccactttagccacccagagtttaactcactttcttgtgtggcctcccaagacctgttgtacagagtggttattcctgtggtaactttggggggtggaggagggctcagcagggatttccacttcttggccccaggtatgcataatttgccctttcatttattcatcctccaaactgtcacacctaacataatccagccatcccacaccaagctgcacacccattccccctcctcagtggcagacagccccarttcacttagcccctgtttactcatgaactcccagtggccttgtcatagggccacagttctccaggcccaggtacctgtggttcaggtggcttgtcaccatctggaccctctgggctgaaataattctaaccactcccaaacagtgacctttgcatccccggctagggcagataccacccttgaggcttatgttttcctggccgatttatactctgatattaatttcctagttccagaggtagaattaaaagcactcttcttcctcagacttcaggctttgcacagagtagactcggtagg

SEQ ID NO: 171686 - DNA, 601 bp, Human
caagaagagagccctcaccagaaaccaatctcagacttccagcttccagaaccataagaaataaatttctgttgttcaagccctctagtctatggtattttgttatagtagtctgagcagagtaaggcacatggcctccactttacaagatcaacaagtgctgtgttgaaactgaacagatggggccaggaagaaactgggaggccaggcaggggtgtactgcactagtccagacaagagaggatacaagcttgggtctgagtctcaaagagggattcagagctgaatggaataaacttgytgatgcaaacacatacctttaactcaccaaactggggttcttcagaatagaggcctgcaactccattcggctgtttacttttttcaggagccaatgaactggacatttttatgtatttatttactttttttttttgctttctgtggtggtttggcaggtgcttttgttcctcagccaaacgtgttgtagttcccagaaatggtggtttcttacaccatagtggcaaattatacgtaatagagaaaatgcgttttgttttctggaactcatttgggttgtgacattttactttaggggcca

SEQ ID NO: 171687 - DNA, 601 bp, Human
tccatcactcaggaatgaattctgtgaagttatgacatcctgagaggcatttggacacaggctgtagtgttgaattgtcttcagtgccttcatgattgattataacgttcagtgtgttttttggcctgagttacttctgccaaagtagagataaatgagaacgcagtagacttcagctgcttttagtatgggcagttttccggattacttggtcatttctatgtgatcgtctttgccaagtgtgacacttcgtgacttatggaggttacctccaaagaaaacttattacatccttttccarttctgctgagattagaaattgaggagcttttgattagatgtctttaaaaaaaaatgctttcctcatgaaagctgaactgtaaagaatgtttgagactttctgtcttaaaatttggacctaacagctttaatgggagtttatggcttaggttaatgaagtgctttttctctggagggaaggaatgagctgccactggggagaagtactccctaattgggccactcgaatgtatgaaacatatttgggagactgaaggtttgagttaaggaagggtgaatggctttgtttctgccagtaatt

SEQ ID NO: 171688 - DNA, 601 bp, Human
ttggaaatactgaatccaaagggatgtgaaaaaatgttttagggtgatggaaatgttctgtatcttgatggtgaagatagttacatgggtgtgtgtttttcaagattgattgaactgtaaacttaaaatggttgcactttggaggaaaaggagagtgtgcagaagagcaggcagagccaagaggtttttgtgtttataggcaaaggaggagttgaagatccttggagacaggatctagatgtgagtgtgaaaaatctatgagtgtgaagacaaaagcattgtccctttatagagatgtgawgggaagggtggagctgggcaaatgtagaagacaaagggtaggaagtttcagcaagctcactcagtctcccttaatatcccctatgacacagaaggcagagtcatttgtggagagacagggaccttgaggcaaggagtagtttgaaatatcagctacaggggtgagaacagaagccagccaggatctcctagtggcaggggcctagctggccacaccatggagataccacgtatcatggtatctccactaatgatcgcagtgttttctacagctgtgctcagaaggctgggtggaggaaca

SEQ ID NO: 171689 - DNA, 601 bp, Human
gcaaaggtcctgaggcatgggcaggcctggcagtgcttgttgaatacttggaggccggcatggctggaatggagtgtgtgggaaatagtgggagattgttaaagggtgacaggttgaaagggagggactgcttgggatttatgaaccactgtgtaaacactggccttcactgagtgagatggggaaccaccaaaggattttgagtcacagagaagcttaatctgatttatgcctttaaaaggatcactcttctcagtgtcaaggcattgacttatagtcttgacaaacatttaatccacayagagatgccccatgaggttgatgttatctctattttttttttccttactgatgaggaaattgaggctccacgagcttaagtaactttgccaaggtcactcagctggtgattggcagagccaggatttatgccttggtttgtctgattccaaagtccacacagattaagagaggagggaaggcttgagagacaaagggttcctatggtgttgaagggaatgggaacaggacacagaattatggttggcatcgaaacagaccacagagtttggcaactgatagcatgtgttagggagaaata

SEQ ID NO: 171690 - DNA, 601 bp, Human
aggcttgagagacaaagggttcctatggtgttgaagggaatgggaacaggacacagaattatggttggcatcgaaacagaccacagagtttggcaactgatagcatgtgttagggagaaatagacatcaacagtgtcgtttgagtcatggctttcttctaggagaatggtggtactgttaataaaatacggtagtcaggagtagaagccagtctcaggcaaaagacagagggcgtgacttgggcaagcagaggctgaggcgttggtgggaagtagtgggcgtgtccagttgatccagagaraggacccgggagaggggagcctagaaccccactgtggttagggtggaagttatagagaggcatgtgctctctgagtgagaagaaaggctgaagggagaagctggcaatgttcctccctgtgtggaggagggagtggggacaaaaattcactgcttttggggacagaaatgtttaaaactttacccttatgaacttggacaaaggaaagatgtggacgtctgttttgttatttgagcttaaagaagtgatttagattagcctagcaatgagcatcttgtgacctcacccaggatgtcagtt

SEQ ID NO: 171691 - DNA, 601 bp, Human
ttagcatttttgatctttccatctaattaggtacattgaagcctttccccatagttgcattaatactctatgtacaatgttatcttttctcctgaacataatagcataggtttgtatatgtcttaaaattttattagccctcttagaagccttaattttttgccaagtggacattctataacttaaccatattattgggtaggtcatttgtaatgctgctacgtacacatctttgtacaaaaaccattttctatagtttatattgtctttaaattagattttatagaaatgcaatgggggkgccaaagggaatgaacacttggaggctctagaattgccgctccaaagaggtgtgtccatttactggccaatcaaagtcagttcttaaacccattttacttttcctaatgggaatatgtagagctactccaggcatcggacaaggtaatgattaaggttttagaagtctttgaggtgtcagatagtgatgctctgaccccttgtccacggtgtgtggtgactggttcttcgttctgcatccatcccccaagttatatgcaagtttcttgaaagcagttctgttctggtctcagttctctat

SEQ ID NO: 171692 - DNA, 601 bp, Human
ttgcaacacaaaggagagctgtatttatcttgaaatcatagtagcaataatagcccgtatttatacagcagctttctttttgaggaactgaaagtgcttattgcctattcatgcctcgaggagctttatgtgtatttctgggtctcaagtgcaggccagacttttaaggttttgctcaggacactgagactcttgcttccttccacaccttcagaatgaggaactcccagcctaggaatttggaggaaacgatcggcacagatttttctctctgtgggccgtgacctgggaacatctgatratcttctgaccatccatgtcactgtgtcctatctggtcttccagcttttgccagcaattcatcacttatagtctgcttaggatattgtcttcttatcatctttgtgctgtggcctcttaggcgagttcattaaacatatttaagagcatggtagttgcccaatctacccattaaagtaataactgagttatgtaaactctagtggttcttgaagtaaccagctatgtcatgctagatggaaaaggttcgtggtcctagctctgttctcctctaccttcagatcatattcatattatgatt

SEQ ID NO: 171693 - DNA, 601 bp, Human
agcttctaactgtagtgactgcttaggatttatgtgtttaccttttccattaagtaaattcttacagtggccccagcttcatccagatataaaaattgcgtcattctcaggtgaaattgtggtgttcgaaggagctgggatatgcatgaggtggaatgtgtgtgcataggtgtgtaaatccattgcctccattatctattgctgcatgacaaaccaccccaacttagcattttattgttaatgattctgtagggaattcaggaaggactcaacaagaacccatcatctttattccacatgyttggttggcctcactcatgtatctgagacttcagttcagttccgtgtgacctttctccatacagatagcctggactcttgatatggcagcgggctccctcttgagtaaaaatgggtgttacagtgcctcctaaggtctgggctcaaaagttccagaaccttccttccactgcagtctgttggtcaaagcaagtctcaaggccagctgagaatcaagggtagagatatagactcggcttcttgatgggaagagtaacatgcattacaggaatgggaagaattggtggtagtgacctttaga

SEQ ID NO: 171694 - DNA, 601 bp, Human
atcgctggagtgaaagtgtgttgtagagagtcatctgaggggcctcggcggtggtagtaagcactcagtctcctctatggccactgggcgtagtcctttctgcaggcatcatgggcatcgtctagtccagccctgcgattttgctgaggcttgccattaggtggcttgtccatgtttctgcagtgagtgacagctgggatgaagtcctgtggtcctgttcccagggcagtgcccctagcttcacacccctactgcgttcctccatgtctggggggttaatgtggtcatccctgcgggtggyatttggggtgatgattactcccttctgtgggatctggaaattcaatgactctggaatgcatgtatctgtttttctcctaggcccactctgtatgttgggaaatactctaccagcctctatgcctctccctcaatggtacacgagggggttgctgtcgtggtaagtccactacggagggctcgcagctgcctaaccacttctgttccattttagcaaagaatgactttgctatgcatgagcatcctgcaggttaagaatgaaaaacacaaatcttaagttctcaaaaacagtttctgcaca

SEQ ID NO: 171695 - DNA, 601 bp, Human
tcaggccgggagtggtggctcacgcctgtaatcccagcactttgagaggccgaggtgggctgatcacgaggtcaggagatagagaccatcctgcctaacacggtgaaaccccatttctactaaaaatacaaaaaattagccaggcgcggtggcggccgcctgtagtcccagctactcccgaggctgagacaggagaatggtgtgaacccgggaggcggagcttgcagtgagcccagatggcgccactgcactccagcctgggtgacacagggagactccgtctcaaaaagaaaaaaaaaaagaagtttcttccaatttttttcacatgcttccaaccttatcatcgatccttttaaacttaggaatggaaagttaggaatggaaatgacaaatagaatcctagctgctagtagatctaagtggttatatcaatttcttaagtcataaagtcattgtcaggcaacagcgtggagctgagcagtctacagtggttagttagttcttttctaaatagttcaaaggaataggacccatttctgtgtggccttaaaaggtatgtggctggattaaagtttgtgagactttattaaatcaaaggaga

SEQ ID NO: 171696 - DNA, 601 bp, Human
ttttcacatgcttccaaccttatcatcgatccttttaaacttaggaatggaaagttaggaatggaaatgacaaatagaatcctagctgctagtagatctaagtggttatatcaatttcttaagtcataaagtcattgtcaggcaacagcgtggagctgagcagtctacagtggttagttagttcttttctaaatagttcaaaggaataggacccatttctgtgtggccttaaaaggtatgtggctggattaaagtttgtgagactttattaaatcaaaggagaagttttggaccttggacsctgttgaactgctacacactgctctttgatttttttaaagcacttttgaaaagctctccgcaaaagtgcataaataagtgtgcagcttgattacttttcacaaaataacaaacctatgtaaccagcatccagatgaggaaacagagcattcctgtttacttttaaagtgtgggaatcttcaggtttcagttatttttggcttaataagaaagacaatgcacaaaacctataacgaatctcatgctactcttaaatttccttgtgtaatcaatactaaaattctatattcaacatttgata

SEQ ID NO: 171697 - DNA, 601 bp, Human
ccagagttcatgttcaaactgtggatcctgtctttctccagcacctaatcatgattcttaaagttagagagctctcactttacttttctaagttattttaagcttcataataaaatctgcagatgaaatcatgttttattaatttaaagaaacttttctcacattttgtaaagcaaacatttaaaatgtgctggttggcatttgagagacctccctgggaatggcggagataatgggtcttaaaagcaaaaacaagtaagccaaaattgcgtttaccagatgatcactttaaaataaaaaygatataaagaaaacataaagaatgactttctaactgccaaatgcaataagtcattgaaagtcaagggatgtcagtgatataacattaattatgagccaaccactgagtatttagagtgaagtcaagcacagaagaaatctttaaagaaaacacaaatgtcccttctattggttttcactggttacttccatactggaaacacgaaggactgtccataaaactgtttccaaaggctttaccaacttgatcttccttcagatgtatgagcttttgctcataaatgatacaggcagaatttca

SEQ ID NO: 171698 - DNA, 601 bp, Human
acaagtaagccaaaattgcgtttaccagatgatcactttaaaataaaaacgatataaagaaaacataaagaatgactttctaactgccaaatgcaataagtcattgaaagtcaagggatgtcagtgatataacattaattatgagccaaccactgagtatttagagtgaagtcaagcacagaagaaatctttaaagaaaacacaaatgtcccttctattggttttcactggttacttccatactggaaacacgaaggactgtccataaaactgtttccaaaggctttaccaacttgatctyccttcagatgtatgagcttttgctcataaatgatacaggcagaatttcatacttatctctttggtatgaaattccctagtcagcaaggttaatcagagtccttttattaatcagggtaatgcactttaagtacttcgtttatggcccatagccactgattccttggttggtagtcatatttttaattaaaataaccaatgaatgatttcacttaaaaaactttctggcaggtactctgtttcctttactaagtagcaacttatatcccaatattgtgaaagctcttatttccactctctg

SEQ ID NO: 171699 - DNA, 601 bp, Human
cagagtccttttattaatcagggtaatgcactttaagtacttcgtttatggcccatagccactgattccttggttggtagtcatatttttaattaaaataaccaatgaatgatttcacttaaaaaactttctggcaggtactctgtttcctttactaagtagcaacttatatcccaatattgtgaaagctcttatttccactctctgaatgaataatttctttatcacctaattttcctctttgccagaaattcactctcctgctttcccatttccatcctagggttcttttcctttcttygatgttcaaacttttttcttttacattttacacttcaaacttgcttttatccccccttcccaggggaactttgagttatctggaaaatattagctattaaaaaatagccaagaattgtgcttcagtctgtaatccttcaggactgtgtaaatacatggacacaggcagagcaaatgtctgctaatccagccacgagcagtgtgtgtaacctttggctgtaataacagaggcttctcatgtgtggggttcttttgactcagataacattatagttgataactgttgcagagcccaggctta

SEQ ID NO: 171700 - DNA, 601 bp, Human
tggttccccggttctccctcacctctgtcctttgtgaagtctaaacacatagtaaaagggcagcctgaagtctgcagaggtgagcagaggggggcttttgaaagacaaatactaggaataaatcacattctaggtttcgaagccctggaaaaattttgctgtgggaagaagggagtgtgtaaaaaatgaatctgcctcatcagttaattgtgtttctagcatgctgtggtcattggtggttatattttgggggacaaattctgatctcttgacatatcagcatcagcagaagattgtgaayaggcacagcctcatctgtagtttttgaagatagctttacctggggtttggtcctccatgacagtaagtgtatttacttccacacttgctacacagtgacctgtaggcccagcctcattttaaagtgatgattgtacgctgatggcccttttgccaggggctgctcttttctctgctcaaagcagcagactttcctgatatgctcagggctgaattattcaaaaatccctagccccacattaccaccaaagttttgcaacacagcttccagatacacttcagtataccctaagctatagcc

SEQ ID NO: 171701 - DNA, 601 bp, Human
gcctcatcagttaattgtgtttctagcatgctgtggtcattggtggttatattttgggggacaaattctgatctcttgacatatcagcatcagcagaagattgtgaataggcacagcctcatctgtagtttttgaagatagctttacctggggtttggtcctccatgacagtaagtgtatttacttccacacttgctacacagtgacctgtaggcccagcctcattttaaagtgatgattgtacgctgatggcccttttgccaggggctgctcttttctctgctcaaagcagcagactttyctgatatgctcagggctgaattattcaaaaatccctagccccacattaccaccaaagttttgcaacacagcttccagatacacttcagtataccctaagctatagcctgcaaactgtcctcttgccatttctccacttcagctccccagaggcagcagctaaggtgtcttgttaccacctacctacacacattcctatcttaggagaggtgagttgtaaccacaactccattctgggagttggctgaattccaggaccttgtagtctgtgagcctgattgaccagataatgtttatgatt

SEQ ID NO: 171702 - DNA, 601 bp, Human
aaagtccatataatccaacaccatctcttcccagtgtctggaatctcaaagtaatatattagaatttaattctattagctgaatatagattcttctataaattcagataatcctcagagtgatcatactttaaacaatcctcagtccattagaccttaatgtgaaataactggatttctttttaaagaggagatttggataaagggaaaggtgggagagagagaaagcaagatggctctagaattctgaatggagtaaaaaagagatgaaagtgtgtgtgtgtgtgtgtgtgtgtgtgtgtatgtgtgtgtgtgtgtatagctaggttggaggatacattacagaaagacagacaaactttgggttgagttcattcattcctgtgggattaatcactgtgcacaaccttgtaaatagcttctttaaattaaattattttttcccctctggacagagagacaatagcttattttgattttatttatttttgttaaaaagcaatacatgcacaggatactaaatttagaagttgccaaggaggtaacttggtatgttacctccttgtaacaagaacaagtgcatttctgtcctgatcccccaa

SEQ ID NO: 171703 - DNA, 601 bp, Human
tatagaaaaaagaccagctcagcgtatagaagtcagagatcagtgggagaaaagagagagagagaggcagagagagagaatgcacatttccaaaaaccaatgggaaaaattattgaagatctcagttctaggcacatctatgcttcccctgcccaatcatttatgtatggcttgtagacatagttaattatgcaacatatcttattttcctgtttattttggctgctaggaaattcaaaggcaaatttgcaatgccattctagtgtataggatacagtttatattttgtgtatgtatttgycttacttttgacatttttattttcctacttttttattttgcccttattttctaaatcgtttaaaaaatctttaagtgtgtgaaagttgagagttgccttaaattcgtctttggaaagcgatattgcataaatcaacaggcaggcaaataaaatcttggagtgataatttttttaaaaagattaaatatattcatatgttggattgacaacaactataggaaaaaagattttggatagaataaaaattataagcttgcaactgacagccttggaatcattcaagacaaactctcaatgatt

SEQ ID NO: 171704 - DNA, 601 bp, Human
ataggcagatagtgatgccattttttgaggtaaagaaacttgaggaagaggcacctatgtagggataatcattaaatccattttttaaaaagtcagtttatggaggtataattttcactcagcaaaattaacagtacaatttaacattttgagaaatattgtttttgtgaaactatcatgccaatcatcttaaaaagtttcctgatgccctttgtagttagtcctctccccctctacatctacagacaaccactgatgttttctgtccctataattttgcctgttttcagaatgtcatatwcattaaaatataaaatatgtaggcttctgagtctggtttctctcacttagcataatacatttgagatccatccatatggttgcatggaccaataaattagacctttttattgctgagtagtattccattgtatacacataacaaaattgatctaccccccagtagagggacatttggaatgtccttaggttttgtcagttttcaaagaaaggctgatataaacatttgcatacaggtttttatgtggactttttatttctcttatataaatacctaggagtgggatgatggctatgtggt

SEQ ID NO: 171705 - DNA, 601 bp, Human
tattgtttttgtgaaactatcatgccaatcatcttaaaaagtttcctgatgccctttgtagttagtcctctccccctctacatctacagacaaccactgatgttttctgtccctataattttgcctgttttcagaatgtcatatacattaaaatataaaatatgtaggcttctgagtctggtttctctcacttagcataatacatttgagatccatccatatggttgcatggaccaataaattagacctttttattgctgagtagtattccattgtatacacataacaaaattgatctacyccccagtagagggacatttggaatgtccttaggttttgtcagttttcaaagaaaggctgatataaacatttgcatacaggtttttatgtggactttttatttctcttatataaatacctaggagtgggatgatggctatgtggtaaatttataagaaactgcaacactgttttccaaagtagttctgtcatttcgtatttctatcagcaatgtatgagaattccagttgcttggcagaacttgataatgtgagataaaaaaaattaggctgggcacggtggctcacacctataatatcag

SEQ ID NO: 171706 - DNA, 601 bp, Human
aaacatattagaatagctaacatattggctaacattctaaatgtccctctactggggggtagatcattagaatgttagccattctaaatatgtttgtaatggtatctcattgttttaatttgaatttctctgatgactaaggatgttgaacatgttttcatgtattgatttgccatctgtatattatttactttggtgaaatgtctgtaacttttactcctttaaagaaatgggttgcctgtattcttattgatttgagagagttcttgatatatattccgaatactagtcatttatcagwtacatagtttgcacgtatttctcttcattctgtggcttttcttttcattttcctaacagtatctttcaaagagaagaagtatttagttctgataaattcaatttaccaatttttttcctcctagcaaaaaatttgtttcatatgtttatttctagaggttttgtcatttcagattttacttttaggtgtaggattcattttgagttaatttttttatatggtataagttatgggttaggttcgtctttttttatatggatgcccagttgtttcaacaccatttgttgaaaagaatattct

SEQ ID NO: 171707 - DNA, 601 bp, Human
tcccacctcagcctcccaagtagctgagactacaggcacatgggccgtgcctggctaatttttaaaaaattatttttagtagagacagggtcttgctattttgatgaggctagtctccaactcctggcctcaagtgatcctcctgcctaggcctacaaagtgctggaattataggtgtgaggcattgtacctggtcagacaatagttttaatcttttctgaaatatttaaactcagtgggtattttatcaatgttattttcttgaaaaagttccttctggagtcttcagacctgctccaaygagtttcaggttgatgtgcatctggtgaaccactgtcatcctgggattcccattccctatcatcccagggacacccttttcctctctcctgttttctggaccacaagtcttcctaaatcttggtgtgttgcctgtttgggttagatatgtcctctggtacatttctgagaaagggtgcatgagaccatacatgcaccccagtgcatgaattctacccccgacttagagtagaattctagattcataaacattttcttttagcatggtgaaggcattgccccattgccttctagtttccag

SEQ ID NO: 171708 - DNA, 601 bp, Human
tttctatatgctctctttcttgaattactattatttggatatcgaacctccctggactgtttctctaattatcttgtattgtctcgtctctcctattttatgttttttattctctacttgctgggagatcttttctaggttgtttttctctgtttttattgtctctgtcaactatattagaggttttcctcagatgtcttataatccttggctgtctgcctatatttaagatccgagtcactaaaagctgatttggaatctaattatctacgtagaggttttttgtttgtttgtttgtttktttgctgcagggtatctggctgcacctttcatctgaggaatctctgacatagtctcttatgaatttttttttccttgagattggtcagattctccgaaaaaaaatctaactggctttttttctagagagtcaagacctaaatgccattattccaggtgctaagttaggggaaaaggctggggatgcaaatacagcatatctgctatctagaatgctctgctcctcttctttgccgagcaaacttctactcctgtgcgaagtcttagttcagacttcacttctgaggatcagtcttcctta

SEQ ID NO: 171709 - DNA, 601 bp, Human
gtgctaaaatcttaagaaacagatgggaagataattatattcgggaaggagattaggtggtatagctgaaaaagcaaagccctaaagaagtaggggtgttctttttatttatctttccacgagaattagggagtaattggaaggagcaatggggagtcagatatatgaaaaagaacacccagctatataccacaggccagagttaagcatcccacatccgttgtttgagcttggaacacagcaaagctagtttggttgccatggtgaccaacgccatgtctccgggctcattaatcctctrttccaaactaagcacttagcaatagcttctgaataaatgcaacaaagctctgcatactgaaaagggcacattcatgttaagcagaggaaaagggttttcaatttcattcattaaacttgagtaaataatttaatatctttgtgcgtcagtcctcctagctaatgaataaggataaatgcttaatggaaaatctagcttaataaagttaacagcattggcactacatataaaggaaattgatgttgccggtatacatgcatatgaaggggaaaactgaaaggaaaataatatatattaagc

SEQ ID NO: 171710 - DNA, 601 bp, Human
tttttctttttttctccaaacactaattgttttggtctcacctatacgacaattttaggtcaattttctcaagtttgggttgcttactgcagccaggtgattcccaagtgcttcagaggaaaagtagtaatcacagccttctttcccacctgttagcattacaggtttccttctctgacccactctctttaaattctacaatcaaaaaccatatgtgtcttctgttttgagttttcagtctggatgtgttatctttgttttataactggaagcatctgaaaccggaaattgaaggatgaartttccttaggcctgtacttctttatttattttctatcagcactttaatttgtttcttacttaggggagcctggagcttattatcctctgaacattttaaatacccatttagcaaaagatatcagacttacaaacagaaatgcaagtgttttctttgtcatctctgtaagtaataacttatggaacataatataaacaattttagaaggtttttccattaagctaaccaagaaaacatacaaataggggaaatgatgaaagctcagaattggatgctaagaatcaagcacatgccagcttc

SEQ ID NO: 171711 - DNA, 601 bp, Human
cctcagcaacactcttgaattaagagggccacaccaaccaaagacctgggtggtaagagtaggaagtacgtgcacttctcgcaagcatagttgaattaacctgggtgggggcaggaggaagagccgtgaagaaagatcggcttggacttaataattaataataaccctgtaatcacagctacttgggaggctgaggcaggagaatctcttgaacctgggaggccgagggtgcggtgagccgagattgcgccattgcactccagcctgggcaacaagagcaaaactccgtctcaaaaaaaawaaataaataaataaaaataacaacagctggatatggcatttattttgcatgcttggcactttgtctatgctttcactaatcctcacaactatcctatgaggttaagatttgcagattaaaacactgagcttgagacaaattgcttaatagtgaaatcaggttttgactgcagtgacctcaatacagagctctcgttttgtccactaggtggtgctgccttccctttgctactttagagtcctgccgctaatgtaaattagtctcgggactgccttgggtgactttgctgtttttgcctta

SEQ ID NO: 171712 - DNA, 601 bp, Human
gggtgactttgctgtttttgccttattctgtggatctcatctccactgtagactgtatatgtcagtcagcaaacctgccactccctcagcttcttctataactgccttgctcccagcccctgatgaaggggaagcacaggttgctatcttctgtaacacttgatcctcccatgctgtagcctattagaccaggggtggtgttcaaccaagggctggccaggaggctcgaacatggcttgatatgaaaagaggaactcaaggacagtgcttaaaagtgaaggttctggagtaagacggactsggttcagaccttgactattccattcatgagggcaaaatttaacttctttgaatcttagccctcacctaccaaatggggctacggataattcaagttgattctagggaactccagcaaggctttatggattatgtaaggctcttttcccccatccctggacctgtgaaagtatctttatgttgtctagaaatgcgtttcccaaagtccactgtattaagcaatgatgctggagctgttaataggtgtttcaaaaagagaattccttggaaaaataagtcctggaaaatccatgttaaactg

SEQ ID NO: 171713 - DNA, 601 bp, Human
tctcaagctttccatgtccagaaagaaagtgtttcctatccctgtgttaatgatcatttgcatggtttgttcttgtagaaatgtctgtttatatactttatccatttttaaattgggttatttggctttttctattgagttgtaatagttctattttttttgttgttattgttggagacaggttctcactctgttgcccaggctgaggtgcagtggagccatcatagctcactgtaacctcaaattcctgggctcaggcaatcctcctgcctcagactccccaaatgctgggactacagaygttagccaccatgccaggtctagttttaatagttctttatgtattctagacacgagtcttttatcatatatatgatgatagaatttggggacctgtctgttcacagataaagagaaaatagtagttttgatttctccaggaagttatgtataataggaagtgcaaggagcaaatgatgatgcccaaagtgaggcaaaaatttagggagtgagaagaaaggaaatcacagaaaaatcatcacagactttgttttcagagagggagaagaaagcacacccaaggaaactgaaaaaaaaaaag

SEQ ID NO: 171714 - DNA, 601 bp, Human
tggactgaggagtgtatcggtggtgagacagtggatgtggaaaacagagaccaccctttcaaggagttcaaacaaaaagcaatagaaagaaattggaggttagctaaaagggagaaaagagttgcaaaagcttaagtatgcttagaaaatgagggcaaagagtccatgggaatggagatgttgggtaaataatagagataaattacttgtggagcaatgttctactgctgggtgtatgatcaattgcaaagaggaaggtgttggtcttaaattggaggagagaccctacttcccctaaaargatagagagaaggtaaagatgctgaattagtcagcatttctgtttgttttaccaaaacccacagaaactcaattcagcaatggtagaaataactagttttcaccaatatcttgttctcttccactccaggctcatggaagaccacgctttctagtccacttgaagttcagcaggcatatgactcttctagctaatgacatatgaacaaaagaaataagagtggcttccaggcttagacaatgaaaagtccatgaggaatttttaaagtcttcttctccccatgatattgtgatagtgggg

SEQ ID NO: 171715 - DNA, 601 bp, Human
ccttgattctgaattgccccttggaactgcagtgcactatgtgacagtgagaaataaccttctgttgctctaagccactgaaatatgagtgtctttacaacagcataattaagtttattctgactaaatcctaacctaaggaaaaaaattagactatattggcactcaagaaagagttgaatgacctagatacctagataagggtaagatagagattaaactgggtaactggaaccactaactcaaactgagtccaacaagatgatgtacaaatctttaacagggattccactgcaggaaygaccaatgagattttttatcattgccacacaatttgacccagaaggtttagaattgtaagtgcaagtgtgttggatgggccatccacaaaggttttgcagggtgacttcaggacagagataaaaggaagacttgagccagacacctgtgccttcagggaaaatgggagagtcactgggagttagtaagattatagataagaagaaataaagagtaatttcacgggatgacataaatcttaaagaatgaggtgcacaggtgaggaattaatggttcttgttgctctagaagaaggtagttc

SEQ ID NO: 171716 - DNA, 601 bp, Human
gatatcactctgcaaccaagaaattggctaaaattaaatagacggaaaataccaatgttgataaggatgtaatacaatgagaaaccctcacccatggcttatcggagtgtaagctggtacaactgcttatttgacagtacttaatgaagttgaagatatgcatacccagtgacccagcaattccactcatagatgtagagcccagagaaatccctgcacgtgagcaccagagtacaagaatgtgcaagaatgcccatggcatcagtgcttgggatagcctgacacgggcaatgcccatctrcagttgaatggataaattgtggattactcgtgctaaaagacagacataataaaatgaacaaatgagaactaaacagcacaagacagattattttcaccaatacaatattgagtgaaagaagcaagtcaaaagaatttgtgtttatgattccatttattcaaagttcaaaaattggaaaatggaaggattttctggggctaagagtgtctaatttcttgaccaaggatgtgattagaaggtgatggctttacaataattaaaaaaaactgtacatatatattttatatactatgtaacgta

SEQ ID NO: 171717 - DNA, 601 bp, Human
gcttgggatagcctgacacgggcaatgcccatctacagttgaatggataaattgtggattactcgtgctaaaagacagacataataaaatgaacaaatgagaactaaacagcacaagacagattattttcaccaatacaatattgagtgaaagaagcaagtcaaaagaatttgtgtttatgattccatttattcaaagttcaaaaattggaaaatggaaggattttctggggctaagagtgtctaatttcttgaccaaggatgtgattagaaggtgatggctttacaataattaaaaaaaactgtacatatatattttatatactatgtaacgtatgttatgtgttatgggtcgaattgtgcgccaccccccaaaacacacacacacaaagatacgttcaagttccaacctccaatacctcagcacgtgaatttatttggaaataaggttgctgcagatgtaattacttaagttatgttaaaatcatactagagtaaggttgttccctattgcagtatgactggtgttcttataagatgaccatgtggagacacaaatgagacagccaagtataatcgggtccccagagaccctctaacca

SEQ ID NO: 171718 - DNA, 601 bp, Human
tgtataggatattgagcatgcttgtaggagttttggctttctcaaatatgttccatatgatcaggagatgccataaataagggcataaaggaacaatacatggtaaacggattttttttaaagctaacaaaatgcaatgttatctttctagtactttctggttttcatatagtaaaagagagtaaactacagaaaaattttccttcagaaaagtaatatgaggtggaatagaacagtgataaggaatttcgaagccagtctgtctgttttcaaaccttggttcaacaatgaggaaggggtycccagtgggagagagccccaggtggggaagaacaatgaacagttgttctgagaaatgggaaatcacaagcaatgacttcttcctggcacaatgaccttgttctgtgcgcacaatgacctccttcagcacagcagctccccccagcacaactctataaaacttcgctccagttgcaccctgcctctacacagccccttctctgctgtgctgccggttgcaactttgcaacgcattttcatacatactttctctaataaatctgcctttctttacctacaactgtcttggtaaattacttta

SEQ ID NO: 171719 - DNA, 601 bp, Human
tcgaagccagtctgtctgttttcaaaccttggttcaacaatgaggaaggggtccccagtgggagagagccccaggtggggaagaacaatgaacagttgttctgagaaatgggaaatcacaagcaatgacttcttcctggcacaatgaccttgttctgtgcgcacaatgacctccttcagcacagcagctccccccagcacaactctataaaacttcgctccagttgcaccctgcctctacacagccccttctctgctgtgctgccggttgcaactttgcaacgcattttcatacatacttkctctaataaatctgcctttctttacctacaactgtcttggtaaattactttaccacctgtgacaccggccccagctagttgcactcgtgacaactagctggttgtacttttggccaattattaacctctctgagtacaaatttcttcatccataaaattaggattaaaaactgcacccactgcaaaggattacttggaaggttcaatgaggcaatatatgaaaagcatttagcccagaatgtttcacatggttaagtgcttaataaatactagttactagcataataataacaataataa

SEQ ID NO: 171720 - DNA, 601 bp, Human
tacatactttctctaataaatctgcctttctttacctacaactgtcttggtaaattactttaccacctgtgacaccggccccagctagttgcactcgtgacaactagctggttgtacttttggccaattattaacctctctgagtacaaatttcttcatccataaaattaggattaaaaactgcacccactgcaaaggattacttggaaggttcaatgaggcaatatatgaaaagcatttagcccagaatgtttcacatggttaagtgcttaataaatactagttactagcataataatamcaataataataataagtctgtacagactaatacttgaagtagctataaaaaattccagcagcgctgatattagagttggccccctaagggtcatttggttcacctcattaaattaggcagagaaggaaaatttcagcttcttgagttgaccactctcacatttaacatttctaattagaaaaacaaaattcacttaagttttctagtctgttaaataaatgggttggattaagtaattctaaggagctttccaagtacaaaaaattcctatttctaacatcctttgtcaaccataaataa

SEQ ID NO: 171721 - DNA, 601 bp, Human
tcttacctgggtaaaatgtcagggacttgtctgaagtcctgcagtgtgaggcttagttagaagaaaagttctactagagaatttaagggtagtgccttcagtcagggcagattccagatggacaaaccagagaactttcaaatgaagatttgatgggttcagcaatcctgtgatctcaataggaattttctcttggttatcaggatgctaatggaagattaactaattcttttttaaaaaattatatgtaaagcccagaatgtcatgaattttccaaaagttttttagggaactacaaatkattaagatgaggaatagaataagaataatgttacagtaactgtcctgtgttgagctctaaataggttttatacagactatttcattttatttttataatggactctgaggtgggcactggcattactcacatttaaaaggtgactaagctaaagctaatagtgttaatatattttcataaagtcacacagagtaagtgtcaagttcactcatttgtttatttaacaaatatttacttaacacctccgaagtgtcaggtactgttctatttgctggaggtagagcaatgaaccaaaggcct

SEQ ID NO: 171722 - DNA, 601 bp, Human
tttgtttacttccatctttttttcttacctacatcttgctaagggctggtcattcttcatgacgttagctctagaagacaaaaacatctacctctgtaatacagctcacttcacaaagcataattttctgcatattgtcgttcaaagactactttccctccagcgaaaaggatggacagggacacagggcatgaaggtgccagagaaacatactctatcactttatccatgaatagtaatagccttcttgtaaggctgttttgataattaaatgagatagcatttgagaagtggttagcayggtgccatgggcatggtaaccattaaacaaatgatggctatgactattactattcttaaacatgtgttgagcaggagaattggtgctcctgggcctgctttactatagcagtcttcccatccaggagagacagtatgtgtgtgagtccctgcccagagactaaatgttgacttgtattctgaaacttgctgtggaatctagtagtggcattcaaccctagtgttcacttttctcctcctctcaacatgtgctcttggtccagcataagcatctcccctgctggcttttcttggtagctcc

SEQ ID NO: 171723 - DNA, 601 bp, Human
gatggggaattcagtttccttatttacaaggaacaaggtcagagctgaagatgttttcttccaaatacaaagccaatttgtagagggtgtatttcactgaaagccaatgtgtaaattacataagcgggggaaaaaagaattatagggtctgcaattgctttccagggtacaaaaggacatttgatttttttttctcccagcgtaattcagaagaaagtgacaccccagggagccaagattgggttttcttgtagggcaagaaagacatttttctagaggaggaaaaggtaacacgagggtytgggagaggtaaggatgatttctgccattgaacaatgctgtatatgaaggtaggcagttctctttgatcattaagtacctttctgaacacatatatatcaatataaaagagtggaagtagcttgagaatgtttctgctgaagtggcttacagatgatgtttggatgagaagagaggcagggagacttaccttgaatctcttttttaagagattgtgtattaatccatgcttttgggggttggatggtgagatgaggtgtctaaatctctcttcagtagtcaccacagtagaaataacttt

SEQ ID NO: 171724 - DNA, 601 bp, Human
tgatttttttttctcccagcgtaattcagaagaaagtgacaccccagggagccaagattgggttttcttgtagggcaagaaagacatttttctagaggaggaaaaggtaacacgagggtctgggagaggtaaggatgatttctgccattgaacaatgctgtatatgaaggtaggcagttctctttgatcattaagtacctttctgaacacatatatatcaatataaaagagtggaagtagcttgagaatgtttctgctgaagtggcttacagatgatgtttggatgagaagagaggcaggragacttaccttgaatctcttttttaagagattgtgtattaatccatgcttttgggggttggatggtgagatgaggtgtctaaatctctcttcagtagtcaccacagtagaaataacttttttgtctaattgttcctccatgaagggagaataagagatgccagagactcatcaaggtgagcttactgaacatcttctgttttctgggctggcaaggtcaaaaggaggctgtggtttctccctttggggtccacatcagtctgctgtctcatgtttcctttgtcttatgttttcatgagga

SEQ ID NO: 171725 - DNA, 601 bp, Human
tttctcagcctttggtcttaaatctctgaaatggggatgaatataggaccaacctcataggattgttcaacggctgagcaagttaaagtatatgaagatttaacacagtcccttgcacatagtaagtcctcgaaaaatggtagctattattttcccttcttcctctctcgtgcctattaggatttctgaagctgtaggtaatgatcctctatcttttccatttatacccatttagactgtcactgaacttcatggcttctgccagcacatactttgatgacacataataactccatcttarctttctaatggggagcatctattgtgtacattttttgctgacatgaatggctgggcgcggtggcttacacctgtaatcccagcactttcagatgcctaggcgggcggattactggaggtcataaattcaacaccagccttaccaacatggtgaaacctcgtctctgctaaaaatgcaaaaattagtcaggagttgtggcatgatttgtaatcccagctacttgggaggtgaggcaggagaatcgcttgaacccaggaggtggaggttgcagtgagctgagattgcaccattgcactccag

SEQ ID NO: 171726 - DNA, 601 bp, Human
ggtctgggaaattaggaagaaatgtctttggagaaagttgtttaagtgcagaggcatgcctctcttctaatgcctcacctaacaccaagtgaaaggggctttaggaggaccccctcagaaaggttgatttatgttctccgaagtttcatgggaaaaatggaactgatacgaaactcatgatgaacaaatttagaagagcagatctgtggctggagctgcttgttgggtggcaatggaaagaaagatgattaaactgggagtcaggaatgccttttactggccacaccaaaagttggttaartgtataaacatccatgtagtttaatctaaatgttaaagctaaatctttctatctcctgaaggagattctggccatcttgactaagctttcaagtatttttggttggttaataaactattaaacagagtgtgctaagagctaactgaatttcatgtcatctttcatttgttaatgaaaggtaaaataccaataagtgtggtttagtacatgacaccagccctctgcaggcattggactgggaagataacttggctcaacttgcatgttactctgtagtttactttacctcgtggtcaccag

SEQ ID NO: 171727 - DNA, 601 bp, Human
ttctaatgcctcacctaacaccaagtgaaaggggctttaggaggaccccctcagaaaggttgatttatgttctccgaagtttcatgggaaaaatggaactgatacgaaactcatgatgaacaaatttagaagagcagatctgtggctggagctgcttgttgggtggcaatggaaagaaagatgattaaactgggagtcaggaatgccttttactggccacaccaaaagttggttaagtgtataaacatccatgtagtttaatctaaatgttaaagctaaatctttctatctcctgaaggakattctggccatcttgactaagctttcaagtatttttggttggttaataaactattaaacagagtgtgctaagagctaactgaatttcatgtcatctttcatttgttaatgaaaggtaaaataccaataagtgtggtttagtacatgacaccagccctctgcaggcattggactgggaagataacttggctcaacttgcatgttactctgtagtttactttacctcgtggtcaccagtgaatctaagttgattgactaacattgaattttttgataaaatgttctgtagagctggaagagt

SEQ ID NO: 171728 - DNA, 601 bp, Human
agatgagttaaatgataacatttggaattgcttatatagcatttttaccagaatattaaagcgttttgtgtagattatttcatttacttttaaatatcatgaagtgactattaggcaggaaagagttttaaaaaccctgtcttgggtcctacagaaaaccattggcagagtcaagttctcacttgcagactttcagactttgctaccaatgtataccagtccttcccactgaacacccttggttcttggttttagatgtcaaagtctgtctgtaacacatggagaggtatcaggcacaggrtgcaaagttcactgggcttggaggtctgtggcttaggtgtaatcttattctgctacttattggctgtgttacttttaaaagtcacctaacttgagtgagctgcattaatccttcacttccattaaatatctgaatatatgcatcacaccaagcacataatgtgtttaaaattgctattttggtttagattcatccaggcacttcacacttgcatattttatcttatctcctgggttctgaattgtagaatgttatttcccctcccctttccttgtataccaccgcctcactgctcccatt

SEQ ID NO: 171729 - DNA, 601 bp, Human
gtaagctggaccaagactttacagataggaaagctgagggtcttatctgacatcacccagcctattagggccaacgtgggccaagagcccacgtgtcctgacttccagcccagagccagttctgcttcatgaccctgccccttgcactcagaagctgagggtatttgtggtttgtttgttttagtgctttcttttattactgatagctcttctgcaaggaatgcctcccctctctaagcatttattctttgttacttacagaagaagactgcataaactgggcgtgtcaaaggtcacccargtggatttcctgccaagggaagtagtgtcctactcaaaggagacccagactcctcttgccacgcatcagtctgaaggtaaactatgtctttggcttactttccatattatctctggagaaatcgctgggaagtaacatctttcttgttgatttcctcttaccataagagctcttcatgggatacaaacataatgacactgaaagccaaagcctcttctgagtttgaaagctatggagagggaactcggtgatactcttccaagtgacctggcaactttaaattagataaactaaagaggt

SEQ ID NO: 171730 - DNA, 601 bp, Human
agcttttttgtggtgaagggcatttacatggttcagattacaatacagaacccaaagctagctaccatagttcttgacatttaagcaatcctggatggatttggacagaaaaacctttcaatttgggttcagcaaactgcccctcaccacaggcgatgatgccttgacccttggctgccggcagtcacccggctgcccggccatcgagggtgctggtgctcactttcacctgctgtggggaggtggttggcaggagagctgcgtggagcagtggacagttggcactgaggttctaccatgyggcagatgtgggttggctccactgtggggtttgagccatggcaatgttttcatgaaaactgcgcctttcagcggcaggaaacaactacggaattttatgacacaatgaggctcttgggtggctaacatttgaagctctggcatatataacatccactttggcttgctgttgcccacaatgtaagaaggcatgctgattattttttgtcattgtttgactgtggacagtttaatgataatcaaactaatgatctcagagcattgatttgttctgcctctaatggattctagtgcattcaag

SEQ ID NO: 171731 - DNA, 601 bp, Human
ggctgcccggccatcgagggtgctggtgctcactttcacctgctgtggggaggtggttggcaggagagctgcgtggagcagtggacagttggcactgaggttctaccatgcggcagatgtgggttggctccactgtggggtttgagccatggcaatgttttcatgaaaactgcgcctttcagcggcaggaaacaactacggaattttatgacacaatgaggctcttgggtggctaacatttgaagctctggcatatataacatccactttggcttgctgttgcccacaatgtaagaaggcwtgctgattattttttgtcattgtttgactgtggacagtttaatgataatcaaactaatgatctcagagcattgatttgttctgcctctaatggattctagtgcattcaagttcttacacattcccattttacttttgaaaatgaaggggaaggcactttggatttgcccaagcttaagcatcctttctgtactgtgcaccgtaatgaacattctcatcatagtaagtattaatttttgatcataatgatctgttatgagaaacactccagacagtgatataaataagcaagatttaagta

SEQ ID NO: 171732 - DNA, 601 bp, Human
ctgtgcaccgtaatgaacattctcatcatagtaagtattaatttttgatcataatgatctgttatgagaaacactccagacagtgatataaataagcaagatttaagtataaattctccatgaatactgttctttcaacaaggttagaccttccttctctgcagggaaagaaggccaagaatggccaacactgacttggagaaggatacctttgccccaatatatttgaaacacataattttattcccaagtagcaagaaaggaaaacgaaattatggtcccctccaaggctgcctctctrttgcctattatgaacccatttctgtaccaaccatgaggtcctgggcttagggagccagtcttttgcatctttattatagtgagtgagtgcatggcttatcctgagtacccaagaaatgctgttgaacgacaaagataatgccagacatctctagaaacaccaagttcactatgttccccctgggggaatgagaatttcttaatctgctggaaagatgcaagccacactggaggaaggaggaggaaatttctacaacctggtacataatcatagtttgttttgatagtcacctggtatctt

SEQ ID NO: 171733 - DNA, 601 bp, Human
cccaatatatttgaaacacataattttattcccaagtagcaagaaaggaaaacgaaattatggtcccctccaaggctgcctctctgttgcctattatgaacccatttctgtaccaaccatgaggtcctgggcttagggagccagtcttttgcatctttattatagtgagtgagtgcatggcttatcctgagtacccaagaaatgctgttgaacgacaaagataatgccagacatctctagaaacaccaagttcactatgttccccctgggggaatgagaatttcttaatctgctggaaagwtgcaagccacactggaggaaggaggaggaaatttctacaacctggtacataatcatagtttgttttgatagtcacctggtatcttgtggtcaaggtttaatctctactcaggcccagtagcaaaccaagacatctctctcaaagggagagtaatgcaataaagaggccacattattattctaaaatctaagcacttcttctgagactcacctcttagggacatttgtttgatttgccatagacacttggggcaccattgggtcagctggaccataatttccaagtagtatagccatttga

SEQ ID NO: 171734 - DNA, 601 bp, Human
aggctgcaggtctttggctgtcaagcaaggcttagtgtagaacatggtttggaggtactcccaggcctccgtattcttacctacattcaatttcccattatttcctgatcattgctgtcactttcacataagtcacctggtgacactagcaattccacagaccttattcagaaacccacagaatttaaactttgcatttgactttgacatttttgtagatacttatcacaagcagagaaagtccatgggtctatgcctagatctaaaatatagagacttcaacctgtcatctatttcttasagctgtccagtcccattagaagtatccacctcatcctagtgtctttaaattcttcatgccactcacactattcaatagcagtgaaaatttgatcccctaaatccttcttttcaacggacacttcattaaagatcaccatagaagaaaaattatgtagctatttgttacagctgacagattcccattcctgaactcttactgaatttttattttctttagcatcagctatggcagataaccaacatcagcttcccacgtgactatctcctgatggtagtttctgtaccagactgagtttgt

SEQ ID NO: 171735 - DNA, 601 bp, Human
cccagcttccagaactgtgagaaaataaattgtccttgtttaagccacccagtttatgctatttttcatggcagcctgagcagactaagacagcagctaacacagcaagatcataccagttaaccttcctggttagaagacctgagcctcctgacttccggtcactggatactctctgttaggctcatgatttaaactctgtagtcactgctggcttggaaacctctaactctctctgcctcttgacagtgttccctcaagggagtccattagccaggactaggttacatgcccctgtgtyagctgtgagggacaaggcagagaaataactgcccaagttcagcttcccataatgtttggggatgctatgactcaactttgatctatttttatatccttccttttagaacaatgggtgtttggatgctaagtggccaagaatatatattggaaaaatgcccactttggtgtaagaaaaagaaaaaaaagggaggtaaagagaaaaataatatttattatgtgttcagcacactcatatacattattacgcttgcagcattgctagaatttactcaccttataaatcagaggtgccgagaga

SEQ ID NO: 171736 - DNA, 601 bp, Human
agaagacctgagcctcctgacttccggtcactggatactctctgttaggctcatgatttaaactctgtagtcactgctggcttggaaacctctaactctctctgcctcttgacagtgttccctcaagggagtccattagccaggactaggttacatgcccctgtgttagctgtgagggacaaggcagagaaataactgcccaagttcagcttcccataatgtttggggatgctatgactcaactttgatctatttttatatccttccttttagaacaatgggtgtttggatgctaagtggmcaagaatatatattggaaaaatgcccactttggtgtaagaaaaagaaaaaaaagggaggtaaagagaaaaataatatttattatgtgttcagcacactcatatacattattacgcttgcagcattgctagaatttactcaccttataaatcagaggtgccgagagaatgcagttcctttattttatctgcagccatttataataccactagttgacatggagaaaatatacaaaataaacaactttagttcactctcatcttttaaaccgtccctgttagtatgttccattaatcttggg

SEQ ID NO: 171737 - DNA, 601 bp, Human
tctcatactgccccagctacttgtttcagaagataagttccaagcaagtgtgagtacaaggtggggactcccttttttcagcccaacactaacttgagggatggagattttaccttggcttcaacatgctgagaacatgggaccccaactgtcttctccatggctcatgtgtaaagcagaggtttcatggtgggaaaagcaagctaagtagaccagaagcaatagcagtaccctactctcccacacagccagctgctaaagcaagggtgtcactcagaaagaagtgtgccattgtcccctyccccagctccagaatcttggtgcaaagattttgaccagggagagaggcaagtcaaaatcagagagctcagaatgtcttctcaaaagagctaacatgattttcaatgttcaagcctaagggcatcctcaaaacaatcaagatagtggtgtaaagcaattaagaaaagactggtagatgtgctaaatgtgtagacaagctgaaacatagctagcttaccagacagaaccaggaaaacagacagctaagaagagcccttctgggatcacaacacatctcaaaaactggtctcaaaaactgtaa

SEQ ID NO: 171738 - DNA, 601 bp, Human
agacagaaccaggaaaacagacagctaagaagagcccttctgggatcacaacacatctcaaaaactggtctcaaaaactgtaaattaaattcaggcttatttcaacctgtggagaaaattgtgccccagggcagtgttgaaaactatagagcaacaattatggaactcaatggcagcaattagtgaaactgagcagttgaagtgatcagagaaaggaactgctaaatggactacaaaaacctgttaccgcaggataactatgcacatgcccaaggctgcgcccttccaggaccagtatgakaggattcacactgtgggaggacaggggagaacagatttcaccaaaatagcccaaccaatcactaaacaaataagcaagcaaataacaataacaaacctgggggttggggggactggtatccagtgctgctacaatatattatcaaagtcaatttcttaaaaaaagaaatttgaggcaaagaaaccagaaagtctgacccctacacaggcagggaagcaggcaacagaaactgcctgtgagggcaactagatggatttaacaaagacttcagagttgtgtatgtgtgtatgtgttttttca

SEQ ID NO: 171739 - DNA, 601 bp, Human
agcaaatcagcctacctgtaacaggaatgccagaaggatagatcaaagaaaaaggagtagaaaatactcaaataaataatggaataaaatttctcaaatttgatgaaaaactttaactataaacctaagaggctctaaactccaagtaagattaaagcaaatagttccatagacacagcatagtacaaatgctgaaacccaaagacaaggaaaatatcctgaaagcagcaagagaaaatgaattttcacttacaagagaacctcaataagataaactgctgacttcttatcagaaataatkatgaccagaagacagtggtgtggtgtattcctagtgcccaaagaaaagaagaaaaaaaaaaaaaacaactatcaatcaagaatcactacccagcaaagctatcttttaaaaatgaaggtaaagtaaaaacattcacagataatcattgagataatttgtagtcacagacccaccttacaagaaatataaaagaaagttattcagactgaaagtgactgaccccagagagtaattcaaatctatagggaaaaacaaagagcacaagtagaggtagctatgtaactataaaagatagtatac

SEQ ID NO: 171740 - DNA, 601 bp, Human
gtaacaggaatgccagaaggatagatcaaagaaaaaggagtagaaaatactcaaataaataatggaataaaatttctcaaatttgatgaaaaactttaactataaacctaagaggctctaaactccaagtaagattaaagcaaatagttccatagacacagcatagtacaaatgctgaaacccaaagacaaggaaaatatcctgaaagcagcaagagaaaatgaattttcacttacaagagaacctcaataagataaactgctgacttcttatcagaaataatgatgaccagaagacagtrgtgtggtgtattcctagtgcccaaagaaaagaagaaaaaaaaaaaaaacaactatcaatcaagaatcactacccagcaaagctatcttttaaaaatgaaggtaaagtaaaaacattcacagataatcattgagataatttgtagtcacagacccaccttacaagaaatataaaagaaagttattcagactgaaagtgactgaccccagagagtaattcaaatctatagggaaaaacaaagagcacaagtagaggtagctatgtaactataaaagatagtatacataaatatttctttttt

SEQ ID NO: 171741 - DNA, 601 bp, Human
tcctagtgcccaaagaaaagaagaaaaaaaaaaaaaacaactatcaatcaagaatcactacccagcaaagctatcttttaaaaatgaaggtaaagtaaaaacattcacagataatcattgagataatttgtagtcacagacccaccttacaagaaatataaaagaaagttattcagactgaaagtgactgaccccagagagtaattcaaatctatagggaaaaacaaagagcacaagtagaggtagctatgtaactataaaagatagtatacataaatatttcttttttcttttccttctsttaacttatttaaatagcagtgatataaaacactataccaataattgtattattcagcctataacttatagaaaggtaatatattttctaataacaggacaaagaaggtgagtggcagcactttgttatttacagaaattctccattgttctttttttttgctgaaatcctgtagtctatagtaactagcattaaaactcttaaatgaaaaagagtcttatattttggggatagtagagaagtgaagaagaagtaattatggggagaggaacagcaaaagtaaagtaagtgataaaataa

SEQ ID NO: 171742 - DNA, 601 bp, Human
agaattgtaggaaggtaattgtccaacattttttgattggatgtaactaacttatcaatggttctaagcatgaagaatttggtctatttatactaacgttctccccagaccagttagagttacgtgtttgctctgccatgtaggagctgttccaaggtctagaatctgcatggaagaagtagtaagtccagttttacttttacagtaacttataattgtcagcctattccttattactagtaatgatgatagtttggcctttatttgttttattcctgttcttatttttcaattaattcakaacttggacaggaaaaagtggtactatttcaaaaccccgacaccttggtacattgcctggaaatctaacccagtcctcccacatggtaagagagaattccaccaaccgaacacacttcctgtccacatctgatgtttcttccaatgtgaagtccgttcgtggaatactcttagcttcttgccacccctttaccactccactctaccctgcatactccacccccagaggaggtggaatgatttatccaattggtaggtttggataaacgacccgggcagtttcaggccatctccagttttt

SEQ ID NO: 171743 - DNA, 601 bp, Human
aggaaaaagtggtactatttcaaaaccccgacaccttggtacattgcctggaaatctaacccagtcctcccacatggtaagagagaattccaccaaccgaacacacttcctgtccacatctgatgtttcttccaatgtgaagtccgttcgtggaatactcttagcttcttgccacccctttaccactccactctaccctgcatactccacccccagaggaggtggaatgatttatccaattggtaggtttggataaacgacccgggcagtttcaggccatctccagtttttttcctggggragccagcatacctgtaggggttacaagttactttcttctcctttgtgccatgagtcatactcaagtcacatgcaagaggggatgcctgtcaggtccagccttacctgtgagagagtgggtaagtctgcctatttcaggaaatcaattagtagatccatttggctttcttcataacctacatcttcttactttttttttttttttttttttgagacagaatcttgctctgtcacccaggctggagtacagtgacgtgttctcagctcactgcaacctccgcctcctgagttcaaccgattc

SEQ ID NO: 171744 - DNA, 601 bp, Human
ttctcagctcactgcaacctccgcctcctgagttcaaccgattctcctgcctcagcctcccgagtagctgggattacaggtgcacaccaccgtgcccagctaatttttgtatttttagtagagatggggtttcaccatattggccaggctggtctcaaactcctgaccctcacgatccgcccatctcagcctcccataacttgcattttcactcgttcgttatcaacaatgaaaatgttattttggcctccctccatttttttatctttccctaatttctcatttggatgctatttatttrgtcctcttaagaatctcaaacagtagaaggaaaattatgtcacgatgtcagttctgaagaaatcaaagtactgaagataatgttaatgaccataggtaattacacaagaaagagtaacttaggcagaagggagagggttatattctaggaacaaggaaatagcccatttgtagaagtggattacagggtcagagtggaagcagcaataaagtcaccttgatgctgagccctgaaatccttccaattctctatgaatgtgtgtcaatgctgagcctgtgtgtgaaggtactaactgtgtag

SEQ ID NO: 171745 - DNA, 601 bp, Human
ctcctgcctcagcctcccgagtagctgggattacaggtgcacaccaccgtgcccagctaatttttgtatttttagtagagatggggtttcaccatattggccaggctggtctcaaactcctgaccctcacgatccgcccatctcagcctcccataacttgcattttcactcgttcgttatcaacaatgaaaatgttattttggcctccctccatttttttatctttccctaatttctcatttggatgctatttatttagtcctcttaagaatctcaaacagtagaaggaaaattatgtcamgatgtcagttctgaagaaatcaaagtactgaagataatgttaatgaccataggtaattacacaagaaagagtaacttaggcagaagggagagggttatattctaggaacaaggaaatagcccatttgtagaagtggattacagggtcagagtggaagcagcaataaagtcaccttgatgctgagccctgaaatccttccaattctctatgaatgtgtgtcaatgctgagcctgtgtgtgaaggtactaactgtgtaggtttgtgagggaagagagccaggaagcttgctatacttgatga

SEQ ID NO: 171746 - DNA, 601 bp, Human
tgaagataatgttaatgaccataggtaattacacaagaaagagtaacttaggcagaagggagagggttatattctaggaacaaggaaatagcccatttgtagaagtggattacagggtcagagtggaagcagcaataaagtcaccttgatgctgagccctgaaatccttccaattctctatgaatgtgtgtcaatgctgagcctgtgtgtgaaggtactaactgtgtaggtttgtgagggaagagagccaggaagcttgctatacttgatgacttatttgaaaaggaaaaagaaaaaaaaagtaaaacctggtcactattaccataaagccatagcatgaaataagattttctgtaaaattgttagcacagcattccagttttgataacacttcagatgattttgttgcagtaaaatatatcagactgaaaacctttcctttgcctaaaggaaggtagttcttggactatttgggaacaaatgatctctttcaatagctcaaaacttgtagtgtgacatttgttttcttgtgatcaatagagcaagtgttcattttcaccatgagggtggcatactggaggctcaagctaattatttttct

SEQ ID NO: 171747 - DNA, 601 bp, Human
ttaatgaccataggtaattacacaagaaagagtaacttaggcagaagggagagggttatattctaggaacaaggaaatagcccatttgtagaagtggattacagggtcagagtggaagcagcaataaagtcaccttgatgctgagccctgaaatccttccaattctctatgaatgtgtgtcaatgctgagcctgtgtgtgaaggtactaactgtgtaggtttgtgagggaagagagccaggaagcttgctatacttgatgacttatttgaaaaggaaaaagaaaaaaaaagtaaaacctgrtcactattaccataaagccatagcatgaaataagattttctgtaaaattgttagcacagcattccagttttgataacacttcagatgattttgttgcagtaaaatatatcagactgaaaacctttcctttgcctaaaggaaggtagttcttggactatttgggaacaaatgatctctttcaatagctcaaaacttgtagtgtgacatttgttttcttgtgatcaatagagcaagtgttcattttcaccatgagggtggcatactggaggctcaagctaattatttttctggtaatgggaa

SEQ ID NO: 171748 - DNA, 601 bp, Human
tatatcatctgaagcctatttgtacgttgggatcattttatttggttttggttaggcataaaagtgttctgtggtctcctcttttttcaaggccttctggcttttggaaaattgagtgatttcatccctgtccgggtttcctagtgaaatcttgtatttttactcaaattacttgatcaattagttatgtcagctgcccaaaatgtgcctttttattaatagcaccttttatcaactcattggaattagaaattgcaaccatggtttgaggctggtaacatcttgcaataatttataaatwttactttttaaaaagacctcacaattgctcatttgtgaactttttggatgtgtccctgtgtgagaaattgcatttgtattattattagttctgacaaactggattagatcttggctattgttaagtggttctatctgccctcaaatctactgagagacacagcattttaaatgaatttaattaaaacggcatgtggtttatagagctgcctccagttagtatgccattcttcttgactgaatagagtttctactaatgtataatgatgttttatgtgagagatgtttgaaactccttcat

SEQ ID NO: 171749 - DNA, 601 bp, Human
aaaatacaaaaattacctgagcgtggtgtcatgtctgtagtcccagctactcaggacactggggcaggaggattgcttgaactggggaggcggaggttgcagtgagccgagatggcactactgcactccagcctgggtgacagagtgagacctgtctcaaaaaaataaagcaaaacaaaacaaacaagcaaaaaaacccatactcaccaaaagaaaaaaaaaattaagacttagagaacttaacttgctagcaaataaccaagccagaattcacactcagtgcttcctgactttaagtttyttcccatgatgccattctgcctcaaaccagacagccaatctccttaagaagacaacaattttttatcaaaatattttgacattagtgaattaaccaagtatgccacttgtctgactgtgcaaatccttaccaaggaagcaaagtggaaaaaaaaattgaggaaattccagacaatggaaacacaataggcaaaaagacatttcagttttatctggagaacatatgaaaggagcagcagtgatcacagagaacaagctggaaacacttccttgtgagtgatggtattctgtttccatggta

SEQ ID NO: 171750 - DNA, 601 bp, Human
tcaacaaagaataattcagtgagacagccctgatcatgtcacccctgcctaaaaactttccaggattcttggctaagtgcaggacgcctcgtgggcataggaggtcctctactcagccagtctcatctcctgctctctacagttccgtctctatgctctggtccattctgacatgcacccaatccgggctgcatattagagtcacctagggagctttaaaaatatacagatgtctgggcttcacgaaccccagggattctgatttgatgatctggggtagggtcttaaaatctctccaggyaattagaaagcacagccgggattgagaagatcactgatctaatcaaagaggattctaaaaactacttcattctcctgactctacactttatactaacgcccttcctttctcctgaaagatcttttctctctcctcccctttcaccttctctggccaactataccttttaaattcttttcatcttgtaaagtgtttctccaatgccttgaagcttttcttaattccccgtcctctttttagttgaacatagtatctctttcatttaaactttaaaaatgtgtttttacccctcttatagca

SEQ ID NO: 171751 - DNA, 601 bp, Human
tttcaccttctctggccaactataccttttaaattcttttcatcttgtaaagtgtttctccaatgccttgaagcttttcttaattccccgtcctctttttagttgaacatagtatctctttcatttaaactttaaaaatgtgtttttacccctcttatagcatttatatttcctatcactacctcctctcacccttctctatgagcaaggactaggttttgcagatttcttgatatactaaaggctcaataaaaaattaaatacctgtatttcaaaggttgcaaaatatctgtctttggaraaaagagttaatatcctccatttctgatgatgcttgaattgagttcaagactgggcccaaagtccatcccctaatagtgagaatgcttattttagagcctgcaagccccccggtattgtattagaatggtgtatgggcttgggtgcattattttcaggagagtttccgtagctttaatcagactctcaaagttacccatctatgattcattaacatgttaaagctactatcctacaagatgaatcttcagaggctcagtgctcagtggtgacagtggccttgatttgacactgtttactg

SEQ ID NO: 171752 - DNA, 601 bp, Human
ccgtagctttaatcagactctcaaagttacccatctatgattcattaacatgttaaagctactatcctacaagatgaatcttcagaggctcagtgctcagtggtgacagtggccttgatttgacactgtttactggacactaaccttccatttctctttctgccataattttaggccacttcacctccatttaggttgaatgccttcatgaaaatgttagtactccaaagactaatcgagaataacacctatcatttggatgattaaatatttttaaatgaaaaataaaattaggccaggwgtggcggctcacacctgtaatccaaacactttaggaggccaaggtgggcagattgcttgagcccaggaattcaagacaagactggccaacatggcaaaccccatctccacaaaaagtacaaaaatctagctgaacgtggtagtgcacgcctgtagtcccagctacttgggaggctgaggtgggaggatcgcttgagcccaggaggttgaggctacagtgagctgtgatcatgccattttagtccagcctgggcaacagagtgagaccctgtctttaaaaaaataagaagaagaaacaaaa

SEQ ID NO: 171753 - DNA, 601 bp, Human
aaaaggaataaaattcatttcggcaggccacctctgagtttcttaggtttcattatttgctgctgaaatatttgagactaaaacaacaacaatcaaaacatgacttagtagctgttcgaagtaatttttctacttctgggcacaaaatagccagaaaagcgtctgtcttctcaattgaactgatttgtaattctagaatgtaagaggaaaaaactggaaggacctccacttaaatctgtaattttggtaattctgaagtaacgtgacacaaggaattttgatcattgctcagttcagcctrggggaatctcctttcaaggaatgagaaatgcttgggagaagtcattggaggaagctgcaattggggtttgacctgaataaattgaaatagaacatgggagatattacctagtgagcctagtagaaattagcaagctgaagataagagttagcagtatatatattcacatatatatggctgtatactcaaaattgttgcaaagtgtgaacatcagacttaatcaaatgacatgctgatatgcctccttataaaaaagggttggcattaaaattcagaattttcaaaatacaaaaattagaa

SEQ ID NO: 171754 - DNA, 601 bp, Human
ctcaacatcactgatcatgagagaaatgcaaatcaaaaccaccatgagatagcatctcacaccaatcagaatgtctattattaaaaggtcaaaaactaacagatgctggcaaggttgcggataaaagagaatgcttacacactgttggtgggagtgtaaattagttcaactgttgtggaaagcagtgtggcaattcctgaaatagcgaaaaacagaactaccattcaatccccttactgatatatctgatgtaataaatcattctcccataaaggcatatgcatgtgtatgttcattgcarcactattcacaattgcaaatatatggaatcaacctcaatgcccatcagtggcaaagtgaataaagaaaatgcggtgcatatataccatggaatactatgcagccataaaaagaatgagattatgtcctttgcaggaacatggatgaagctggaggccattatccttaacaaaaatgcaggaacagaaaggcaaataccacatgttctcactttaagtgggacttaaatgatgagaacacatggacacatagaggggaacaacagatactggggcctccttgacggtggagggtgagagga

SEQ ID NO: 171755 - DNA, 601 bp, Human
caggaacagaaaggcaaataccacatgttctcactttaagtgggacttaaatgatgagaacacatggacacatagaggggaacaacagatactggggcctccttgacggtggagggtgagaggaggaggaagggagaggatcagaaaaagtaactattgggtactaggcttggtacctgagtgagaaagtaatctgttcaacaaacccctgtgacacaaatttacccatataaaaaaccttcagatgcaccactgtacctaaaataaaagtttaaaaaataaataaaattaaattaatgaratgctctttaaagtatgttaaaattgccatttggttaatttcagaggttctcacacttcagtgtgcatcgcagtcaccagaaaggtatgttaataaaaattaggttgctcagcccccaccctcagaatttctgattcagaaggtttgggatggatccctaaaatctgcatttcgaacaggttctctggtctgggcaccagtttgaaaactgttggtttattaaaattcttcctgaacgtagtttattagaaaaaaatctatgatgtaacaggaagtaaacctacaagtgatttttagtgg

SEQ ID NO: 171756 - DNA, 601 bp, Human
tcagtgtgcatcgcagtcaccagaaaggtatgttaataaaaattaggttgctcagcccccaccctcagaatttctgattcagaaggtttgggatggatccctaaaatctgcatttcgaacaggttctctggtctgggcaccagtttgaaaactgttggtttattaaaattcttcctgaacgtagtttattagaaaaaaatctatgatgtaacaggaagtaaacctacaagtgatttttagtggatgtgatgtgctgaattgtgtatcccccaaatttcatatgctgaagtcctcatccccrgtacctcagaatgtgactgtgtttaaagatagggtccttaaagaagtaattaagttaaaatgaggtcattagagtgggccttcatccaacatatgactagtgtccttataggaaggggaaattaggacccaggcacacacagaggaaagcccatgtgaaaaaaacagggagaaggtggtcatctacaagccaaggaaagaggactcagaagaaaccagcctgctgacaccttcacttggatttctagccccaagactacgaagaaatatatttccgatgtttgatctccctagtctgtgg

SEQ ID NO: 171757 - DNA, 601 bp, Human
gcctcagcctcccaaagtgctgggattacaggtgtaagccaccgtgcctgacctaatttttgtatttttagtagagatggggtttcaccatgttggccaggctgatcttgaattcctgacctcaggtgatccgcccaccttggcctcccaaagtgctgggattacaggtgtgagccaccgcacctggccctgtaactatttttattataagaattttctcctagcagtagtgatggaaataacattagcaatacaaatgctatcttatagagggagaaaatgaggaggcccaataccatttcatgagtgagtcagaaggtgaaatccacaatcacttgcttttatgctttgctcaaagtggcaggctccatggcctcttaaaaaaattgccatctttttattataaagtaataaataaattgcaaattctgccataaactctttcctcgtgacctttcttaaatttgttttcttttttcttcatttcttaataagtctttatatattttggcacagtaagctttgaaaagggagggttaaaaatagcttcctggtttcagctaccaaacacaagcatgttttggagctctcccacaacagg

SEQ ID NO: 171758 - DNA, 601 bp, Human
agcatcctggaacatcccagattattagttgctgtagtccatctagaatgctataatgagacaccataaactgggtagcttataaataacagaaatttgtgtctcacaattctgaaggctggaaagtccaagatcaagattccaggagacttggcacctggtgaagcctggctttctggtttatagaaagcatcttctctgtctcctgatatgatagaaggggcaagggatctctctagggtctctttataagagtaccaatccccagttatctcccaaaggacctacatctaataccctyaccttgggggttaggatttcaatacctgaatttggggggggacataaacatttagtctattgtattagcactgcaagcatagggtgtaagagtgtgtatcttcttttcaaacttaggaattagctatttcttcatagattcttctagttagtaataggttggtgcaaaagtaatcacagtttaaattttaaatcattataactaggctcaaacacatctttattaattaaaataggaaccattacaatcaacacatttttgccaactggaaataagtttgtttattcctgtagcataaaa

SEQ ID NO: 171759 - DNA, 601 bp, Human
tctagaatgctataatgagacaccataaactgggtagcttataaataacagaaatttgtgtctcacaattctgaaggctggaaagtccaagatcaagattccaggagacttggcacctggtgaagcctggctttctggtttatagaaagcatcttctctgtctcctgatatgatagaaggggcaagggatctctctagggtctctttataagagtaccaatccccagttatctcccaaaggacctacatctaataccctcaccttgggggttaggatttcaatacctgaatttggggggggacataaacatttagtctattgtattagcactgcaagcatagggtgtaagagtgtgtatcttcttttcaaacttaggaattagctatttcttcatagattcttctagttagtaataggttggtgcaaaagtaatcacagtttaaattttaaatcattataactaggctcaaacacatctttattaattaaaataggaaccattacaatcaacacatttttgccaactggaaataagtttgtttattcctgtagcataaaaatctgtgcttcgggattcaatgaactcttggaaagcatttt

SEQ ID NO: 171760 - DNA, 601 bp, Human
taggatttcaatacctgaatttggggggggacataaacatttagtctattgtattagcactgcaagcatagggtgtaagagtgtgtatcttcttttcaaacttaggaattagctatttcttcatagattcttctagttagtaataggttggtgcaaaagtaatcacagtttaaattttaaatcattataactaggctcaaacacatctttattaattaaaataggaaccattacaatcaacacatttttgccaactggaaataagtttgtttattcctgtagcataaaaatctgtgcttcrggattcaatgaactcttggaaagcattttctgcatcctgctggttgtggaaacattttccatgtaaaaagttgtcgagatgcttgaagaagtcagttggtgagaggtcaggtgaatatggcagttgaggcaaaacttcttagcccaattcgttcaacttttgaagcattggttgtgtgttgtgcaatgagtggtcaggcattgttgtggagaagaattgggccttttctgttgaccaatgccggctgcaggcattgcagttttcagtgcatctcatcaatttgctgagcatacttctcag

SEQ ID NO: 171761 - DNA, 601 bp, Human
tcattcgaatttgctttttgtctaacatcatttccattgtctaaaataaatataaaataaacagcaagtaataagtcattagcaaaaaaaaagtgagaaatggccattaaagtgatatataacataactacatttatttaagaatgtattccaatatcacacagcaaatttcaacaatgcaaaaactgcaattatgtttgcaccaagctaatagtatcctgtcttatgccactaattaccttagggctgagtgaaagcggggcctgctagccctgatgatggaccctcagttcagagtcarcttgagagggaggcaagagaaaccatcttctccacctttcccctcctagggcagttatctgagagaagagccggcagaaggcatttagccttcagtctgtgaagtgttggtgctggacaaattatagcagaagctgggctgctacagagtaactagggttggcaatagcttgcttgttgatggccactttcttaggcaagtccagacacagtatatagcggcttcaggtgggactagaacatccctgcagcaccatctgcccaggcttgctcggtgaagagccctgagccctaagcccta

SEQ ID NO: 171762 - DNA, 601 bp, Human
ccctaaatcctaaggtggtgtcagtttagcttaaaggaaggtggtcttcttggagaaatgtgccaagcttgagagcgtcctaaacatcatggcaaaatatgaggcaaaagggtaaactgacgaggattgttaacaccaacattactaataatgcgtgcttatattacttaatgtttctatttgctagatatcaagccttaacactgactactttaaattcagtgtttcattgaatcccctcagcaactttatgagttaagtattattactattcctattttcagagaagataactgacaaraagagagtaagaagtttgcctaaagttacagttattaaacatttagaattggtttcacacacagctcagtccgactcagaatcccatactctttcccctaaactatgccacctgtaaacaaacacaggcaaggccagtgagaaatcagaaaccaagttgcttattatttcatggtgttgctgtgtgttgtgggaattacaaatgactctaaaatattgtttctaccctccaggagcctagaatgtcaatccgtgatctttctcatcaattctgtttatgttttatttatccccatatgaa

SEQ ID NO: 171763 - DNA, 601 bp, Human
tccaagtgctttccccccagcgtagggagttcaacgtgttctttattcaggccattctaattactgccagccacattccctcaatttattaaaacaatggcccagcttatttcagtttagtttaattcatgtgtgaaaactttacccccatcttattccatggagaacagtatgaaagctatctttctagttggtccagtgtttttgtttttagaaaagcaccggctgtttccaggctgactcaggaacttcattaatttagttgagccttgtgcaattgttaatgggcatgagatagccyagtggtgcagcctcatctggagtgcaaaatattacagtactccatggccaaatcttggtagcaagtattttttgctatctttaccctcactaaggagaaacgtgaagtgtgaggcaatttagtatagttagtattttagtagtaagtaccgtatattgaaggtgggaaataagaacatatttaccttctcctagtttttacatcttttgcacactgaaatcaaactgtgcttctccaaagtgttttgtgccattttacccaaatgcttccaacttatttagggaagtgttcattttaaga

SEQ ID NO: 171764 - DNA, 601 bp, Human
ccccagcgtagggagttcaacgtgttctttattcaggccattctaattactgccagccacattccctcaatttattaaaacaatggcccagcttatttcagtttagtttaattcatgtgtgaaaactttacccccatcttattccatggagaacagtatgaaagctatctttctagttggtccagtgtttttgtttttagaaaagcaccggctgtttccaggctgactcaggaacttcattaatttagttgagccttgtgcaattgttaatgggcatgagatagcccagtggtgcagcctyatctggagtgcaaaatattacagtactccatggccaaatcttggtagcaagtattttttgctatctttaccctcactaaggagaaacgtgaagtgtgaggcaatttagtatagttagtattttagtagtaagtaccgtatattgaaggtgggaaataagaacatatttaccttctcctagtttttacatcttttgcacactgaaatcaaactgtgcttctccaaagtgttttgtgccattttacccaaatgcttccaacttatttagggaagtgttcattttaagagtgtggcaccttgt

SEQ ID NO: 171765 - DNA, 601 bp, Human
tccaacttatttagggaagtgttcattttaagagtgtggcaccttgtattttctgaagcatccttttctacctccaacagggagcagcaaggctagtcacagctagttctagctggacagtaatccatgccaaggactggaacccagaagaagtaaaagtgaagaaaataagtggagctggattaaaagatagacccacacacaaagaggcagacaggagacttaatgtttgcaatgtttcagcttgtgggaaaaccaactgtcatgtgaatattctgcaaagaacagaaatgatatcatyttattagcaccacaattcatagtttattgaatgcttccattttccaggccttgctaagtggatcctttatttaaatttatccttataacaactctgtggggaaagttcaatcattcctctttgataggtaaggaaactgaggcttacagaggttgtggagctgtgtgagggtacaaccaataattagtagaagcagaatttgaatctctgtttgactccaaagaatgagaatgtgcatcattggtagggtgtacttagttgaatgctagaaagcagtggatgctgctgtgagataacttg

SEQ ID NO: 171766 - DNA, 601 bp, Human
aacttatttagggaagtgttcattttaagagtgtggcaccttgtattttctgaagcatccttttctacctccaacagggagcagcaaggctagtcacagctagttctagctggacagtaatccatgccaaggactggaacccagaagaagtaaaagtgaagaaaataagtggagctggattaaaagatagacccacacacaaagaggcagacaggagacttaatgtttgcaatgtttcagcttgtgggaaaaccaactgtcatgtgaatattctgcaaagaacagaaatgatatcattttmttagcaccacaattcatagtttattgaatgcttccattttccaggccttgctaagtggatcctttatttaaatttatccttataacaactctgtggggaaagttcaatcattcctctttgataggtaaggaaactgaggcttacagaggttgtggagctgtgtgagggtacaaccaataattagtagaagcagaatttgaatctctgtttgactccaaagaatgagaatgtgcatcattggtagggtgtacttagttgaatgctagaaagcagtggatgctgctgtgagataacttggct

SEQ ID NO: 171767 - DNA, 601 bp, Human
agagtgtggcaccttgtattttctgaagcatccttttctacctccaacagggagcagcaaggctagtcacagctagttctagctggacagtaatccatgccaaggactggaacccagaagaagtaaaagtgaagaaaataagtggagctggattaaaagatagacccacacacaaagaggcagacaggagacttaatgtttgcaatgtttcagcttgtgggaaaaccaactgtcatgtgaatattctgcaaagaacagaaatgatatcattttattagcaccacaattcatagtttattgwatgcttccattttccaggccttgctaagtggatcctttatttaaatttatccttataacaactctgtggggaaagttcaatcattcctctttgataggtaaggaaactgaggcttacagaggttgtggagctgtgtgagggtacaaccaataattagtagaagcagaatttgaatctctgtttgactccaaagaatgagaatgtgcatcattggtagggtgtacttagttgaatgctagaaagcagtggatgctgctgtgagataacttggcttagagcagaaagcaactcccaaagaga

SEQ ID NO: 171768 - DNA, 601 bp, Human
agtgaagaaaataagtggagctggattaaaagatagacccacacacaaagaggcagacaggagacttaatgtttgcaatgtttcagcttgtgggaaaaccaactgtcatgtgaatattctgcaaagaacagaaatgatatcattttattagcaccacaattcatagtttattgaatgcttccattttccaggccttgctaagtggatcctttatttaaatttatccttataacaactctgtggggaaagttcaatcattcctctttgataggtaaggaaactgaggcttacagaggttgtrgagctgtgtgagggtacaaccaataattagtagaagcagaatttgaatctctgtttgactccaaagaatgagaatgtgcatcattggtagggtgtacttagttgaatgctagaaagcagtggatgctgctgtgagataacttggcttagagcagaaagcaactcccaaagagagcctagagacaggtgggtggagaggagcagcagtatcctgagaatgtgttgacagtttggcaacattttatggctagatcaaaagatttctagtccagttttgccttatttttctggaggcataggt

SEQ ID NO: 171769 - DNA, 601 bp, Human
ttaagctgtatgcttatatttactggggtgggagaatttgtctttgaggaaatcagggtggagtacatttgctcttgcttcttttatttatagaaagccccattatcaagcaacctgaaaaactacagtctactatagctccaagaaaattaaatgcttgtgacaaacagaggtctcaggacacacattgggcagcccagtcttcattgcttgcaagtggctgattctcagagactgtgaaggaaaagtcttagaataaatctgaatatttatgaaagaaaaccaaagcattttagctggrcttccatctctttaaacaataccagtcacagaaatgtggtttcatagtcatttaaaatacagtttacagaggaattaagctaaaccacttaagctctccaagcagctgtgctttctcagcttccttaccgagagctgcttgcagaacatccgctttgaaatcggcagctcagtcaaaaacagagctgttgatctctgagctacttgctttttcttgtcccacacttctcaggtaatgcaaaacagtggaaaaatatttggatacgagcatatatccttgccccgctttttcatgtttgaa

SEQ ID NO: 171770 - DNA, 601 bp, Human
gaatatttatgaaagaaaaccaaagcattttagctgggcttccatctctttaaacaataccagtcacagaaatgtggtttcatagtcatttaaaatacagtttacagaggaattaagctaaaccacttaagctctccaagcagctgtgctttctcagcttccttaccgagagctgcttgcagaacatccgctttgaaatcggcagctcagtcaaaaacagagctgttgatctctgagctacttgctttttcttgtcccacacttctcaggtaatgcaaaacagtggaaaaatatttggatmcgagcatatatccttgccccgctttttcatgtttgaagcagccttactctcatgagtgtaagtgagcacctgaaaatgagttaaggtcacacagtgtgtgctttcataagccaccatataattgccagaatgaccgtttatattttgggggaaactttaggacttctgtcttcccggagaataatctggcacttaaagctgtgtacagtcagcctaacctcctctcacttgcacatgggagcccttggactcagcccgttggtctcttcactcttcactatggtcaaatcacattcctgt

SEQ ID NO: 171771 - DNA, 601 bp, Human
tcactcttcactatggtcaaatcacattcctgtccctgtgcctgtggtcttgctcttccctactcttccagtgacattccctctgctgtttaactagccccaaccccacccattccactgctgaaagcccaagactcatctcctcacaaatagttcctacagcctcttcagttcagtttcccgtcctcattctctgccttttaccaggactgtatcggttcatttggtccttgttctcaagtagaccacagggcagtctacttgagaatgaatgtctcaatcaactgttttttttttttttggtctcagaatatatatatatattcaacattcaataaatattgtttaacagaattatcagttacatggaaaagtagaaaagcattgtcaaattgagttctattttttgaaaacaaaatatgagtagcaagaaataaatagaatgaaaacaatacttgcaaattatgtaagtaaattcaaccaaatgtgacagatggaaatttttataattgttaactatgttttatttactttttataacatattttaactaatacaaaatagtgtttaggtgttggcaaatttagttaagcagtcatgg

SEQ ID NO: 171772 - DNA, 601 bp, Human
agctaatctgtaggatttagcattcagtcgtctggcctctctgggtggggcgaggggtgggggttcatccatagccaaatgcaggagagcctccttgattgctcactagcagcccaggaatctaggactcctggtgattttccccagcggttggtttagaaagtgtgcaggcttagatacatggagagcagagtgctcggcagggcatccccagtggagcagcactggaaagctggcatcaccacattatcatatccagagtcatagtaaaatgtaccttgttaaatgtgatcttggcctstaaagaaacaaaagactacttttaagacaaaacataaactgcattacaagccagggagtagggttgatgggaggactatgggacggcagtggggggaaattagagagttgggcacagctctcccagacagtgtctgaagaaaaaagactgtgtttgttcctggaacagaccaaaaagggaggatgtgaagactgatgaaataccaaagagagacttgggataaagacagttctaattgaaagggaaagaatggcaggacaaaagttcatggggaggagaaagaggagctcagtaatgaga

SEQ ID NO: 171773 - DNA, 601 bp, Human
gtcacttattagttacatgaactttgaaagtactcagatttctcacctgttaaagaggcaatagcacccctcacagggttgttttgaaaatgaaatcagatcatacatacatgtagctcacagttgctcatgactagcatgtagtagaggttggccgtcgtaatattggccatcatcatctttatcatcatgacctttgtcatgatcattatttttttggataatggtgaatattaaagatttggaattttttaaaaacgagaggtgagaaaggatagcatggtaaaagctatgctttgarggtgtcacatttttaggaggttagcttggaagagttctgaagaggcattctcactcaagtgtggggatagctgggctactctgccaacagctatgatgatgtttccagacacagtataaaaaaatagaccaacaaggcttgataatccacaattgtcaaaaattagaacagagcaggagtcttgaagccagggaaacttcacagttttggaggttcgaacttgtcagtgaccaaagtgaagtgatctgaagccaggaggtaagtcatgatggcgaggagaagtccagtccagaggaggaa

SEQ ID NO: 171774 - DNA, 601 bp, Human
gtaaagtggtcctgatctaaaaatagaacagagctcttgagcggaggtgggggcatggtgccacacatatgaaagagagctggacatggtaatatggtttggctgtgtccccacccagatctcactgtgaattgtagctcccataaaccccaggtgccatggatgggaccctgttggaggtaattgaatcacgggggcaggttttcccatgctgttctcgtgatagtgaataagtctcacaagaactgatggttttataaagggcagttcccctgtatgcactctcttgcctgctgccacrtaagacatgcctttgctcttcctttgccttcttccatgattatgaggcctcctagccaagtggaactgtgagtccattaaacctcttacctagtctcaggtatatctttattaacagcatgagaaaggactaatacacatgggtaacacatagaattagggaaatggcatccttgccagtcttttggattatgagtctgatttttagtctctattcactaataatgctatgggtttaataattcagttgtctgtagttgtgcttcctaatctttttgcattaatatcagagtatttgcat

SEQ ID NO: 171775 - DNA, 601 bp, Human
gcaagccttttagctttgacctgtttcatggccagagctatacattcacccaggcagggactgggttgataggtttattggaagtaccaggcaagaaggcctgaatggggcaccagacctgttactcctggaaaaacaattcaaagcacatttcatctatgacatcatgaatcatattactattttcattttctttactcactaggaagctttaagccacttccagtagctgaataggatggggctgctttcttgtccatggctctaatatttcccctcattagaacattcctgattattyactgtatccttttgtattatggttatttttataggccacttgaaatcctttctgcgggttgtggattatggaagagagcaaataatttaaaaagaaagctcaaaatacacttcttacccatattgggtcagtcatgtctttttttgatgcagacaaaatattttcaccctttaataaaattggtaactgaatatggtattagtcataatatgaaataatgttcctttttaaatgtgatgatcatcctgctttatttccccatctgcaagatgagaataataattatccctttgaaaatat

SEQ ID NO: 171776 - DNA, 601 bp, Human
aaaattggtaactgaatatggtattagtcataatatgaaataatgttcctttttaaatgtgatgatcatcctgctttatttccccatctgcaagatgagaataataattatccctttgaaaatatcatatggtcaaattagttaatgttggacaagcatttcaaaatgaaactacctaataatttattagtggctccactggtgtgcaatttgagaatgaagtctgcgtttgaggaattggcatttgcattaattcatgttttcccttaaattcattacagaggtctagtctgaattctcycggctgggtgccagctgtgcccatctgtggcacatggtctcgtggccttttcctccagaagtcttgtttgagtaatcagaagtcatgtcctaaaagggaaactgagcaaatgaaattgctcatgtacttctcttaaatggaatcacttgtttgctttttaattaagatgagacttttgattaaagcaaaaatctggtggcattttattttctactctgtgcccctcgagatccattgcttgaccctgaaatgaatgatctcagttatatcttaaatgacatagtgaattaactgtatttc

SEQ ID NO: 171777 - DNA, 601 bp, Human
cactggtgtgcaatttgagaatgaagtctgcgtttgaggaattggcatttgcattaattcatgttttcccttaaattcattacagaggtctagtctgaattctcccggctgggtgccagctgtgcccatctgtggcacatggtctcgtggccttttcctccagaagtcttgtttgagtaatcagaagtcatgtcctaaaagggaaactgagcaaatgaaattgctcatgtacttctcttaaatggaatcacttgtttgctttttaattaagatgagacttttgattaaagcaaaaatctgrtggcattttattttctactctgtgcccctcgagatccattgcttgaccctgaaatgaatgatctcagttatatcttaaatgacatagtgaattaactgtatttcatgtgccagcatttccttcatgttacttagataattaagttcttcctaattcagaaagcgtgacatttttgtatggtcacaaagacagccaaggaggacaaacacataataacgaactatagtaatagctatcattcattgagcacttttgttccagaagctttgtgcattattatctccagtacaaccctgaaaa

SEQ ID NO: 171778 - DNA, 601 bp, Human
tgtgttctattagatctgagttgttctccattttctttttgtgttttccatataagggccgaattttcatatatcttatgacagagtacttacctgaccattgagaaatagctacgatttcacatctgacctttattatgtgaccattcattgtttttttgacatacgcagccttccctcggacatttccctgtctcttaaacccagttttgccgctttgtcctgtcttggattccgcacgctgcacaaaaaatggccagtagagggcgctgctggcttactttttagaaaactgctcacrgcctgatttcagcactttcaaaaacatggaaattatcttaattcagtcaaagcaatcagaacgagaaaactgtcttaaattcatcaaagttgtttctttgtgtctttttctatttcgtttccccaaaggcatcaataaaaccaggcaattagtgtttcttcccttttctgcggagcccttagctgacccacagtaaggatgagtatggtagttgagggcaaccgggtgtgattatctaatttttccatcagcttgaggttcttatgtgaaagttgtattcatggagagccaaaagaaggg

SEQ ID NO: 171779 - DNA, 601 bp, Human
tttattatgtgaccattcattgtttttttgacatacgcagccttccctcggacatttccctgtctcttaaacccagttttgccgctttgtcctgtcttggattccgcacgctgcacaaaaaatggccagtagagggcgctgctggcttactttttagaaaactgctcacagcctgatttcagcactttcaaaaacatggaaattatcttaattcagtcaaagcaatcagaacgagaaaactgtcttaaattcatcaaagttgtttctttgtgtctttttctatttcgtttccccaaaggcrtcaataaaaccaggcaattagtgtttcttcccttttctgcggagcccttagctgacccacagtaaggatgagtatggtagttgagggcaaccgggtgtgattatctaatttttccatcagcttgaggttcttatgtgaaagttgtattcatggagagccaaaagaaggggaaaataaaagcctgtttacactttcactttccaaccggccttgccagttatcccctgacctggtgcaatgacgagaaaatatctgtgcgaccttggcctctggattgtggactggggacggggtgtccgt

SEQ ID NO: 171780 - DNA, 601 bp, Human
gatgaaaaatgtcttccattagctaatggctgtgttctccgtgaaacattctgccccttggcctggggctgcaggagagcatcaatcaagtctcttagatgaggcctcagaggaccaagggaaatttgtataatcctgaactgtaaacatgaggaccagtggttgaggtttttggatttgaacaacatttaaaaatgtctatttgagtatctaaagtaaacctttattttaaagagaagctgaggcttgctgggtggccttcaggaggtcagctgacctttctgcctccgtttccctgtcytcaaattggtggagggagcaaaaaaccttactcttctgttgcacaggagaatccatttaatcttgattgattacattaaataaggaagtcaggctttctttatgccacttcacaccttatgggccacattataatttccctgcctctcggtctaagtgtccactagtgatcactgcctggtgtggttttttgttggtgttgttgttcctgtgggtctgtagttttcctttcagccatttcctttctcttgttcttctcctccccacttgctaaccaaggaagaagggctaaggggctccc

SEQ ID NO: 171781 - DNA, 601 bp, Human
caggagaatccatttaatcttgattgattacattaaataaggaagtcaggctttctttatgccacttcacaccttatgggccacattataatttccctgcctctcggtctaagtgtccactagtgatcactgcctggtgtggttttttgttggtgttgttgttcctgtgggtctgtagttttcctttcagccatttcctttctcttgttcttctcctccccacttgctaaccaaggaagaagggctaaggggctccccacccttcctggcggtggcaaaacagcttcttgttcatgagggraattgtggaagcatagatgtaaaaaggagagaagtatgtgggtgtgtctgtgtgtgcacacatgtgcatgtgtgggtgtgcatgtgtgtgccatttagcagttgcctttttttgtgatggtttgttgctgttggcacctgtaaaagcagtcaagctgaagaaattcctttggaaaaagaaagaactaacttcctagaggtgaatggaaggttgctgaggccttaaggggaaaatttatagagagctgagttttctctgttttcctttgcattgcttatttgaaattcttcattgttagaa

SEQ ID NO: 171782 - DNA, 601 bp, Human
aaccaaggaagaagggctaaggggctccccacccttcctggcggtggcaaaacagcttcttgttcatgagggaaattgtggaagcatagatgtaaaaaggagagaagtatgtgggtgtgtctgtgtgtgcacacatgtgcatgtgtgggtgtgcatgtgtgtgccatttagcagttgcctttttttgtgatggtttgttgctgttggcacctgtaaaagcagtcaagctgaagaaattcctttggaaaaagaaagaactaacttcctagaggtgaatggaaggttgctgaggccttaaggsgaaaatttatagagagctgagttttctctgttttcctttgcattgcttatttgaaattcttcattgttagaacacagttttgtttaccatgccccccattattttcccttaaacaataccataaatattatcatttggggaacaacctcaatttcccagaattcatgacttttccattttaatagacaatgtatcagaacttaaatcttgtgagatcttcttaaaagagtacttctcaacagttttaggaactgttttttactctagcctttgaggacaagatgggagggacactgaaga

SEQ ID NO: 171783 - DNA, 601 bp, Human
tttaaattagacaaaagaaaacaggttctccaagatttgctatcatacacatttattattgtcataggtgccatttgcagcgctctgaataccatggttgcctttgcttataaatagacttataattttatcttacagaaggtgtttattaagaatccaaagtatgagaaagttcattccccatttttaggattgtcatgactatccttggaggaggattctctgagtaacttagtagtaggtggccgctttcacattcagtcaagaattgtgtaattttcagttgatggtttagaaacarttaaatggtctccccctttctgtgcacattgctattaatgttacagctatgttcataaaaccaagattgttatagtctttatcgacatgacattgtattttcttgcattagtaaatccagtacttttaaaagaaagttaaatatatttcctttgaggtgaaaaaacgacttttccatccaaaaactggaactgttcataagatgtgtaaaatttaccctgcatattgataaacctatcaagattttgggggcttcattgtttcatgactataaagagtatgttattatgactatgaaagt

SEQ ID NO: 171784 - DNA, 601 bp, Human
atgaagtattatctaccaatacatttttaaaaattcaggtcctgcataacaattacttactggaacttaataggcataatggctatcaggaagtgacaccaaggcatgggaagaattttgtatgttcttcatattgggcacctctttatagccgtattatttgccaaggaaaaacaagagagggtcattgctttgtactttggggccattattgagaacagttttccccattggagtgtgatgtcatcgacctattggaaagcatacatgggcactgaatggatgatttacagagcatctycccaagtttctttgcactgctgggtttatgaaatgaacatagtgattctgagatacaatcttctgtgttttgtatctcaaattgtcccattgctttggtagtcctgattaacatcttaatttctaaatgtgtgttccttccaatacaatagccactagacatatggtgctactgtgcatttgaaatgtggctagtccaacttgtgatgtactgtaagtactaaatacacactggattttgaagatagtgtgaaaagaatggaaaatatgtcaataatttttatatcggttatgtacggaa

SEQ ID NO: 171785 - DNA, 601 bp, Human
cactgaatggatgatttacagagcatctccccaagtttctttgcactgctgggtttatgaaatgaacatagtgattctgagatacaatcttctgtgttttgtatctcaaattgtcccattgctttggtagtcctgattaacatcttaatttctaaatgtgtgttccttccaatacaatagccactagacatatggtgctactgtgcatttgaaatgtggctagtccaacttgtgatgtactgtaagtactaaatacacactggattttgaagatagtgtgaaaagaatggaaaatatgtcrataatttttatatcggttatgtacggaaattatgttggattgttattagagtatattattaaggttactttcatcttttctttttgctttttgaatgtggcactagaaaattttaaattacatatgtggcttgcattgtatgtccatcggacagcagtgagctagatgggatatggcatttttctgcttctgatgagaatgcgaaatgtggaaacacattaggtcactcattagaacaattctgagtgttccttaaacttcagctaattttgatgggaggctgagaattagatcaagctc

SEQ ID NO: 171786 - DNA, 601 bp, Human
aatcatcaaaatgtgagatgaaaggatctaatgggttgtctgaatgtttttcccagccctgttggaaatgattgaggcattggctcttcaacatttcctctgagaaagcaattccaaaggttggtgtcaacttacagcttagtaatggactaatacacattatcctgtatgcaactctaaattatagcctgccagctgtgattctggaagtttggaataggttccttcccgagattctaaacagaaatggctttgaatgttgcgggcatgagtctgtctaacccttctaaaggtggcatamacgctgtaacatttctattgatttttaacatccagctctctagaaaacagaaaatagccaaaatttgacaggcattttacaaaataatctgatccttcatagatgcagagtaagagctttgttcacaagtgacatttgtgcttaaacttggatcaaaccttccttgtttctttcttatgccagttttattatgtggagttgaattacattttactggatttaaaataatgctttaaacgttattttgtcttctttagtttttctttttatcatttaaatatctgtagcctcaaactcata

SEQ ID NO: 171787 - DNA, 601 bp, Human
atgaaatttttgtaaaaatattttaacaaactgacctcatgagcaaaaactgctgtagtttttaataattctgtttacagatgattttattccagtatgtgaatcttcccaagcaaagaggggaaaaaaagtgttcatttttaaaaatgacatcatggaagtccttaaagcatctaatacaagttaatgaactctgcaaccatttatactagccctaatatattatatatacgcacctggaaagtcatccaacagatacttacctgaacttcaaaaagttgtcagtctagtaggggaggtraccgtccatacaatgagaggcagaacataacaatagtcagaagacaggcaaatctaagggctacgggagcgtcacaagggaaagggaagtgttagggatggggtgatagtagaggtggcatttgtgttaggacttaaggccattattggattaactgagaatattgaatatgaatagtggattagttaaaaatactatatagatgttaaatttattgagcttgataactgttctatgggttatggaagaatgtatccctttaattaggagatacacgaagaagtatggggatgggggaga

SEQ ID NO: 171788 - DNA, 601 bp, Human
cagtctctcctcccccaagggtaaccactacatcatagattagttatgccccttattaaattttctacaaatgtcatcatatggtacatatgcattcatggctaacatctttcatttcacattatgtttcagaagcattcatgctgttgtatgtagatgtggttcattcactaccatgactatgtagtatttcactgtgtgactatgccattatttatttatccattctgctgctgatagaccttgggaagtaactgttttgtgaactgaaatgaatactaacatctggctcttaagaaayatttcccaaggaaagggtgacagcacagaaggttagattcacgaatgctagagaagtagccctgatttctcactttttcaaagagcattgacagatggctccccatatcaagagccagcacaatctttcagaatcaggacagcccattttcccagaccatgtgatatttattctattctagcctggctggttgctaaattggtaaagatcagagagcttttgggcacagtggtgttcttagaattctgttttgctattaaatattggcctacaaatatatagctaaatgtgttttactaa

SEQ ID NO: 171789 - DNA, 601 bp, Human
tcttttaaatatgtttttaagtatagaagtaactcatgaatactttttttttttttggagacagagtctcactttgtagcccaggctggagtgcagtggcgcaatctcggctcactgcaacttccattccacctcccagttcaagcaattctggtgtctcagccgcctgagtagctggaattacaggtttgcaccaccacacccagctaacttttgcattttttgtagagatggggtttcgccatgttggccaggctggtctcaaactcctggcctcaagtgatccacccactcggcctcycaaagtgctgggattacaggcgtgagccactgcgcccggcctatgactacatttttaacttaaaagaatctaataatactgataaagagaaaattccacttgacttattttcatcagttctagtttgttccacatagatattcctttcatcagactagtttgtattgttctagttcagaggtcagcaagttctaacccaaaggccaatccagctccctacctgtttttgtaaataaagttttgttgaaacacagccacgcccatttatttacatattgtccctggctgctgtcacactgc

SEQ ID NO: 171790 - DNA, 601 bp, Human
tttttttttttttggagacagagtctcactttgtagcccaggctggagtgcagtggcgcaatctcggctcactgcaacttccattccacctcccagttcaagcaattctggtgtctcagccgcctgagtagctggaattacaggtttgcaccaccacacccagctaacttttgcattttttgtagagatggggtttcgccatgttggccaggctggtctcaaactcctggcctcaagtgatccacccactcggcctcccaaagtgctgggattacaggcgtgagccactgcgcccggcctrtgactacatttttaacttaaaagaatctaataatactgataaagagaaaattccacttgacttattttcatcagttctagtttgttccacatagatattcctttcatcagactagtttgtattgttctagttcagaggtcagcaagttctaacccaaaggccaatccagctccctacctgtttttgtaaataaagttttgttgaaacacagccacgcccatttatttacatattgtccctggctgctgtcacactgcaacagctcagctgtgtagccgcaatacagaccacatggccccc

SEQ ID NO: 171791 - DNA, 601 bp, Human
tctcaaactcctggcctcaagtgatccacccactcggcctcccaaagtgctgggattacaggcgtgagccactgcgcccggcctatgactacatttttaacttaaaagaatctaataatactgataaagagaaaattccacttgacttattttcatcagttctagtttgttccacatagatattcctttcatcagactagtttgtattgttctagttcagaggtcagcaagttctaacccaaaggccaatccagctccctacctgtttttgtaaataaagttttgttgaaacacagccacrcccatttatttacatattgtccctggctgctgtcacactgcaacagctcagctgtgtagccgcaatacagaccacatggcccccaaagcctgaaatgtttactgactagcgctttacagaaaaattttgttgatctctgttctagatcattttcgtttgcattttttatatttaaattaatatacagctaaatgttattttactattgattgtggtggcgttaatcataatgacttgtcagtctaacttgctgccagcgtcttaatttccaacatgtctgaaaggttttaaaggatttca

SEQ ID NO: 171792 - DNA, 601 bp, Human
taacttaaaagaatctaataatactgataaagagaaaattccacttgacttattttcatcagttctagtttgttccacatagatattcctttcatcagactagtttgtattgttctagttcagaggtcagcaagttctaacccaaaggccaatccagctccctacctgtttttgtaaataaagttttgttgaaacacagccacgcccatttatttacatattgtccctggctgctgtcacactgcaacagctcagctgtgtagccgcaatacagaccacatggcccccaaagcctgaaatrtttactgactagcgctttacagaaaaattttgttgatctctgttctagatcattttcgtttgcattttttatatttaaattaatatacagctaaatgttattttactattgattgtggtggcgttaatcataatgacttgtcagtctaacttgctgccagcgtcttaatttccaacatgtctgaaaggttttaaaggatttcacaatatgcaattttatatttactatttatatatgtataattgtgtctatttttacataaatggtattatatagtacatattgctcaatacctatttt

SEQ ID NO: 171793 - DNA, 601 bp, Human
ctcagcttcctgagtgtctgggcctgcaggcttgtgtcatcacacttggctaatttttaaatgttttagtagagatgggggtctcaccatgttgcccaggctggtctcaaaatcctgtcctcaagcaatcctcccaccttggcctcccgaagtgctgggattacagatgtgagccacagcagccagcacagagaatctttatttatactttttaaaaacataatctctaaatatgaaaattcatattagagtagcttcatttgtgataaaatatcagctgtcattgtctcagcaaccacarcaaagaagagtccaaatgaatccacagccggtttgagattctcattcctaacaatgccagtctgtttgttcatgtgtattaaagtatcattagaaaggaagcagcctcagatgaagccattttagccattgatgtgtctcaaaagggttaatcagatacagaaacttaacaatttctagaattgtaaggaaataattttgtttcttgtaaagcaagagtaataattgatgctcacgtgaattgacatttttggtagcttagaaatggcaccaaatgtgggttttggcaaaacctatattt

SEQ ID NO: 171794 - DNA, 601 bp, Human
gcttgtgtcatcacacttggctaatttttaaatgttttagtagagatgggggtctcaccatgttgcccaggctggtctcaaaatcctgtcctcaagcaatcctcccaccttggcctcccgaagtgctgggattacagatgtgagccacagcagccagcacagagaatctttatttatactttttaaaaacataatctctaaatatgaaaattcatattagagtagcttcatttgtgataaaatatcagctgtcattgtctcagcaaccacagcaaagaagagtccaaatgaatccacagcyggtttgagattctcattcctaacaatgccagtctgtttgttcatgtgtattaaagtatcattagaaaggaagcagcctcagatgaagccattttagccattgatgtgtctcaaaagggttaatcagatacagaaacttaacaatttctagaattgtaaggaaataattttgtttcttgtaaagcaagagtaataattgatgctcacgtgaattgacatttttggtagcttagaaatggcaccaaatgtgggttttggcaaaacctatattttcatgaagaaatggcttttaaacatgttg

SEQ ID NO: 171795 - DNA, 601 bp, Human
tctttctgtgactggtatatttcacttagcataagatccccaacattcattcatgatgtcacatattgcagaattttcttctttttaaggctgaatagtattccgtggcatgaatataccacattttctttatccattcaaatgtcaatgaacatttaggttgtttccacatcttggctattgtgaatagtgtttcaatttacataggagtactaataacacttcaagattatggttgcatctcttttggatggatactgaaaagtgtgattgctggatcatacagcaattttatttttawttttttgaggaactgccaaactattttccatagagactgcaacattttgcattcttgctaacagtgtgcaagtgctccaattaaaaagcttatgcacagcaaaggaaacaatcaacagcgtgaaaaagcaacctaaagattgagagaacatatttgcaaaccataaatctgataagtggttaatgtccaaaatatataaagaactcctacaactcaaaagtttttttaaaaaaactaataccctgattaagaaatggacgacagatttaaatagacatttctccaaaaaagacatacaaa

SEQ ID NO: 171796 - DNA, 601 bp, Human
aactgccaaactattttccatagagactgcaacattttgcattcttgctaacagtgtgcaagtgctccaattaaaaagcttatgcacagcaaaggaaacaatcaacagcgtgaaaaagcaacctaaagattgagagaacatatttgcaaaccataaatctgataagtggttaatgtccaaaatatataaagaactcctacaactcaaaagtttttttaaaaaaactaataccctgattaagaaatggacgacagatttaaatagacatttctccaaaaaagacatacaaatggccaaccartacatgcaaacatgttcaatgtcaacaattatcagggaaatgaaatcaaaaccacaatgagatattgcctcatacctgctagcatggttattattttaaaaagacaagtattagtgaggatgtggagaaatttcatgtttttttggtcttagctgaagtatacagtaacacagataatttctttctttccattaaaggagctagtcagatgtgacctcacgtacctcacatttctcataatactctcatccaactgctaaataggcaagcaaatattaaattcaagaatggtgtgtctgc

SEQ ID NO: 171797 - DNA, 601 bp, Human
atcaaaaccacaatgagatattgcctcatacctgctagcatggttattattttaaaaagacaagtattagtgaggatgtggagaaatttcatgtttttttggtcttagctgaagtatacagtaacacagataatttctttctttccattaaaggagctagtcagatgtgacctcacgtacctcacatttctcataatactctcatccaactgctaaataggcaagcaaatattaaattcaagaatggtgtgtctgcaagagaatagttattatagagaagtagttactgagaaattaatgraatatgtgtatttgtcatataaaataaagaactcataagagttcaattatatacatggctgatatgctgggaaggacaggaaaataattgggaaaactaatgtcaaaacgatagctgagtttttagtaatgaaccatttccctggacttgcattgatgatagtcacaagtagagtagctataatctaaacacttcttactaaaaataagatcctagaatatccatagactgggaagttggccatagatagtgcccagatttatagaaaccaccacagaatggcttttcatctgtatctgg

SEQ ID NO: 171798 - DNA, 601 bp, Human
ggaaattaaaaatacgattgttccaggagaaaaaaatcagacatagccagaatatggaataatctataagaatgtgaatgtctactaaaagggaatgtcattttttaaagtgtgtatggaataggtgggggacatgattggggacaagactgtattaggttaaaagattccaaagagaagtaacagttcattgtagcattattcacaatagccaagatatgcaaacaacctgtttgtccacaaaggaatggataaagaatatgtcttcacacacacacacacacacacacacacacacaccaatactattcagcaattacaaaaaaagaagaaatttgcaacatgaatgaaacttgaggacattatgctaagtggaattagacacagaaagaaaagtactaccttatctcacttatatgtggaatatataaaaattaaattcctagaagcaatgtcaattaccagaggccagagtatggggaaaatggggagatgttggttaaagggtacggagtttcagttacgtagggtggattagttctagagctctaatgtgcaccatagtgactatagttaaccatagtatattggatacttaaaa

SEQ ID NO: 171799 - DNA, 601 bp, Human
gaaattaaaaatacgattgttccaggagaaaaaaatcagacatagccagaatatggaataatctataagaatgtgaatgtctactaaaagggaatgtcattttttaaagtgtgtatggaataggtgggggacatgattggggacaagactgtattaggttaaaagattccaaagagaagtaacagttcattgtagcattattcacaatagccaagatatgcaaacaacctgtttgtccacaaaggaatggataaagaatatgtcttcacacacacacacacacacacacacacacacacacatactattcagcaattacaaaaaaagaagaaatttgcaacatgaatgaaacttgaggacattatgctaagtggaattagacacagaaagaaaagtactaccttatctcacttatatgtggaatatataaaaattaaattcctagaagcaatgtcaattaccagaggccagagtatggggaaaatggggagatgttggttaaagggtacggagtttcagttacgtagggtggattagttctagagctctaatgtgcaccatagtgactatagttaaccatagtatattggatacttaaaat

SEQ ID NO: 171800 - DNA, 601 bp, Human
atatcaaaatgtcacattgtatacctcaaatatgtacaatttttatttaaaaaaatttttccaaattcgatgtatggaccttaatttaatcttcgttcaaaaaaaaaaaagcacctatgaaagacatttagcaaacagctatagatatatgcatgtagatcagatattagagaatattggggtattatcattaattttcttggtataataatggtattatgattggtaggagaatgtgcttgagttatgagatgtttgctgaagttgttagtgatgaagcatcattatagctgaaatattstaaatggttccaaaaatattaaaacaaaaaaatgcaaaaatattattatactttaccttttcctattacaatgacaatccatttttaatgtagaagaaataaatatatacagaaaaacaagaagaaagtttacaaccaaccataaacacagctctcctccagacactgctaacaccttgatgtttgccatgtatgtataatatatacttatatatgtatacctccataatatataatatatatacactcacacacataataccctaatttattgtacccatctcctccagtgagtggagt

SEQ ID NO: 171801 - DNA, 601 bp, Human
caaaaatattattatactttaccttttcctattacaatgacaatccatttttaatgtagaagaaataaatatatacagaaaaacaagaagaaagtttacaaccaaccataaacacagctctcctccagacactgctaacaccttgatgtttgccatgtatgtataatatatacttatatatgtatacctccataatatataatatatatacactcacacacataataccctaatttattgtacccatctcctccagtgagtggagttttacttattacttgggcccacttcttccttttgrtgcctgaggctttccttaagcgtgcaaaacttggggtgcttctcaattccctcttgttgagaccttagcagtttgttttcttatccattctgtcaatgagattttcctctcatttgcattagcccagaagggcaaggagcatttttatctagatgagtgtatcttacacataacaaattggttgcatatctttgctcactgatactttatttagcaggctaatctgataaactatttctcaagttataataacattcaccatggtggtaaacttgataaagtttctgagtctcgaaaaac

SEQ ID NO: 171802 - DNA, 601 bp, Human
taggtaatccaataaagaatttcttttcatgttgacaggataaaaattggcagggagcaggggaaggtgttaacctgttagggaaaatgcaggataatcacatatggcattttattgctttggaatctttttattgtaatatcctcattttggatgaggtaacttggcatcagatagatccagcttcaaataatggctctgttactttttcaccttggacaagttattgattttttctgcccatttttctcatctgtaatatggatcatgaggtatgtatggaaatctcataggtctgttrtaaagatgtaatgagtaataaggtcatgtattgaaagctttttgtaaattattaagtgctaatggtggtgattggggtgggatgtaggtagtggttgtggtagtggtagtagcaagaattagcagtagcagaaatagtgacacaagtaaaaatattagcaatggatcaccttatttatttttaataaataaaaaaccattttttgtgatgttagggtgtcaattttggatctttcctgctttctcttttgggcatttagtgctatcagattccctctacacactgctttgaatgtgtccc

SEQ ID NO: 171803 - DNA, 601 bp, Human
aataaaacatttccactaaatttatagcatcttctatctctgctcaagattcccaattttgcataaatattccttcagtttaaatttatatttgtcgtgattcttaaatcttgataaaagagaaaaagtactcctttagaactaagtgatatgtaacagctctctcatataataaattaacttcagaataaccttcacataatgcattcattttgtttttcctttgtttataaaaaaaagtgctcttgggaaatggacaagtttctgaaacactcagttcacagcattcacttttttagcrttaaacatcaggtattttatgacccaactggcacataatgcaaaaatatatgtatatatatcttttctagtggaggattaatgaggtggatgtttattttgtggttatttttagtgaagaattagtagagtggctgtttaaagaaaacacactaacacatcaacaatatggaatgatatattctattataaagatacatggacatatatgttcattgcagcactatttacaatagcaaagacatggaatcaacccaaatgcccatcaatgatagactgaataaagaaaatgtggtacaga

SEQ ID NO: 171804 - DNA, 601 bp, Human
tcctttagaactaagtgatatgtaacagctctctcatataataaattaacttcagaataaccttcacataatgcattcattttgtttttcctttgtttataaaaaaaagtgctcttgggaaatggacaagtttctgaaacactcagttcacagcattcacttttttagcattaaacatcaggtattttatgacccaactggcacataatgcaaaaatatatgtatatatatcttttctagtggaggattaatgaggtggatgtttattttgtggttatttttagtgaagaattagtagagyggctgtttaaagaaaacacactaacacatcaacaatatggaatgatatattctattataaagatacatggacatatatgttcattgcagcactatttacaatagcaaagacatggaatcaacccaaatgcccatcaatgatagactgaataaagaaaatgtggtacagagataccatggaatactatgcagccataaaaggaacaagatcatgtcctttgcagggacatggatggagctggaagccattatcctcaccaaactaacacaggaacagaataccaaataccgcatgttctca

SEQ ID NO: 171805 - DNA, 601 bp, Human
atactatgcagccataaaaggaacaagatcatgtcctttgcagggacatggatggagctggaagccattatcctcaccaaactaacacaggaacagaataccaaataccgcatgttctcacttctaaatgggaactgaacaatgagaacacatggatgcagggaggggaacaacacacactggggcctgtcaggggggcagggggagggagagcatcaggataaatagctaatgcatgtggggcttaatacctaggtgatggtttgataggtgcagcaaaccaccgtgacacgattacctrtgtcacaaacctgcacatcctccacatgtatcctggaatttaaaataaaattaaaaatatatatggagagaatgatatttaagacaaaaagatgttctttctacctatttagattgtttaatcttcaattagcgtgtttggaaaagcacataagcatgatgatatgaggtgctgaagtaaacatgtagataaatataactaaactctaaaaatgccacctcctccacaaaaatcttcatcagcaccctagaaagaggtgtgattcttttcacttgcaatccattacatgttcaaacatgt

SEQ ID NO: 171806 - DNA, 601 bp, Human
caaacctgcacatcctccacatgtatcctggaatttaaaataaaattaaaaatatatatggagagaatgatatttaagacaaaaagatgttctttctacctatttagattgtttaatcttcaattagcgtgtttggaaaagcacataagcatgatgatatgaggtgctgaagtaaacatgtagataaatataactaaactctaaaaatgccacctcctccacaaaaatcttcatcagcaccctagaaagaggtgtgattcttttcacttgcaatccattacatgttcaaacatgtaagcartagtcacctaggctctgagcctcattcattgagtatgagggcaccattttaaaataaatttgggtggaacagagtcatagtccatacacttacagttcattcattgattaattcatgcattgaacaaatatctagtaagtgcataccctgagccaagtcctatcttagatgctaagaacactatagtgaacaaggtacagtccctgccctgatagagcttatatcttggttgaatgacaggggaagaaatgcaataaattgaagacaagtagatacagatggtggtgtgtgctatagaga

SEQ ID NO: 171807 - DNA, 601 bp, Human
caggggaagaaatgcaataaattgaagacaagtagatacagatggtggtgtgtgctatagagaagaaaaggagtggagtaaaagagacagacagctggttgggaggagagtgctctctggcataggatggatacaaaggcctccctggtctgctgatgttaggacagaagcatggagaacacaaggaagacagttctggattactggagggaatggatccaaacagaagtgatgcaaaagccctggtgcaggtagaaattttagtatttttaagggccagctcaagttaactagcttctckgagttgcaatttcctctgttgtaaaaatggggataataatagtactatgaaggacagtttgtgaagatttaataaaatagtgtgtgcaaaatacctagcgcagtgagtgttctgtgaaaatcttaggtgcatttcttctgtaaatatctactcacgtcagtgtttctgtaaatatgaactcatgttggtgtgtgtgttagtatgtgtcattatggtctctcttctttgacagcaatgtgccttttgaacagtaagcccaaggtaattaccagattgtgttccagaaaacactaaggcagc

SEQ ID NO: 171808 - DNA, 601 bp, Human
ttttgggtgggagatgcccaggatagctcaggaccagctctcctccatgtgtgttactcactccacccatgggaaatgcatgcacccatagtgaggggtggggcagatttctttccatccctcctctaaaccctgatatctctccagttccctcttttccaagcttagacaggcaaaggagctaaggcagctgaaatgctctgcataaaataatgggagaaatttaggatcagagtgggtgtttgcccttgagaggaatagctgagagaaaagaggtgaaaaacaccttttcaagcatcayggttatgtggctgagaagctttcaagaacagaaaaggccactaagtatttttaaggagtttgccctgttgcactgtaaattctctccatcttttcaaacttttaataaagtctgtcaaaaaccaggtctttgtatgtggcttttttttttttttttttttggtagcaaccaaggaaaggggctaagttctattttgtggtaaacagagctgaaatcaatgcaaagccccatgaccaacagtgggcgagtaagaatttagcagaggaaggaagcaggaaccagccatcaccatccctccat

SEQ ID NO: 171809 - DNA, 601 bp, Human
aagcttagacaggcaaaggagctaaggcagctgaaatgctctgcataaaataatgggagaaatttaggatcagagtgggtgtttgcccttgagaggaatagctgagagaaaagaggtgaaaaacaccttttcaagcatcacggttatgtggctgagaagctttcaagaacagaaaaggccactaagtatttttaaggagtttgccctgttgcactgtaaattctctccatcttttcaaacttttaataaagtctgtcaaaaaccaggtctttgtatgtggcttttttttttttttttttttggtagcaaccaaggaaaggggctaagttctattttgtggtaaacagagctgaaatcaatgcaaagccccatgaccaacagtgggcgagtaagaatttagcagaggaaggaagcaggaaccagccatcaccatccctccatctcctagagttcctcagaagtgtttcgagggcgttggatgtttcaaggcagtagtatacctatcttaatgagcaggatggccttagctgacatgtgcatgtatgtgagacttgctttgggcagcaccccagacaaagataggcactgaattctctggata

SEQ ID NO: 171810 - DNA, 601 bp, Human
tacagaaatcttgaaaatgccactgggaactcagcaacaagaggtgcctcatcaagactaagacgtagatttaagattggatccccagcggctcccctccccatcccttttatccccactttactagcaaaacctaagtaacctctttttacttcctgacctggaggttctaaactgaaatcttcaaccagcccaagggtgcacgtggccctgctcagtgcttttacgccatcctcccacagtctgtctattttgaagtgagcgctatgttatttctgtaccaggcaaaaacctttttgtwtaaatggagatataaaatttgtaggtgctacataatatgcttaaaaaaaagcttcaatatgtttttactttaccatcctgctccctctgcctcgtccttcctctgtccttttatgcattgtgttgccctgtgtctctttcttcatttttggacttgcttcagtgtgtggctgcattcagagtggagcttagggaatgactgatcacctcagaccttcagggtctgcctgtccagcagagctcagctttcactagatctcaagagtccaggggtgaccatagagcaggattatgctgggca

SEQ ID NO: 171811 - DNA, 601 bp, Human
tattggacaacatggagcatttccattgacacagaaagttctcttgggcagtgctggtgtagacagtgcttatagaatctcttggtctttggccactcatcacttttacaatgatcaggcatttaagggcataagcaataaaagctgaatgctaaaactcaatgacatttccatttttaatattctgactttatgttaaatgtcttcttgtttaaagatgtatggacaatgggccgggcatggtggctcacgccttaatcccaggactttgggagtctgaggcaggcggatcacgaggtcrggagattgagatcatcctggctaacacggtgaaaccccatctctactaaaaaaatacaaaataattagccaggcgtggtggcgggcgcctgtagtcccagctactcaggaggctgaggcaggagaatggcgtgaacccgggaggcggagcttgcagtgagccgagatcgcaccactgcactccagcctgggcaacagagcaagactctgtctcaaaaaaaaaaaaaaaaaaaaaaagatatatggacaatgactttttttgccttcttttaatatgtcttttgaatatcatatgtcagtg

SEQ ID NO: 171812 - DNA, 601 bp, Human
cgggaggcggagcttgcagtgagccgagatcgcaccactgcactccagcctgggcaacagagcaagactctgtctcaaaaaaaaaaaaaaaaaaaaaaagatatatggacaatgactttttttgccttcttttaatatgtcttttgaatatcatatgtcagtgctatgcaacatgtgctccccggaatgggtccagtccacaaactattagttatcagtctatagtgaagcaaataaatcaagagtaagcctttacaaatttttatagggatttaacattgctgtgacttccaggcattcrtgctggttttgataagtatgtgaggtgatggatatgtgaattagcttggtttggtcattccacaatatgtacttgtatgaaaataccatgttgcccacgataaaaatacacactttgtcatttttccattaaaaaataatttttaaaacaatttgcaacagattggaaattttgatttattttatgaatttttttttttaaagacaagatcccactctgtcacccatgctggagtacaaaaatgcagtcgtagctcgctgcagccttgacctcctgggtgcaagcaattctcccacctct

SEQ ID NO: 171813 - DNA, 601 bp, Human
gatatgtgaattagcttggtttggtcattccacaatatgtacttgtatgaaaataccatgttgcccacgataaaaatacacactttgtcatttttccattaaaaaataatttttaaaacaatttgcaacagattggaaattttgatttattttatgaatttttttttttaaagacaagatcccactctgtcacccatgctggagtacaaaaatgcagtcgtagctcgctgcagccttgacctcctgggtgcaagcaattctcccacctctccggagttagctgggactacacacttagctratttttaatttttaatttattttatttattatttttagagacagggtctcgctgtgttgcccaggctggttttcaaactcctggcctcgagcaatcctcctgacccagcctcctaagtggtggcaatttaaaacaagaaataaacttgcccttcaccacagagaggtgagaagcaaagatgtatgaaaatgttcactttcggaaacacattaaccagctcacgtaaaaatttcaaacaggaccagcttacgtgcaaggaacgaaagctcaattcaggaaaaagctatattaaatgtataa

SEQ ID NO: 171814 - DNA, 601 bp, Human
tttcttctctgggtacctggccacatttcaatgcactcagcccacagagaccagaggctatgtggcacgtgtatgtggagttgctacataaataatacgtagtattaagtgcttatttgctagcttctctgactaaactcagagctctgcagagaaggtggctgtacttagccacctttgctatctccctcgacttacacaacaggtgctcaataagacccttctttttttctcttttttttttttttttattatactttaagttctgggatacatgtgcagaatgtgcaagtttgttacrtaggtatacatgtgccatggctgtttgctgcacccattaaccggtcatctacattagttatttctcctaatgctatccctcctcttgccccccacccccgacaggccccagtgtgtgatgttcccctccctgtgtccatatgttctcattgttcagctcccacttatgagtgagaacatgcagtgtttggttttctgttcctgtgttagtttgctaagaatgatggtttccagcttcatccatgtccctgcagatgacatgaactcattcttttttatggctgcatagtattcaatggtg

SEQ ID NO: 171815 - DNA, 601 bp, Human
tcttcatttaattggctattggaactacatgatgcagttaaaaacatagttaataatcaagtccatcattcagttcatttaacacgataccaaatcactgctttgacatcattattttgcttcatctggtagttgtgtagccctggacatgctgagtttaaacttcagcttggtcaatggcttgttgaataatcaggaaactctgattccaaattattgatatttcttagctctaaaaacataatcttggtttgcaataggggcaatataatgaataaatgattgtaaaatacttcactaygaaatgaggctaaaatattccttatgtgaaatattactaccagaaattccccagcactcattggaactttctgtaagacatctctctgtcagaggaagttgtgagttgctgcttagaaattcagtatcagtggcatttttgtaaacctggcatttggaaagtgaatttcagaacaatcttcttcctccaccccaccccaaccctccatttatttgtatcacaaaactgcccctaaagtcaatatccccctccctaaaatgaatacattgtccaagatctttatcccctcctcctcctcct

SEQ ID NO: 171816 - DNA, 601 bp, Human
agaacaatcttcttcctccaccccaccccaaccctccatttatttgtatcacaaaactgcccctaaagtcaatatccccctccctaaaatgaatacattgtccaagatctttatcccctcctcctcctcctgctgctgctgctgctgtttgctcatcaatgcaggatttcagagttgttcgtcctccagaagctcccactcccttggtcttgtctgagaagttcttgattgggctcccatccatcagaagaaggaggaatttctggccctatagacatgcaggtgctcttgcagcccatgrtcttgcatgaactggagatgtcaggattggggaagtgactcctgcagcctgaagcctttgttgggaggagcagtcggagccaggaagcacatctgcagcaggaaagtgtttgctgattgtgggatttataagaaaggacacacccgggagtaggctctgaaaggggtgaagagctccatccccaggatcacagaacttgtccttctggctttgatctttaagccacatttaaactcacaggaaataccaccactcacgagagccttcactgggagaaagtataggctgggtgttatccag

SEQ ID NO: 171817 - DNA, 601 bp, Human
gttgttcgtcctccagaagctcccactcccttggtcttgtctgagaagttcttgattgggctcccatccatcagaagaaggaggaatttctggccctatagacatgcaggtgctcttgcagcccatgatcttgcatgaactggagatgtcaggattggggaagtgactcctgcagcctgaagcctttgttgggaggagcagtcggagccaggaagcacatctgcagcaggaaagtgtttgctgattgtgggatttataagaaaggacacacccgggagtaggctctgaaaggggtgaagakctccatccccaggatcacagaacttgtccttctggctttgatctttaagccacatttaaactcacaggaaataccaccactcacgagagccttcactgggagaaagtataggctgggtgttatccagctcgtcacaattgcaggtgtatgtcttcagtgagtgagtggttctatatgtcataggtcagagtttcctaatcttggcattattggtattttgggctggttaagcctttgctgccagagctgtcctgtgcattgtaggatatttagcagcatctctggcctctacccatgaga

SEQ ID NO: 171818 - DNA, 601 bp, Human
atatattattataagaattcaatgagagaatcattgagaagaacaatgcttaacacctagtaagtccttaacacatgttagccaagttagcagcatccccgagcccaggaagtccaactgcaaagttgatattcctaaccattttaatacactacctccttggggcaattgcatgtagattaaatggttgaaatatagattcccctaagcggacttgtgcagtgtaaggataaaaaactaggcaaaggttagatcacaggagatcatatattgtaagctagggactttggcctttatgttktttgtgaaatgagaaaatgctggaatgtttttgttttgtttttttgagacggagttttgctctagtcacctaggctagagtgcagtggtgctatttcagctcactgcaacctccgcctcctgggtttaagctattcaactgcctcagcctcccgagtagctgggattacaggcggacaccaccactcctggctaatttttgtatttttagtagagatggagtttcatcttgttggataggctggtctcaaactcctaatcttaaatgatccacctgcctcagcctcccaaagtgctggga

SEQ ID NO: 171819 - DNA, 601 bp, Human
gttagcagcatccccgagcccaggaagtccaactgcaaagttgatattcctaaccattttaatacactacctccttggggcaattgcatgtagattaaatggttgaaatatagattcccctaagcggacttgtgcagtgtaaggataaaaaactaggcaaaggttagatcacaggagatcatatattgtaagctagggactttggcctttatgttgtttgtgaaatgagaaaatgctggaatgtttttgttttgtttttttgagacggagttttgctctagtcacctaggctagagtgcartggtgctatttcagctcactgcaacctccgcctcctgggtttaagctattcaactgcctcagcctcccgagtagctgggattacaggcggacaccaccactcctggctaatttttgtatttttagtagagatggagtttcatcttgttggataggctggtctcaaactcctaatcttaaatgatccacctgcctcagcctcccaaagtgctgggattacaggcttgagccaccacgcccggccaaatgctggaattttaagcagggagatggcatgtcccaatttttatttcagaatgct

SEQ ID NO: 171820 - DNA, 601 bp, Human
ttgaaatatagattcccctaagcggacttgtgcagtgtaaggataaaaaactaggcaaaggttagatcacaggagatcatatattgtaagctagggactttggcctttatgttgtttgtgaaatgagaaaatgctggaatgtttttgttttgtttttttgagacggagttttgctctagtcacctaggctagagtgcagtggtgctatttcagctcactgcaacctccgcctcctgggtttaagctattcaactgcctcagcctcccgagtagctgggattacaggcggacaccaccactyctggctaatttttgtatttttagtagagatggagtttcatcttgttggataggctggtctcaaactcctaatcttaaatgatccacctgcctcagcctcccaaagtgctgggattacaggcttgagccaccacgcccggccaaatgctggaattttaagcagggagatggcatgtcccaatttttatttcagaatgctgacatcaacagacagggatgacctaccagtgtaggaaggcaatggccagaaagacccaccagccttctttttcttgttttcctcctagtgtatagaacactt

SEQ ID NO: 171821 - DNA, 601 bp, Human
gactgtctcacacaacttggaaccttatttcatattttgttgtttgaactatgtttagatgctttatgctcctcattcccaaatcctattgcaactaaataatagctgcttctgtgggtctttctagccctttgtttctgtgattattattaactgaaataccttccttctctttcctattgcataactttcttcctaccttgcacatttttgtggctgggtgggccactggacaccaagaagcagtaattattatcacaattaccctgccttaataactaacacgttatagccttttacactgacaaagcagctctgtatccattatctcattgtttcacacaacaattctgttatgtaaggagcacagaaattagcatccctcatttacaggtaataaagtagatcttaaagaagctgaagaacttattgtttacatgccacataacaaaatgtagtgaataagaccatactttcctgtgctgtctctggggaaaaaaataggtagataatttacctactacaaaatgtgtgatgggaaactatcctcctgggtcatggcactactaattacccaggaatccttagaaccctcttttga

SEQ ID NO: 171822 - DNA, 601 bp, Human
gaattattgttaaagggggcaatttaggttggattgaggacacccagcatgaaactgaaatgactgagaacaggcaaaaaattcatgactgcatgctctaaccactagactattttccattctgaataggacaatagtggtcattattttgttgccacagtttcattctcacactcacactgagcctttgaagtgaaatctctcctagcaccactgaggttgggaggattgctcactatttggagggattgtcagtagaaagttatgaactctctggtgaaatgctgctcagtttattctmtagagattcagattcttttgaccaacctgatgtttcaacagcttgaaaaacgaaggaaagaaccatgtctgtctagactgaccagaaagcaaaaacaagggatactttgaaatctgaccacaactgagagttgtacttagtccaagtaactggaaaatcagtttcttggattagacaaatgcttcccttaagactctcaaactactagctttcttcttttataattaatagaaaattattacactgacagacaagagacttcatatttgagccaatgggaaaacttgacgttgaaaccag

SEQ ID NO: 171823 - DNA, 601 bp, Human
gcatgctctaaccactagactattttccattctgaataggacaatagtggtcattattttgttgccacagtttcattctcacactcacactgagcctttgaagtgaaatctctcctagcaccactgaggttgggaggattgctcactatttggagggattgtcagtagaaagttatgaactctctggtgaaatgctgctcagtttattctctagagattcagattcttttgaccaacctgatgtttcaacagcttgaaaaacgaaggaaagaaccatgtctgtctagactgaccagaaagyaaaaacaagggatactttgaaatctgaccacaactgagagttgtacttagtccaagtaactggaaaatcagtttcttggattagacaaatgcttcccttaagactctcaaactactagctttcttcttttataattaatagaaaattattacactgacagacaagagacttcatatttgagccaatgggaaaacttgacgttgaaaccaggggaaataatttagcctcaaatagagttgttaatgccaggataaaagcaaacaaatgtgctaatgatcttccttgagaatctgactgtga

SEQ ID NO: 171824 - DNA, 601 bp, Human
atctgtgtggttgtaagcatctatgacaaagttggtggtgggcatgaggcagggggatgtcctgatttccatcatagaatctgccattgctctgctggcctatagaattgatgagaggggagagtttgatacagcagctgccttgatattctcctgtgcagtcatgttatcacccaacaaacattcattgccatctcccatatgcccagccctttcctaggcatatggcaaagaagagagacagtctttgctattgtggaattctcattctagtgggtctagaattctcattcaattcccrccactaaaatatgaacagacaataaatacatgcataaataaatgtagaaggtcagatagtagtcagtactatgcaattaaaaaacaagtgaaggtgaagggaaaacaagtgccatgtgccagggcacaatggatggtggtatgttgctatattaactggggttggaagaggggaggcctcacagatgatgtgacatttgaataaggaccctaaagacatcatggagaaagatgaatatttggataaagagtattccaggtacagggaataccaatgcaaaagctgtgaggtgtgagttct

SEQ ID NO: 171825 - DNA, 601 bp, Human
ctggcctatagaattgatgagaggggagagtttgatacagcagctgccttgatattctcctgtgcagtcatgttatcacccaacaaacattcattgccatctcccatatgcccagccctttcctaggcatatggcaaagaagagagacagtctttgctattgtggaattctcattctagtgggtctagaattctcattcaattcccaccactaaaatatgaacagacaataaatacatgcataaataaatgtagaaggtcagatagtagtcagtactatgcaattaaaaaacaagtgaagrtgaagggaaaacaagtgccatgtgccagggcacaatggatggtggtatgttgctatattaactggggttggaagaggggaggcctcacagatgatgtgacatttgaataaggaccctaaagacatcatggagaaagatgaatatttggataaagagtattccaggtacagggaataccaatgcaaaagctgtgaggtgtgagttcttgacaacatcaataaatgtccaagaagttagcttgattgaagtagagtcagcaaaccaaagagtggtagcccatgcattatgagatagagctgg

SEQ ID NO: 171826 - DNA, 601 bp, Human
atttaaccccacataccttgcaggatggtgggcttgctgaaagggattatcaagaaaaaaataacaaagaagatactcagtcattgttagttcttggccactcacacatttttgattgcaagtgactgaggaatcaacccaaaattacttatgccaaaagaaagtttgttggcttttataaataaaaattggccctaggcactagggtcatgctagcttcagctactgctcaatttaggttccaagttgctatcatgatcccatctcttagccctgctttatctattccttctttttcatrttccatgtggtgagccatggcagcttcagttccacagcaatacaacacccaatccagtagaggagaggagttcactttcctgatgggtgaccatgtgttctggtttagctggaacagtcacccagtccaatagaaaagaggagtctacttctataataggagatacatccagaatttcccaagacagtcacctagtccaaaggaggtggactgatggacaggatgaccataggtctggttttcccaggcactctttattcacatctgtcattgcagcttgattattaattgtacctccat

SEQ ID NO: 171827 - DNA, 601 bp, Human
catgatcccatctcttagccctgctttatctattccttctttttcatgttccatgtggtgagccatggcagcttcagttccacagcaatacaacacccaatccagtagaggagaggagttcactttcctgatgggtgaccatgtgttctggtttagctggaacagtcacccagtccaatagaaaagaggagtctacttctataataggagatacatccagaatttcccaagacagtcacctagtccaaaggaggtggactgatggacaggatgaccataggtctggttttcccaggcactstttattcacatctgtcattgcagcttgattattaattgtacctccattctctctcagaagtgtcccaatttatggtagatgtatatggtcattttactgatagtacaaagaaaaatagtctcattaatctttgcctcagatacaaagtcttcctctaaatcttaagtagtatttacttagaggagagagggagaatgtgtccaccaaagaataatagagggcctgttatcccaagaagtggggtggtggttctggatggccaaaaccacaaatgtagattacagttccccttttctcttc

SEQ ID NO: 171828 - DNA, 601 bp, Human
ctttttcatgttccatgtggtgagccatggcagcttcagttccacagcaatacaacacccaatccagtagaggagaggagttcactttcctgatgggtgaccatgtgttctggtttagctggaacagtcacccagtccaatagaaaagaggagtctacttctataataggagatacatccagaatttcccaagacagtcacctagtccaaaggaggtggactgatggacaggatgaccataggtctggttttcccaggcactctttattcacatctgtcattgcagcttgattattaattstacctccattctctctcagaagtgtcccaatttatggtagatgtatatggtcattttactgatagtacaaagaaaaatagtctcattaatctttgcctcagatacaaagtcttcctctaaatcttaagtagtatttacttagaggagagagggagaatgtgtccaccaaagaataatagagggcctgttatcccaagaagtggggtggtggttctggatggccaaaaccacaaatgtagattacagttccccttttctcttcatactgttcggtactgtttagctgtagaaatggtttgg

SEQ ID NO: 171829 - DNA, 601 bp, Human
gcatgaaccaaggtacagatggaatgtggaactgtgtgcagcagatactgtgttagtgcaggcagactggagtatgcatgtgtgtatgtgcatgcttgtgcgggggtgaacacagtagaggacatttaaacaggaagcacatattggggccagaccttagaggacttgaagactaggccaaggaactcagcttttagtctgcatgtcatagaaactatcaaatgtttccaccaggaaattgatatgaacaagttgtttgaagaggattgatcagacagtgttgtttgtagcaagagtaggygtggaaagaggttagaggtagggaacaatgaccaggtgcttcataaaaagccaaggtggccttaaccgaaaaaaaaaaaggaggtgggaaatggagagaataaagggagatgtgcaaaagaagggtatacaaagagatagaattaacaatatttgatcctgttaataaaaggaatgctagagaacatgtactaatattagtgggatgacctatatatgcagtgattgatgtgacaacagctctaacattaatagtcagagatgatgactcttaggtatggaaggtaccactctgtcctta

SEQ ID NO: 171830 - DNA, 601 bp, Human
cagatactgtgttagtgcaggcagactggagtatgcatgtgtgtatgtgcatgcttgtgcgggggtgaacacagtagaggacatttaaacaggaagcacatattggggccagaccttagaggacttgaagactaggccaaggaactcagcttttagtctgcatgtcatagaaactatcaaatgtttccaccaggaaattgatatgaacaagttgtttgaagaggattgatcagacagtgttgtttgtagcaagagtaggcgtggaaagaggttagaggtagggaacaatgaccaggtgctkcataaaaagccaaggtggccttaaccgaaaaaaaaaaaggaggtgggaaatggagagaataaagggagatgtgcaaaagaagggtatacaaagagatagaattaacaatatttgatcctgttaataaaaggaatgctagagaacatgtactaatattagtgggatgacctatatatgcagtgattgatgtgacaacagctctaacattaatagtcagagatgatgactcttaggtatggaaggtaccactctgtccttaggaacaatttccttacagcgaaaatagtgcttctaaatggt

SEQ ID NO: 171831 - DNA, 601 bp, Human
tgatgtgacaacagctctaacattaatagtcagagatgatgactcttaggtatggaaggtaccactctgtccttaggaacaatttccttacagcgaaaatagtgcttctaaatggtttctatttattttactcttttttaaactagttaacataacacaataacaattctagtatgtgaagaccttgagtgtctgccttcctttgggacagatctacagtcactcctaaaagttaaatatcatgacatctctatctctgtgactctgattttctttttcacaagcaaggttcccaccaaargaaactgcagatttgcacattgggaagacttaatagagaaagcagaagaatagagaatggaattgtctaaaagcggaagtagatagcagaagggatttgagtctgaaaaacagaggagtccctccttattttccaagcagccaagaattgcatcttcaattgttctgaattttttgctctgtgtgttgtgtgtgtgtgtgtgtgtgtgtgtgtgtgtgtgtgtgtaggcatgtgcatgcatatgtggacagctacacatatagggctgccaaggatggccataaaggctgtgtcttacac

SEQ ID NO: 171832 - DNA, 601 bp, Human
tgagaaggtccttgttctcttcctcatctctgtccttccatgcaagctgactgatccacatcaactcaattcaatacatatttactatgcatatattacatatcagtgctcttacaagtttcagaaacagctgcttaaacagtactattctctgacttcccctctcattttgaatattttctttcatttcctcccatttgcaatgccttgggtgacattccttcaggaagtaaactttccaagtactgtcatgttagagccttaggagagatctgatgtggcctagagtgttaacaggagygctctgtacgatgagaaatgtatgttttctttactctggccagatgtttctagaccagaaagtgaaggttttttcaatattagcatgtagtatatttaacaaagtgcttactgaaaatcccacaaaatatgtctttcctgcatatttttaaagcgtagaggcgctcaccttggtttgtgtaagcattcagtggtgcatgttatactttatcttggctgctgtgatacatattgggagggtggctctctctggactcccggcgaagttggcaagctgtatccaaagttggtccaaggatag

SEQ ID NO: 171833 - DNA, 601 bp, Human
ctgcttaaacagtactattctctgacttcccctctcattttgaatattttctttcatttcctcccatttgcaatgccttgggtgacattccttcaggaagtaaactttccaagtactgtcatgttagagccttaggagagatctgatgtggcctagagtgttaacaggagtgctctgtacgatgagaaatgtatgttttctttactctggccagatgtttctagaccagaaagtgaaggttttttcaatattagcatgtagtatatttaacaaagtgcttactgaaaatcccacaaaatakgtctttcctgcatatttttaaagcgtagaggcgctcaccttggtttgtgtaagcattcagtggtgcatgttatactttatcttggctgctgtgatacatattgggagggtggctctctctggactcccggcgaagttggcaagctgtatccaaagttggtccaaggatagggtggcttgagtgagttatgtgcgagagccctcactgtctgctatacaaatacatgtctaaattcacagtctgattcatcacacccgctggcaactgcgccgaccaaagtcaggttctcaactgctgctt

SEQ ID NO: 171834 - DNA, 601 bp, Human
tttgagggacatttactctggttgtagagatagatgcaaaaaactaattttacacggtatgagatgtgttattgtagagatatttacaaggtgggtggcagaataatggaggggattcacaaatctgtttcagaggaagagttaaagctgctggagttgcatcataaaggctgtaaagacaggcagattcaagacagatgctggaggtggaattgacaggactgagacccccctcttactagtccctgatggaaaaggggaattgagggcagtgctcaggtatccagctgggattccatakgaacagtggcaccattaagcaggtcagagctctgctgtggacatgtcaggtgtgaggtgcccctgagatgatcacgttgtaatgtccactacagagtctggaacctagaagggatatcttggctggagaaatcaacttataggtgatagtggaagatacaggtgtaagagctaaccagagtgagcatataatattagaaaagataaaatgagacaaaaggcattacgcaaaaagatgaaaccaaagccagaactgcaaagaatatcttccaatatattttttaaaactttaatagaactt

SEQ ID NO: 171835 - DNA, 601 bp, Human
tccagctgggattccatatgaacagtggcaccattaagcaggtcagagctctgctgtggacatgtcaggtgtgaggtgcccctgagatgatcacgttgtaatgtccactacagagtctggaacctagaagggatatcttggctggagaaatcaacttataggtgatagtggaagatacaggtgtaagagctaaccagagtgagcatataatattagaaaagataaaatgagacaaaaggcattacgcaaaaagatgaaaccaaagccagaactgcaaagaatatcttccaatatatttttwaaaactttaatagaacttgaaggggttaagcctttttctattaaaaatttaaaaatatgttataagaagaatcaccatctgaatatccatacatggaattatataaaagtggccagggcatttgttcttaagttgaaaagaacatatccaaaaaaacaaacaaacaaaacaaaacagaaaaactcaggtctttatatctctccaagtctattctccaataatagtatactagtaagcttgatttagaattgcctctgtgtccttgccagtttacatcttggaagcttgtttctattcatt

SEQ ID NO: 171836 - DNA, 601 bp, Human
cagaaggaacaggtttgaaaaagcgtggggaccgagggagctctggaacactgggcctctggaacaatcttgccaggatgttgggcgtcactgctgctactgcgttttcctccaaaatgaatcctaacttttttctcagctctgactccaaggatccaaagacaaagcctgagttaggagcgaccagtctgactccccagatcctgtctgtgccctggccaccaggagatgaacagcaggaaactctttccccctgggcttcgagagaggaaagtaggatccagcatatcaccaatccggattgctgcaaagggaatatgccccagacagaaaggggttttgcattatactgtattgccaaacactgacaaatgttccactgcactccccttcaaatacctcacatttgtaaggctatcaaaacaagtcagcgagcagaggactgctgcatactaaaactgtctacgtcggcttcattcagagccatggactagtggaggaaacgaactcttctggagctcaggcaaagggtcgagcctcgtgctgagtgtgttatctgtgattgctgcataatatgtagttactcattcttagacctctg

SEQ ID NO: 171837 - DNA, 601 bp, Human
attttacttagttattcttacaacaacgtgttttaaggaaggattattatcccactccagcagatgagaaatgggggctcagagagttcctatgaattggataaaacccaggggccagcaagtggtggactccagcctggaacaagatcaaatacttcctttagggtgctgctctcacctaagctgtgaatctttctggctgggggaattaacacttcatattaagcattgccggccaggtctcaaagcagtggattccagaatgaaaattagaacagaatgtggttgtagaatacctgayaaataaaataatccattatgtacagctctcaagggtgagaagcataccttctcagctacaacttgtatttgttcacctcctgagtgtggaagaacaatccatgttgaggccatgcaagtccacctcaaaaagtccctgcaaagcctccttaccttgcaatagaacattgcagctgcttgtatttcagtcctttctccatggcatttctatttcacatcatgctgtggttcaggaggcagtttgcatagtggttaaagatcacagaccccaaaacaggcagagccagacagaacttgaagc

SEQ ID NO: 171838 - DNA, 601 bp, Human
atacttcctttagggtgctgctctcacctaagctgtgaatctttctggctgggggaattaacacttcatattaagcattgccggccaggtctcaaagcagtggattccagaatgaaaattagaacagaatgtggttgtagaatacctgataaataaaataatccattatgtacagctctcaagggtgagaagcataccttctcagctacaacttgtatttgttcacctcctgagtgtggaagaacaatccatgttgaggccatgcaagtccacctcaaaaagtccctgcaaagcctccttrccttgcaatagaacattgcagctgcttgtatttcagtcctttctccatggcatttctatttcacatcatgctgtggttcaggaggcagtttgcatagtggttaaagatcacagaccccaaaacaggcagagccagacagaacttgaagcgggatgtggttgcagttccttcgggggaaattattctgtcttctcatctgtaaaactgggctaatggtactaagttctgataaataaattagattatacaagtgatgcactcatcactgccttaagtgttagtgaatatctcctgtatccc

SEQ ID NO: 171839 - DNA, 601 bp, Human
tgagcgaacatatggggtggaggaagaagcaaagtcatttcttttcaactctctttgaaccaatgaaatcaataacctacatggagtacaataccatatttaaagactgaaagcaaattttaattttttatgtcgttttattttctataatttggattttcttgtgacaccttgacactcccttaaaccttctacactgtgcctgatgctttcaaacactatataatggaaggggcctctaggaaaggcaagttgagagtagaggaaaaatgagcatacatttgcatagggcaggaagggsactgtaacatctggcaggggtagccaactcagtcgacttgttagtctcattaaattcacattaatgcatgaactgctctgaatgtgtaaataccattttgagttgttttctcccagaccaatggcattgactttgggggcccttcccttggttgtttacttgccaatggcatttgacctggggtcagacctgtatttaaccctttcctgtaggtcaaaaacaaattaatttggtgagaattaaattggaaatgagtcatctgtacaacaggtgttccctgtgggaaatgtgctccaggtg

SEQ ID NO: 171840 - DNA, 601 bp, Human
tcagtcgacttgttagtctcattaaattcacattaatgcatgaactgctctgaatgtgtaaataccattttgagttgttttctcccagaccaatggcattgactttgggggcccttcccttggttgtttacttgccaatggcatttgacctggggtcagacctgtatttaaccctttcctgtaggtcaaaaacaaattaatttggtgagaattaaattggaaatgagtcatctgtacaacaggtgttccctgtgggaaatgtgctccaggtggaaacattttaaaatctgttcctgggccrtcttcgaagaagcttcagaggtcagggaggcaattccaagacatcccacgtggtgagggcctggagctggatgtacaggtgcccattcagtatggttttctcaacagcttggggaaattttcaaagaggccccttttggagataatttattcataaattcatgaacatttatcttgggcattcattgtggactgatttacttagatgttgccctaaatgattggaactttaccctttacccctacctcccactatcaaccaaagactttgatttggaggaaagaaaatattgtatttttc

SEQ ID NO: 171841 - DNA, 601 bp, Human
ccttggttgtttacttgccaatggcatttgacctggggtcagacctgtatttaaccctttcctgtaggtcaaaaacaaattaatttggtgagaattaaattggaaatgagtcatctgtacaacaggtgttccctgtgggaaatgtgctccaggtggaaacattttaaaatctgttcctgggccatcttcgaagaagcttcagaggtcagggaggcaattccaagacatcccacgtggtgagggcctggagctggatgtacaggtgcccattcagtatggttttctcaacagcttggggaamttttcaaagaggccccttttggagataatttattcataaattcatgaacatttatcttgggcattcattgtggactgatttacttagatgttgccctaaatgattggaactttaccctttacccctacctcccactatcaaccaaagactttgatttggaggaaagaaaatattgtatttttctctttcttttttctagaggatgaggaagatgaggaaatggtggaatctaaagttggccaggactcagaactggaaaatcaggacaaaaaacaggaagtgaaggaaggtatgatatgg

SEQ ID NO: 171842 - DNA, 601 bp, Human
ttttgaaagaatctctagcagatataatcgtggcgccattcacacgactgcatagtagttagggctgtgtcagcacttccattacgaaccttgcgtttcaaggatttattactcagccataaagatttgctctgggctgaaacttgacatacacagtttcaaaccagggaacacatttttgagaaatctggcttttttttttttttttttttttttttggagtgaaaaggaagaaaaaggtggtgagggggacatggggaaaataatcagtactcactaacttttgacatttttgcccacrtgacatcaaagtgcattaaacactaaagaaatgcagtcttgatttattactgtttcacttttttctgccatagagtaggaaaaaaatcaggtatattttagcttataatcaaagtttagaaaacttctatatgtcagtgtcctcatgtcttcatgtttagaaattcaaaacaatacaactgggaacctaacatttttgtaaatacaaatcaactcataaacctcacattgacgtcaaagaaagatgtccttcacttttagtttggtttggtttcttgctgctgtttatgaactgatttca

SEQ ID NO: 171843 - DNA, 601 bp, Human
gggggacatggggaaaataatcagtactcactaacttttgacatttttgcccacgtgacatcaaagtgcattaaacactaaagaaatgcagtcttgatttattactgtttcacttttttctgccatagagtaggaaaaaaatcaggtatattttagcttataatcaaagtttagaaaacttctatatgtcagtgtcctcatgtcttcatgtttagaaattcaaaacaatacaactgggaacctaacatttttgtaaatacaaatcaactcataaacctcacattgacgtcaaagaaagatrtccttcacttttagtttggtttggtttcttgctgctgtttatgaactgatttcactgtaaaattcccatgagagccactgtccttatttaatctaatgtttttcctggctacatgggttttattttttatctcttagagatccttgaaaaatatttttgaataatttttatattgaaatttaaagcagcatcactgaaacaagtcaggacatatttgtagtagatatttttaaaatatcttttaacagaaatgagatactaaaaaactcagtataagttgtgaacttcattataaattgt

SEQ ID NO: 171844 - DNA, 601 bp, Human
tcactgtaaaattcccatgagagccactgtccttatttaatctaatgtttttcctggctacatgggttttattttttatctcttagagatccttgaaaaatatttttgaataatttttatattgaaatttaaagcagcatcactgaaacaagtcaggacatatttgtagtagatatttttaaaatatcttttaacagaaatgagatactaaaaaactcagtataagttgtgaacttcattataaattgtacatttttatagagggaaaaaaatcacaagaaggcagaacccaaaagatatmgtttaaagtagtataaattaattaaagagaaactgacaaagtatacattgaggatagcaggaaaggtcaagaaaacacggcaaatgaaatacaatcatgcttgaaagatttatttaaaagtattttcatataaaaaataagaaaaattaacatttctacaataaaaagtggaccctaagtgaaatttatattctattgtaattttgcaggccacaaatttgtagaattaggctgtcttctgaatttcatgtattctgtaaaatttctttcatacatgttattcaaattcaatataactgg

SEQ ID NO: 171845 - DNA, 601 bp, Human
ctcttagagatccttgaaaaatatttttgaataatttttatattgaaatttaaagcagcatcactgaaacaagtcaggacatatttgtagtagatatttttaaaatatcttttaacagaaatgagatactaaaaaactcagtataagttgtgaacttcattataaattgtacatttttatagagggaaaaaaatcacaagaaggcagaacccaaaagatatagtttaaagtagtataaattaattaaagagaaactgacaaagtatacattgaggatagcaggaaaggtcaagaaaacacrgcaaatgaaatacaatcatgcttgaaagatttatttaaaagtattttcatataaaaaataagaaaaattaacatttctacaataaaaagtggaccctaagtgaaatttatattctattgtaattttgcaggccacaaatttgtagaattaggctgtcttctgaatttcatgtattctgtaaaatttctttcatacatgttattcaaattcaatataactggttaaattttggtaactttgaaaattgtcttatcatttggattacatgtaagttacatccatgcattctacttttcatag

SEQ ID NO: 171846 - DNA, 601 bp, Human
ttaaagcagcatcactgaaacaagtcaggacatatttgtagtagatatttttaaaatatcttttaacagaaatgagatactaaaaaactcagtataagttgtgaacttcattataaattgtacatttttatagagggaaaaaaatcacaagaaggcagaacccaaaagatatagtttaaagtagtataaattaattaaagagaaactgacaaagtatacattgaggatagcaggaaaggtcaagaaaacacggcaaatgaaatacaatcatgcttgaaagatttatttaaaagtattttcrtataaaaaataagaaaaattaacatttctacaataaaaagtggaccctaagtgaaatttatattctattgtaattttgcaggccacaaatttgtagaattaggctgtcttctgaatttcatgtattctgtaaaatttctttcatacatgttattcaaattcaatataactggttaaattttggtaactttgaaaattgtcttatcatttggattacatgtaagttacatccatgcattctacttttcatagtgtagaatctacttcttcttaaagagctctttaaatgcacaaagtattg

SEQ ID NO: 171847 - DNA, 601 bp, Human
agaaatgagatactaaaaaactcagtataagttgtgaacttcattataaattgtacatttttatagagggaaaaaaatcacaagaaggcagaacccaaaagatatagtttaaagtagtataaattaattaaagagaaactgacaaagtatacattgaggatagcaggaaaggtcaagaaaacacggcaaatgaaatacaatcatgcttgaaagatttatttaaaagtattttcatataaaaaataagaaaaattaacatttctacaataaaaagtggaccctaagtgaaatttatattctrttgtaattttgcaggccacaaatttgtagaattaggctgtcttctgaatttcatgtattctgtaaaatttctttcatacatgttattcaaattcaatataactggttaaattttggtaactttgaaaattgtcttatcatttggattacatgtaagttacatccatgcattctacttttcatagtgtagaatctacttcttcttaaagagctctttaaatgcacaaagtattgttagctgccagttcttggcagaaacactccatgttttgtgttgtgaaaacaaagaaaaaaaatctgc

SEQ ID NO: 171848 - DNA, 601 bp, Human
agatttatttaaaagtattttcatataaaaaataagaaaaattaacatttctacaataaaaagtggaccctaagtgaaatttatattctattgtaattttgcaggccacaaatttgtagaattaggctgtcttctgaatttcatgtattctgtaaaatttctttcatacatgttattcaaattcaatataactggttaaattttggtaactttgaaaattgtcttatcatttggattacatgtaagttacatccatgcattctacttttcatagtgtagaatctacttcttcttaaagagytctttaaatgcacaaagtattgttagctgccagttcttggcagaaacactccatgttttgtgttgtgaaaacaaagaaaaaaaatctgctataatagtattttctgcttaacctataagaaaaactattatccatgcccacattttgttttggtatgccctttgctattaaatcctatctttttaatgccatgaacttgttaaaaataatttattagattccagggatagggaaaagctgtagaaacagatacttgaggtagaatatggcatctatcttggagtaaaacaattctgattc

SEQ ID NO: 171849 - DNA, 601 bp, Human
gacctccacctatttccccactacctagcctaagtctgagtgtgcatattgtctgattcagcatttcacaaactagtgtctcagcagcactgctcagtagaagttaatggggtccttggaaagtctcagtacacactggaatatttagggctctggagacctagacagcaaagaaatatttctaattttatttagggctgctagaaactatgaggtggggtgtgttaggagaaattcttctgctataatggatgaatcacgtgttgccctaatattacctggagagcatttcttaaggtgygaaccaactacatcaggatcattctagtttcttgtacaaatagagattctcgtgtttctccagaccccctgcctcatggtctggggcagggaaggggaggctagaaagagggagatgttacgaacattggatccactgccatgacttgactctgtagaagggcttcttgacactacagatttcttaggcttcaagatacaattagtccaattatgtaacactttcataaaatattgtgctacaggtgatagtacctaaaagattcttctgaccatgtggccaggtggaaatcgattttgt

SEQ ID NO: 171850 - DNA, 601 bp, Human
caaccatcatcctggggagaataggagggactatatgagccttataaacataaatatagctgttcttagccacagatctcttttggccaagaatgatatgtgaaggtagggtcacttgcctttttcatcaggcctgattttttttgccatttctaaaatccaaatacattcttaaaggacgatatcttatcatcattgaggatgctcaagggaatgtaacagaggcatgaaaaccaatttcaaaagggagtcctgtacatgttctcaacagtaggcagcatctttagactaccttgaagaracaacagtattttgaatatagatgctctacaatctttgtgtttttttgaaaagccatttttctatgactttcttgattttgttggtcctatttccctctgtgtgcctggctcagtattatcctaggctcctggcaggacgtgtgtgtgtgtgtgtgtgtgtgtgtgtgtgtgtgtgtgtatctcctgagtttgcaatggcggagctgaggaagggttaacagaaaaaaaaatgtcatattaggtttactaattagagcccaaataacttgttggaagccaggtcacccagtctgaacaag

SEQ ID NO: 171851 - DNA, 601 bp, Human
ccttgatagcagagatttctaataagccctgcttcaggccagagcctttcagggagaggctctggcctgaaccagggttggagaaagcttgggactggtcaagatgggaacttgaaacaaatctgacatttcataacagtcttggaacgacatggaaacccttgccaggtcaggttagaaagagcttttcataaagaagaccatctttagttcattaattttgatcagggtatgtagtctagattaacattttggcctcagagagtattgtgtgccaggcttttgccatatcagtgcttcyatatgagcagcatagagaaagagctccatatttatctctgatgtttaaatcctcctagggatgttcaggctggagccaatctttctttcaatcgtcagttctatgatgaacattggtccaagcatcgagtggtcacttgtatggactggtccctccaggtaagaattattgctgggctgggacaaactgggcttgtgttctcgtggcatttgtataaaaaaataagagatttgtttacttgcctacgatttcctctctatgcctgttggtttttttcccctcattttattgaggtttcag

SEQ ID NO: 171852 - DNA, 601 bp, Human
tgctaggtaccaaacaagaagccagattgttctgtccatgaaactattccattaagattaccactgatttcctacttgtcaaatcctgtggatatttttaatcccacatctgtcctgacctttctttgtcaagcagcttagtcagcttccttgtgcctatagaaacatcctctttccattgaattctcactactcctctctactgtctcctagttctctgacttctccaggatttctttttcctctgaccatccttgaggtccctgtggtcatgctctcaacccctgctcttcttcctgakgtgctctctgcaggagatctcttccactgctaaggattcaaccacgaacagcctatttatatctcccgcccaatctccctgctgaatttcactttgtacaccagacagagccactattctaggtgtcccatagaatcttaaatgaattagtaactcattattttcatatatcccaaatccttttttacctgttatatgatctgtatgttaaaggcaccacaatatacccaaaagcctaaagcagaactttcatcaacattgccaacttcctcttctcttccagacccagtctgtcacgaa

SEQ ID NO: 171853 - DNA, 601 bp, Human
tcattattttcatatatcccaaatccttttttacctgttatatgatctgtatgttaaaggcaccacaatatacccaaaagcctaaagcagaactttcatcaacattgccaacttcctcttctcttccagacccagtctgtcacgaagactttccatgtcttcactcatgtattcatcatctaatactattcttaaccttcaaactgatatttctaccttcatgcttgtccacatacagttttcccctggagaaatctacccaaacaatctttctaaaataaaaatctgatcactcggctgsgtgaggtggctcaagcctgtaatcccagcactttgggaggccaaggcgggtggatcgcttgaggtctggagtttgagaccagcctggataacatggtgaaaccccttctctactaaaaatgcaaaaagtagccgagtgtggtggcaaatgcctgtaatcccagctattcgggaggctgaggcaggagaattgcttgaacccaagaggcagaggttgccactgcactccagtctgggtgatgcagtgagactccatctcaaaaaacaaaaaacaaaaacctgatctcttcattccctagac

SEQ ID NO: 171854 - DNA, 601 bp, Human
ttccacacagggtctcgcatgatgtttgtgttggaggaagtgaagttggaaataacagaaactctaccatggagagaccacatttattttcccctatttttgtgtgacctgcttacctacgctgtggggaagaggtttgcaattttgaaaaatgtgttgtatatgaggcgtaagaaaaagagattagaaccctcacctcctgcatcacaacactgttgaggggttcaaaggaccaggattacatacttatgggataaagagactttttgatggatttagatgcaatcgaatgatattaagraagaagagagatagaggaacagtcttggtgtgcagtggtggcgtgtgtgtctaggatgatttcctgaatgtaacagaatagaactgagaggagaaaaagaaagaaattataaggtttcagcatagctttcctttgatctcctgggcttcttaaaccagaacactttaactttgaaatatttacaaaatatcatcaaacatcattccttggaagaaatctgggaagctggaggattatgtcaactttgtcacccattgaacattatttaacacagtcagtcaataatactatcacatacca

SEQ ID NO: 171855 - DNA, 601 bp, Human
atacttatgggataaagagactttttgatggatttagatgcaatcgaatgatattaagaaagaagagagatagaggaacagtcttggtgtgcagtggtggcgtgtgtgtctaggatgatttcctgaatgtaacagaatagaactgagaggagaaaaagaaagaaattataaggtttcagcatagctttcctttgatctcctgggcttcttaaaccagaacactttaactttgaaatatttacaaaatatcatcaaacatcattccttggaagaaatctgggaagctggaggattatgtcarctttgtcacccattgaacattatttaacacagtcagtcaataatactatcacataccacgtgacagttttcagatgtgtgcagaatcagactcatgatcttactcccaccatgtatactcactcctctcacatgtacattgcatcttccactcctgcagtcatccaggatgcaaacctgagtaatctttggcaactcagttagttgctaaatccaatcaaatttacaacagcaaaaagattactattgacaccagtgccaatccacgaacatggatttgacacctactttatgtcatgcc

SEQ ID NO: 171856 - DNA, 601 bp, Human
gctgtcatctgtcctaataacctacccacttgacaaggctcaaggtctcatttcttctgagaaatccctttcaatttctcttcctgccacaccccacaccagcttccatgcttatttatttatttattttgagatggagtctcactctgtcaccctagctggagtgcagtggcatgatctccccttactgcaacctctgccttctgggttcaagcgttctcgtgcctccccatcccgagtagctgggattacaggagcaagccaccagggctggttaatttttgtatttttagtagagacrgggtttcaccgtgttagccaggctggtcttgaactcctgacctcaggtgatccaccctcctcggcctcccaaagtgctgggattacaggcatgagctagcatacctggccccatgcttctacagaaccttgcttctgcctctgtcttagcacttgtcatggtctgcttttttatttgtcttgtagttacttctacgtgtgtcttacctccctccatctaatgataagttcctatagagaagagcctattattcagggcattcatgtcacatattttacctgtcatggtgccttacatatt

SEQ ID NO: 171857 - DNA, 601 bp, Human
gtagctgggattacaggagcaagccaccagggctggttaatttttgtatttttagtagagacggggtttcaccgtgttagccaggctggtcttgaactcctgacctcaggtgatccaccctcctcggcctcccaaagtgctgggattacaggcatgagctagcatacctggccccatgcttctacagaaccttgcttctgcctctgtcttagcacttgtcatggtctgcttttttatttgtcttgtagttacttctacgtgtgtcttacctccctccatctaatgataagttcctatagasaagagcctattattcagggcattcatgtcacatattttacctgtcatggtgccttacatatttataggggacacttgaggcatgccacagcagacaggaaaggagaaggcttttgaagcccaacagactttaagtggggttcttgctttatcacttattagcaacatagcatggaatatgttatttaacccaggactctgggtttctttgtctgtggaaatgagtaaaccattgcctaccttagagggttatgaggaccaaatgaattaacatatcagtgtctggttcataacgggcact

SEQ ID NO: 171858 - DNA, 601 bp, Human
tgatccaccctcctcggcctcccaaagtgctgggattacaggcatgagctagcatacctggccccatgcttctacagaaccttgcttctgcctctgtcttagcacttgtcatggtctgcttttttatttgtcttgtagttacttctacgtgtgtcttacctccctccatctaatgataagttcctatagagaagagcctattattcagggcattcatgtcacatattttacctgtcatggtgccttacatatttataggggacacttgaggcatgccacagcagacaggaaaggagaaggyttttgaagcccaacagactttaagtggggttcttgctttatcacttattagcaacatagcatggaatatgttatttaacccaggactctgggtttctttgtctgtggaaatgagtaaaccattgcctaccttagagggttatgaggaccaaatgaattaacatatcagtgtctggttcataacgggcacttaaaacatgatggttccttcctctccagtaaatgctaggttcttttttttttgacggagtcttactgtgtcacccagactggagtgcagtggtgcactcttagctcactg

SEQ ID NO: 171859 - DNA, 601 bp, Human
cctcctgggttcaagcaattctcctgcctcagcctcccgagtagctgggattacaggcacacacaacctggctaatttttgtatttttagtagagaaggggtttcaccatgttggcaaggctggtctcgaactcctgacctcaagtgatctgctggcctcaacctctgtgttggaggcctcaacctctgccggcctcagccactgcgccccaactaggtttcatttatttgttagaaaaaaaatggggttgagagcatatctggtaatttccaggtaaaattctcctagggtaagtattgrataattcagctctatgagtaaccaaatgatcatgaatttcataattctttatattctctttaaaaacataacttcgaacaacacttaagattaaataattgtttagagattttttattggaaaaagaaaatatgactagtcatgttcaaacaaacagtggaaaaagacatactagagggcaccttgaaatcccaaaaacttgcgtgagataaaatttaaatcagtatctttaggccttatgatctcagttatagaaattatgccaatgacatttcactggtaattttactaaagcactcc

SEQ ID NO: 171860 - DNA, 601 bp, Human
ccgtctctactaaaaatacaaaaaattagccaggcgtggtggccggcgcctgtagtcccagctactcaggaggctgaggcaggagaatggcgtgaacccctgaggtggagcttgtagtgagccaagatcaggccactgcactccagcctgggcaacagagcgagactccatctcaaaaaataaataaataaataaataaataaataaataaataaataaataatgtagaatggctggcctgggccaggcgaatgttagtgcaagaccctaaaatagggaacatggaggagcagtaggtttygtgtggaagtcaatgagatcatttttctatgtgttacaattgatgggtctatggacagccctgagaaatccccagtaggcagtcagatataaagacctgcatctcagagagaaattaagcctagagatatagatttgaaaattaccagcatgttaagcttattaaagccactggagtagatgaacttactcagcgagaatagccctccttggaatttatgtaatagaaggagaacctgcaggaactgaaaagagaagtcagggaagaaaatcaggagagaaagatgtaatggaagccaat

SEQ ID NO: 171861 - DNA, 601 bp, Human
tgtagctggcatggggcaagacttaccactcgtatttcttgagttgctgggaaatatagatgctgtttctggtttgaaaatgcagagataatttcaaatatgtttgtatttttcattccttctctctgcggacacgtcttctcttccccttgacacaatacaggctgaaattatggtacccttgtacacgttcagcattgctctgttgccatgactctgcctaaataataggcctcagcataggccaatacaccaacccctttattaatgctcctatcctgtgattatgcacaggcaaatraaaaacaaacatttcagctcaaaattgcagttcctcaaatgttaacaattcagaggtactgagtggcagattactctgaatacaaagacatcatttgaagagggtgggtaaacctgttgatttttggaagcttagtgccattttctatctaagagccaagtatctttttgaactaaaatatgtttagactttagagcattatcagatataatttggggaataggagctgctggaatagagtcccagcctcaacctgattgagtaacctctaactctggccatgtttttctaatttgctgt

SEQ ID NO: 171862 - DNA, 601 bp, Human
ttattattctctttttccagttgagagattttatactttagaggttacccagctagtgagcagtagagccaatcctggaactgaggcttattctatcgcatacatcgtgccatcacctaggctgcattctaaaaatgtgggcagacatgggacttgatagcaaaggctgtacagcccattcaaggtatatttttggccacctacccttataaggtatcgattagacatggttctagacgtggctatctttaccaccttctaaccctaaatggaaatttagagatcccacagaattaaaatrtatatgtggaaaaaccaaagccttcactcactgacctataacttttcttctatcctatctgatctttgctaaatcttatttattacaactggtcatttctagacactaactcagggaaatcacgtcgtttgaatgtgcttccgcattctcctgtgatgttctgataatttcaaaattagacaattcattacttagaaaaagggcagaggtagagagtagcaagagtaccttatgatgactgtacttttataattttggagtaattgcgtagctattcatttcctgctgatctctgctgat

SEQ ID NO: 171863 - DNA, 601 bp, Human
gcttccgcattctcctgtgatgttctgataatttcaaaattagacaattcattacttagaaaaagggcagaggtagagagtagcaagagtaccttatgatgactgtacttttataattttggagtaattgcgtagctattcatttcctgctgatctctgctgattcttcatattttttaaaagtgtataattgtaaacaaaaccaatggatcagagaagcattgtgtcagtcagtggaaagcaaatgcacaagaaacagacatcagctccatggtgttttgtaaagactgacaagcttttwgcctactcataaaaagattttagtatatagtttcatttctctctgttatggatagcaaggccaaaaagtatcttctactgtcacaggcagtttttgtgtctttactaaactgaatttttagtgtgatctctggtcctgcattttctatttttatttcaataaaagctgtctgtacttggaaaatattggtggaccctgcatagaaatcagccactcagccccataacacactctggcagtgctcctgctgtcttctgtagtggcttccacacactgtcattagattatgtgtctgaccac

SEQ ID NO: 171864 - DNA, 601 bp, Human
tggggtaatatcagctaacctcgtttgtgtcagtgtttaaagccctcagtctttattccttcatgggctttgcttcccgttaagattctataaagggtacagatgtcattgctgcacacggcctcagctgcccagtgtttgattctgtatgacgttcctgctaacctcaaagagagttccgcctgtgaagagtgatggtaacagaggagggagtgtgggctggtggttaggacagggacagaaagttaggactcggagttccattcctagctgactgcactgctgagtgaccctgggtgaktcatgggggctttattgttgtgtttcctgatcccatgcaaagaagactttctctagtctctggttcaattgtaaagtttatttcagtaaacctcatttcttcctccatcaatttttgtccctcccccaacccagattgtggtctgtaatccaaatctacaaaacggctgtggacacagagatataaattaattgacattaactttgtaaagtatattttgaccagagaagtgttagaatctccttaaggatttttatttatttttttaaatgaaaagaatagtaacttgcttatggccca

SEQ ID NO: 171865 - DNA, 601 bp, Human
aagtttatttcagtaaacctcatttcttcctccatcaatttttgtccctcccccaacccagattgtggtctgtaatccaaatctacaaaacggctgtggacacagagatataaattaattgacattaactttgtaaagtatattttgaccagagaagtgttagaatctccttaaggatttttatttatttttttaaatgaaaagaatagtaacttgcttatggcccatctgataaaaagaaaagggcatcttctaagcttttctcttggctaggctaagaagtggttattacaggtcaaaraagaaaaacagataaaagaacagaaagttctttgacaattactgcttcatatttagtatgaattcctgggattcaaaatgaaagcacatagtaggtgctttataattgccaaataaactccatggctaagaatatgaaaaccagagtgagacccaaacagttttcaaatgtgatattcaaagtgcctcaggatgggaaaacagaagaggaaacctcaaccagtgttacattgattatcatacacattttgaagaataaaatcatggaaaatttaaacttaacttttgacataaaggtaaa

SEQ ID NO: 171866 - DNA, 601 bp, Human
aaatctacaaaacggctgtggacacagagatataaattaattgacattaactttgtaaagtatattttgaccagagaagtgttagaatctccttaaggatttttatttatttttttaaatgaaaagaatagtaacttgcttatggcccatctgataaaaagaaaagggcatcttctaagcttttctcttggctaggctaagaagtggttattacaggtcaaaaaagaaaaacagataaaagaacagaaagttctttgacaattactgcttcatatttagtatgaattcctgggattcaaawtgaaagcacatagtaggtgctttataattgccaaataaactccatggctaagaatatgaaaaccagagtgagacccaaacagttttcaaatgtgatattcaaagtgcctcaggatgggaaaacagaagaggaaacctcaaccagtgttacattgattatcatacacattttgaagaataaaatcatggaaaatttaaacttaacttttgacataaaggtaaaattaaactcttacataaaagatacaacttacatggatcagaccagagaaatagtgccacaacattgctactttgtgcc

SEQ ID NO: 171867 - DNA, 601 bp, Human
caaaatgaaagcacatagtaggtgctttataattgccaaataaactccatggctaagaatatgaaaaccagagtgagacccaaacagttttcaaatgtgatattcaaagtgcctcaggatgggaaaacagaagaggaaacctcaaccagtgttacattgattatcatacacattttgaagaataaaatcatggaaaatttaaacttaacttttgacataaaggtaaaattaaactcttacataaaagatacaacttacatggatcagaccagagaaatagtgccacaacattgctactttrtgcctttcggaaaaggcataagggaataccagtatacatggtgaaatgaaatgcagacatcccaaaacacttcttttctgccaattgagaatgaccgatccgatgagctagacagtgattcttattaaatcaaacagcaggaatttcattttgctttgcccaggaagctggaagcagaaaacctgcccctccagctttcattctttatctaccctcctctagagtcttctccaaaaagcaactcatgaagaagcagaagtgatcactgggacacatctggggaagttagaattatcagct

SEQ ID NO: 171868 - DNA, 601 bp, Human
catttaataccagtttagcatatctgttaaaagctgtccctcttagagatatgtatgacccaaggacccctttggtagggcttccattctctggactatcagattatgcattttctttatcctacaacattttcatataggcaagagcaggtttaaaagaataccaggtggtctgaaaggaaagagaagtctcagaagggcaacaccctccctcagagatatgtgcatgggggccctcctttcaggaaaggaaccagtacagagcaggagtgggctgtagttgccccaggccagatgagtmcccaccaagagtggacagaggccactaccacccccgagagggatacttgtatattgctttgtcttgtttatattctagggatggaaccacttctagactccagaccatctattttttaaaaatatagctttttctccctctgcaaactaggtccacactttctgatttgtgtgtgtctttaagttgcctaatattgttggatgaatggggctttttgaacacactgtgttattaataaatacagagactcctggaataaataaataatgtgattctccaagagtcacattcttattgtaa

SEQ ID NO: 171869 - DNA, 601 bp, Human
tagaaatgaacccacaaggacacatttctggtattttctatgctgcagccattctcagtctatgggtctcttgcaaaacttcagactcttcggtggacacgacaatggtgtagaaattgagggctcagtgagatttgggattggttaacaatttaaaacataagtttacccttgtctcttccatatatcttatagtaagcacttaaatccagtttttccaagttctttttagtacttcaaagtagcagtttatcaatagaaccaccaaggtagacatagtcctagaggtcacctggttcayctttgtgccttagacataagcatatctaagtcattctaggcagatagaaaaagacaaatcttcactaagactgtttctacctttggcctcattgctttgttgggcgtaggtcttcacttcttattgtcttgcccaaggtttatattcaccacatagttttaatatgaagaaagacctattcgtgccaaattattttattttcttgctaaatttagaatgatccaactgattctgtgtactgtcacagctggcaaaaccaccacagttattcagaaaaaccatgtgaagatgctgtgctta

SEQ ID NO: 171870 - DNA, 601 bp, Human
aaaaagaaattgtccaaagcaggacacacatatcatgcaattgtttttagacactcttgccaatacaacagctctgaatctggttagcttatttttttgtattgtgctggtaaaaaataatacctgataactgaattcttctcttggattctgtagctgatgaacgttattgcttcttttatatggcccaggaagggaacacagattaagaagctggctctttttttacatgcttgctctgtcaagaaagagaaggaagtaccatatttttgaatgctatattttccccctttgcaaggasttagtactttttcaataaaaataaatttaatttgtggctacacttcaagtaagatggtttgatgtcaatgtacagcagtctcagctctgaatttagagaagtcgtgtggctgactcccttagtgtcactttcatgtggttgggtgagccattctcagaaaccccaaacatttctgaagatcctaaactggagacattcacaagtcttccctccctttttgctactaatccttcatattttaacaagcaccgaagttaatgctgcctacactttttcctgtcaaattggaactctttcttc

SEQ ID NO: 171871 - DNA, 601 bp, Human
gtgataatgttcattagcattcctgacaataaacaagaaaactcctagtgtctacatggagagtgatgctgaagagaagttgggacctaaaccttcatttcatttttatttatcattttctaagagcctcattatttctgtggggaggagaaacaaggagagatgtaaaaactaacaaataaccttgaaggaaattaaggaatggtattctagcagagggaaatatcataagtttctcagttgggctggttgtgaaaatgacacgattccataagggaaatatccagacctacattgatgsggaaggaaacttatcccacaatgatactgggtcatgctccatgaattaattgtttcagaactgtgttttccatttttctccatgatatgaagcacctagatgtgtttgttaaatacacagatcactagatgtctaccttggaaattctgattaagtatatcacagtgaggactcaggagtttgtgttttttgtttcttcattttaattaacaagcaaaattgtatatatctatggtatacaacatgatgatttgtttgatatgtatacattgtggaagggctaaatcaagctatttaata

SEQ ID NO: 171872 - DNA, 601 bp, Human
gtatacaacatgatgatttgtttgatatgtatacattgtggaagggctaaatcaagctatttaatatacacatcattctttgtagtgagaacacataaaatctgctctctgcaatttttaaatatataatacattgttattaattgtagtcaccatgttgtacagtagatctcttgaatttattccttctatctaactgaaattttatatcctttgactaatatctccccagtccttctattccagcctctggtaaccaatgtgggtttttaatgaactctccaagtgcttttttttttttattcagataagcttaggaaccattaatttgaaacagtacttttcacatttgacggcaaaatactaatgccccagtcgcacccccagaaattctgactaaattggtataggatgtggcctgagcatttgagattttttaaagcagcccaactgatgctaaggtacaggcgaatttggagtagtactgatttagaaaatagtctgaagggtacctgtaaatgatgaataagtaataactagatgtaaagtcacatcacagatcaatagagtccagctctaattcaaggtgtgaaagaactgt

SEQ ID NO: 171873 - DNA, 601 bp, Human
tcaagctatttaatatacacatcattctttgtagtgagaacacataaaatctgctctctgcaatttttaaatatataatacattgttattaattgtagtcaccatgttgtacagtagatctcttgaatttattccttctatctaactgaaattttatatcctttgactaatatctccccagtccttctattccagcctctggtaaccaatgtgggtttttaatgaactctccaagtgcttttttttttttattcagataagcttaggaaccattaatttgaaacagtacttttcacatttracggcaaaatactaatgccccagtcgcacccccagaaattctgactaaattggtataggatgtggcctgagcatttgagattttttaaagcagcccaactgatgctaaggtacaggcgaatttggagtagtactgatttagaaaatagtctgaagggtacctgtaaatgatgaataagtaataactagatgtaaagtcacatcacagatcaatagagtccagctctaattcaaggtgtgaaagaactgtcaagaataaggacttaaaatagttaaaccacgtaagaaatgatgtagtaac

SEQ ID NO: 171874 - DNA, 601 bp, Human
gtatgtacccaaaataattgaaagcaggatctcaaagagttagttgtgcacccatattcttagcagcattattcacaatagccagaaagtgtccattgatgaatgaatcgataaaaccagatgtggtttatgcatgcaatggaatattattcagccttaaaaaggaaagaaattttgacacatgctacaacatagataaaccatggggacattatgctaagtgaaatagccaatcacaaaaggataaatattatatgataatacttatatgaggtacctcaagtagtcaaatttgtagagwcagaaagtagaatggtggttaccagagcctggtgaagagtgatgagggatgggggatgggggaggaatgaggagttagtgtttaacgggtaccaagtttcaattggagaagatcgaaaagttctggagatggatgatggtgatggttgcaaaacaatgtgaatgtgtttaatgtcactgaaccgtacacttgaaaatggttaagatgataacaaattttatgagtatttcaccacaattttaaaaataaataatttgaaaatgtgtccctcaaatatgcaaacaaacaacttaaggctta

SEQ ID NO: 171875 - DNA, 601 bp, Human
tttcaccatgttgctcatgctagtctcgaactcctaggctcaaccaatcctcccaccttggcctcccaaagttctgagattacaggtgtgagcctctgcgcccagcttgatttgaatttttaaaggccatacgttatttttcaaagtaattctaagacattaacattttaaggaataaaataaaataggaaataattaagactataaaaatatctatacacatatatattcttacagtataacaaggcaaggaaactttttgtttccagttaatttcgtttgtctgcattttattagtctycatttaataatgctttattataacactgaataacaatataaaatttcaactgcatagggaagtaatgaaattttttaaaataaaatggtgttactaataatttttttagattttatctccagaaaaatgtactgttaaaaatgaaggacaaaaaaaccccacatttattagtagtgtcaaccaatttttctgaaatgttttttacttttaaccaaatagaggtaattgacaggatgatatcatttgctctttttattcacagtcagtaaattctatgacaatcagcagcaacagtaatga

SEQ ID NO: 171876 - DNA, 601 bp, Human
agtaatgactagataggtagctgtgtgaacagcagggggttgcaacagtaaaaggtttctgagaccttttactctgaggattgttgatgtagactttccaaattaaaagaggagccctcattgtccaaactgtagttaagactataaatatatctatacacatatattcttatagaataacaaggcaaggaaacttttggatgaaaaataaaaaattaactcactcatccaaatgttggccaccattacatcaaacatcagggtatgtaaagacatcttgtgaaatgactgaattctcaagtttacatctaagcaattgaaatcttactacgttagcatttttacatgaatgatagtgcatagtgtggtgtaccctggagacctgtgttgaacacaggatatgtaaatatatctgtatttattttaacatatatgtcatgtaatacatatatgtcatgtaatacatataacatgtaattaatatgttgagcttaagatataagtgaaattgatgaacataactatacctcatcttccaaacagaaaatgaaaaaaaaaagtctaatcttatttatcatggttatattgtaaaaataggttt

SEQ ID NO: 171877 - DNA, 601 bp, Human
ctcatccaaatgttggccaccattacatcaaacatcagggtatgtaaagacatcttgtgaaatgactgaattctcaagtttacatctaagcaattgaaatcttactacgttagcatttttacatgaatgatagtgcatagtgtggtgtaccctggagacctgtgttgaacacaggatatgtaaatatatctgtatttattttaacatatatgtcatgtaatacatatatgtcatgtaatacatataacatgtaattaatatgttgagcttaagatataagtgaaattgatgaacataactrtacctcatcttccaaacagaaaatgaaaaaaaaaagtctaatcttatttatcatggttatattgtaaaaataggtttgcagcaaaacaaagtagactctggaagcagaactctggtgctgcaaggtggtgttactcttttttagcattaacttgactttttatcaaatttaaatagaattctgaatttgagatgggggcttttgtgacatttaaaattttttgaaatggtttagtagtcctttgttggtggtaagtgttggatgaatgaatgaatgaagaatgaacaaattaatgaatga

SEQ ID NO: 171878 - DNA, 601 bp, Human
acataactatacctcatcttccaaacagaaaatgaaaaaaaaaagtctaatcttatttatcatggttatattgtaaaaataggtttgcagcaaaacaaagtagactctggaagcagaactctggtgctgcaaggtggtgttactcttttttagcattaacttgactttttatcaaatttaaatagaattctgaatttgagatgggggcttttgtgacatttaaaattttttgaaatggtttagtagtcctttgttggtggtaagtgttggatgaatgaatgaatgaagaatgaacaaattratgaatgaacaaataggtattggagttctcactctatggggttgggttctagttgattgccaactatgtgtttcagttttatataaatacctccactgctggttttcctctggtttagtctcaacaaacagtacaagcttgcgggggggggatatttgcttggatttagctgaaacacagaagcaatcaagtggttgaattctgcattttaaaaaattgaatgacattcctttatccatatcgatttgagctttggtaaattcaattgtcgataccacctggataattttaaatctttct

SEQ ID NO: 171879 - DNA, 601 bp, Human
agcattaacttgactttttatcaaatttaaatagaattctgaatttgagatgggggcttttgtgacatttaaaattttttgaaatggtttagtagtcctttgttggtggtaagtgttggatgaatgaatgaatgaagaatgaacaaattaatgaatgaacaaataggtattggagttctcactctatggggttgggttctagttgattgccaactatgtgtttcagttttatataaatacctccactgctggttttcctctggtttagtctcaacaaacagtacaagcttgcgggggggggatatttgcttggatttagctgaaacacagaagcaatcaagtggttgaattctgcattttaaaaaattgaatgacattcctttatccatatcgatttgagctttggtaaattcaattgtcgataccacctggataattttaaatctttctgaagctttaaaaaaaagtttccaacgtagctccagcaacataagaatttcatcaattgaaagctaagaatcatttctgtgggatgtgtaaaacaagaagccgaccagcattattttctttttctttaattcagtatcattattgagagtta

SEQ ID NO: 171880 - DNA, 601 bp, Human
ttctcactctatggggttgggttctagttgattgccaactatgtgtttcagttttatataaatacctccactgctggttttcctctggtttagtctcaacaaacagtacaagcttgcgggggggggatatttgcttggatttagctgaaacacagaagcaatcaagtggttgaattctgcattttaaaaaattgaatgacattcctttatccatatcgatttgagctttggtaaattcaattgtcgataccacctggataattttaaatctttctgaagctttaaaaaaaagtttccaacrtagctccagcaacataagaatttcatcaattgaaagctaagaatcatttctgtgggatgtgtaaaacaagaagccgaccagcattattttctttttctttaattcagtatcattattgagagttattcttgaactttatgaaaaccagattggggcatgagcatgttctccattgaatcatgttcaaggaattgaaactgaaaatcattcaaagtagggaaacatgacattgaaaaatagtctacattctttattctccctcagagtatctgaggctgtttctaactaggaagccttagg

SEQ ID NO: 171881 - DNA, 601 bp, Human
accctatgcatttacattataaggtggaaacacgtattttcaaatagatcctgaagagtaaggatttcacatcaagggatgatatatgggacttttgccaactggccttttccatgtgtgatttgagagagtactttgactttaaattctggaatgtgtggtgtaagtctcaacataaagtctacagtgacaatataatccctggggttaaaagtcaacatctcaaaaccattacccataatttagtagaagaggttcagtatagtgttcataagacaactactctgtcatttcctttaaragaatgacaggtgtgtacagcaattgttcagaggaatgagaagacaggcgtgtctccatcaatccttgctaccttgacactcagggtaactgatgttctttctctgaaatgcccaaattatgcccaaggatacagctttactcttgttttcaatttccttaatgtgcttgctgcatttgtttcatatgctggactcaaaagcactctggcatgaaaaaggactgccagctgtttagctaagtccatgaggaggaaaaatctcctactcttgtaagattatcaatgggaaatgacaaatac

SEQ ID NO: 171882 - DNA, 601 bp, Human
tgacactcagggtaactgatgttctttctctgaaatgcccaaattatgcccaaggatacagctttactcttgttttcaatttccttaatgtgcttgctgcatttgtttcatatgctggactcaaaagcactctggcatgaaaaaggactgccagctgtttagctaagtccatgaggaggaaaaatctcctactcttgtaagattatcaatgggaaatgacaaataccaagtcagccccaattctgattgactggggccaaagacacttgcaggtgaaactagttcttgggaatcttgggarattgctcttgcctgccccatttccccaaactaataacagaaaattgtggcccaggagaaggtgggcttgatgcaggtgtttggtgaagtagtgtgaaaccatgccttggccctgtttggatggctggtgtatttctgaacataccttctgaaatttccaaaattgtaaatccaaatgttagaacatttagcagtaagcttttggggaaaattcaaaaccaggagctcttccaaaaaattaacatttcttttgtgagtaacttagagtgtgatcatcacaactaaaatactattattatca

SEQ ID NO: 171883 - DNA, 601 bp, Human
taagtccgtttgtattagttttagcatgctcacagactcctgtgtctatacaaagatggaggatttcgtgacatggcttccatggatggcagggaggaataggggcatccaacagttggcctggtctttctctctcccaaatgggtaaagggacttttccttccttgctgctaattttagtgatgaagcagatcattggatgatccagttatctgtatgacatagtcacagcatcctctcctttatcccagttgctgatgtgcaccctatgtgtggatatcacaaactttgaacacatcayaggatcagaatcagtctgtgttgcttagactgttagcttgcactttcaatttaatggactccttggctgaaatagtttatttgcacaagaaagactaaactctcaagcaactataatgatatgatacctcagaatgattttttaaaaattatttcagatgcacaaaataggctatttgatgtaaatagccagaaatactcagggatattagttataattgattattcttttctgtcattaaacttaactcagcagtatatcttttaagattaggaatctttaattctcaattttaaaaaa

SEQ ID NO: 171884 - DNA, 601 bp, Human
gatttcgtgacatggcttccatggatggcagggaggaataggggcatccaacagttggcctggtctttctctctcccaaatgggtaaagggacttttccttccttgctgctaattttagtgatgaagcagatcattggatgatccagttatctgtatgacatagtcacagcatcctctcctttatcccagttgctgatgtgcaccctatgtgtggatatcacaaactttgaacacatcacaggatcagaatcagtctgtgttgcttagactgttagcttgcactttcaatttaatggactycttggctgaaatagtttatttgcacaagaaagactaaactctcaagcaactataatgatatgatacctcagaatgattttttaaaaattatttcagatgcacaaaataggctatttgatgtaaatagccagaaatactcagggatattagttataattgattattcttttctgtcattaaacttaactcagcagtatatcttttaagattaggaatctttaattctcaattttaaaaaatcatattataaaataaagactcccatttgctattttaaagacgtatttaaatattgttctt

SEQ ID NO: 171885 - DNA, 601 bp, Human
aaaaaatcatattataaaataaagactcccatttgctattttaaagacgtatttaaatattgttcttttcaggcttatagcctattcacccaatggctgccctgcatgaaatctagtccctgttgaaatctggtttttatgacctgagtgacaactttctggttttagtccatggaggacacatactcctgctttgacaaatttgcttagtacatctgatattaatacatgtgtattctcacaaacaattgattttgaaaatgtttgtaaatacaagggtattgtgtgttttattaaagcytggagctgacaagtgtaaccattattatctttagtttctgcaccattagtttcaaaattctcacctgtcatctttgcctgacttaagaagcagcagcacatgctgatgaaatccagccggcttgaaaccagagatccacagaagcatgaatgtcaggggcagtaaagcatggtttctggcacagccggggtcttttgtaacgctgtgtgaaaagcaaacacatgatttagccaaatgatttttccgtgctatctttggcatggcaaggagttgacagatggaaatgtaaccacaccgtgt

SEQ ID NO: 171886 - DNA, 601 bp, Human
caagacagacctagagttcatattctagttgagggtaaaatactaataagcaaataaatatatagtttaggatggtaagtgcaatggagaaaattaaagtagaataagtgggataggactataggctgtcaagttgacaatttcatatattttccttatgcttctataatagcattaatcgtattttagtttattcattcatctgccatttttctcttactacattatttccatttcatctttgatttcctgcacagtacctaggacatagtaagtgaggagctaaaaatatatattgggrataaagaaatgatatataatgtaatccatccaatctaaagaagtgccttaaaagctttcctcccagtcagatgggtcagaacagagtgagtcacacaaaccaccatgcagttcccaggtgataagaactctaccttaactgagagattcacaatgcccctggaaaagagttgtcagtataaagtggaatccaatagtttggactagattgtaaaattgcatgcaaaacttaacaggtggcctcatgtcttttgaaagggtcactatgttcacactggtgcttaatttgtcttttacttta

SEQ ID NO: 171887 - DNA, 601 bp, Human
aagtagaataagtgggataggactataggctgtcaagttgacaatttcatatattttccttatgcttctataatagcattaatcgtattttagtttattcattcatctgccatttttctcttactacattatttccatttcatctttgatttcctgcacagtacctaggacatagtaagtgaggagctaaaaatatatattggggataaagaaatgatatataatgtaatccatccaatctaaagaagtgccttaaaagctttcctcccagtcagatgggtcagaacagagtgagtcacayaaaccaccatgcagttcccaggtgataagaactctaccttaactgagagattcacaatgcccctggaaaagagttgtcagtataaagtggaatccaatagtttggactagattgtaaaattgcatgcaaaacttaacaggtggcctcatgtcttttgaaagggtcactatgttcacactggtgcttaatttgtcttttactttagtagttcttattccattgattttttttcatctcttgcactcatccgaggctattaagatttaatgaagaaccacaaattgttccaagttcatatcc

SEQ ID NO: 171888 - DNA, 601 bp, Human
ctggtgagctcagtctacctcagagctagttaagtccattttatttacttttacacatataggtaatacttgaaaatattctaactataaaaaattcaaacaattcaaataatgataaagctgcagtcctcctctacctaccccaaccccaaccccatccacaacacccccttcactgcctgcacctcagtcccctccccaggggtaaacttttatcagtttcatgtctatgttctggagcttggtggtatctacttacttacatatgtacctatggaaatatatgatttgggacttgggkttttttttgtttggttcgttgattggttgtttatttttattttgagctattggaagtttttaagctggtaaatggccctatgttatgtttttaaaggtaattctggctgggagctgtggctcacatctgtaatcccagcactttgggaggccgaggtgggtggatcgcttgaggtcaggagtttgagaccagcctggccaacatggtgaagccccatttctactaaaaatagaaaaattagctacatatggtggtacatgcctgtagtcccagctactctcgaggctgaggcaggagaat

SEQ ID NO: 171889 - DNA, 601 bp, Human
gccgaggtgggtggatcgcttgaggtcaggagtttgagaccagcctggccaacatggtgaagccccatttctactaaaaatagaaaaattagctacatatggtggtacatgcctgtagtcccagctactctcgaggctgaggcaggagaatcacttgaacctgtcaggcagaggttgcagtgagccgagattgggccactgcattccagcctgggtgacagagccagactccatctcaaaattaaaataaaataaaataaaataaaatagtaaaataaaatataattctctccatgcttgagagcaagaagaaaagctgagaccacttggaaggaaggcacaataatctaggaaagaaatgacagtgacttaaaccagtagtctgagatggagagaaataaatgcatttgagaaccatttaagagataaaagccacagaaactggtgattgatttgatagaaggaaggtaggagagggagtcatcagcagataacccaggtttaagacctgggcagctggtgagtgtagcactcactgcactggagaacagcaggggaaggacatgctggggcagagctttgcatatgttgagctaaaggt

SEQ ID NO: 171890 - DNA, 601 bp, Human
gagcaatacttaggaaataaatagaaattgaactagaaaagggagatgaaaaagtaacccaggaaatagaagacaaattagaattttctttgcagcttcatgggtattaatggaaaaaaccatgttaagaggacagaatttgcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacattkccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatg

SEQ ID NO: 171891 - DNA, 601 bp, Human
atactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagasagtaacattattcaggtataagaaaaaatgaagaagacttctatgttctattatggagtgatccctaagatacatttttaaatgagtaaagcaaagtggagagaagtgcaaatagtatattatcattgtttataattatataattagaagttgaaaggataaacaaaaaagttacttatagcaagacaggaagctaaaagaaaaaaataatagctagacttctttgaatataccttatttttacatttgattttggaaccatgtaaatattttacatagttataaaagaaaatgaaataa

SEQ ID NO: 171892 - DNA, 601 bp, Human
aggatgctcaataaagaatgtgataaagactgttaaacaccagagatatcaagaaatacacagatggcaaggcaagaagagggtcacgtggacctcagtgagaacacttttagtggagcactggagacagattgtgagtggttgcagagtgaaaagggaagacagtagacacagaaaatatagactagtctttcagacatgaggcagtgaacataaggagatagagaggcgactagcagggaaagccaggccaaggaaggattttattattatactctctgagagacctgagtatatttgyggcctgaagaggagccagtgaaaggtgtatggtttaaaaaatggaggaacagaattcaccgctatataactcatccatgtaacaaaaagcgacttgaactccaaaagctattggaataaaaattaaattaaaagaaaaaaccagaggaagattatttcaagtgaccatgtcaggtttaggatagggagaagaggcaggatattggcaagactaaaaaaaggcttacaagtaagtttagctacatggaagtggagggagaaggaggaaagaagagaaggtcccccatttcttcggtggagt

SEQ ID NO: 171893 - DNA, 601 bp, Human
tatcacagatgtatttcataggtgatatctaatttaaattttatgaggtgataagaagagtgccaagaattgtgtaaaattgccattgtggaatctcttacaggaatctcctgaatctgacattcaaagctgtccacagtctgtccccaccattactagagcaggtgaacagatccaggtttgggagatgcaccacttctttacaattcttccaagccagtgttctcaaaatgtggccccagatcagaagcaacagcattacctggggcttattagagatgcaaaccgtctgggccccacyccagaccttctgtgtcaaaaactctggggatgggagccaacaatctgtgttttagaagccttccaagtaatccagatgttgctaaaatataaagagccatgccctaaaccaccgtaaagttctatttcaaacatcccatcctacagagctggtggggcagttcagttacattgagggacccttcctttctcccagggttgtgttagagaactggggatctagtttagggttcagacaggagaatgaaaactattgtcccacctgcaacaaggtttcctcatataatgaatatgctacatg

SEQ ID NO: 171894 - DNA, 601 bp, Human
tggtggggcacagtggctcacacctgtaatcccagcactttgggaagccgaggtgagcggatcacctgagctcaggagtccgagaccagcctgggcaacatggtgaaaccccgtccctactaacaatacaaaaaattagccacgcatgatggctcatgcctgtagtaccagctactcaggaggctgaggcaggagaattgcttgaacctggagggcacaggttgcagtgagccgctgcactccagactggatgacagagagagactccatctcaaaaaaaacaaacaaacaaaaaaaaaaacagtatagctcaaaaagataaccagaaaagatcaaaagcaaacaattcgacaacaagaaaatttggcaacagaaatatgcattttatacactctactgcccaagaattcacatgtctaacataataataaaatattaaaaaaggaagtctgtattcgagggggaatgtcatgctggaattagcacagtgagcaaaatgaatctcaccctgaagcctatagagaagtccatatgaattcactttgcatagctaaatgattgccagagagacaataacacttcacatactgaaagagagaag

SEQ ID NO: 171895 - DNA, 601 bp, Human
ctaacataataataaaatattaaaaaaggaagtctgtattcgagggggaatgtcatgctggaattagcacagtgagcaaaatgaatctcaccctgaagcctatagagaagtccatatgaattcactttgcatagctaaatgattgccagagagacaataacacttcacatactgaaagagagaagtgatgattttaaagatccaaatttaaaatgaaacttctctacatgggatcttagaaatactgtagttaaatgaaaaagcatatttagagaaaatgcaatcattgtcaattctcttygtgatttgaatagttaatatttccattaattttatagggttttatttaaactttccatgaggattgaacaggttgagtttttgaagtgggacaaacatgatattacatattttgggggtgctaagttcctaaacaataccctttcccattcggtttatcttgtgcctttttctaccaaactgcagtttcaccctctacagcctgtatttatccccatgattgccactagacctgcttcttcaaaagttgccctgacctgctttcttgcctgttccaggggtcatttttatcattttcctt

SEQ ID NO: 171896 - DNA, 601 bp, Human
gcttgggggttagaggagggagagcattaggagaaatacctaatgtagatgatgggttggtgggtgcagcaaacaaccatggcatgggtatacctatgtaacaaacctgcatgttctgcatatgtattccagaacttaaagtataataaaaaagaatagttttcaaaaaataattatatttatttttccactgcaaaattcttattatagttattctttacaaagtaccagaagaatgagaataatcttccaatatgttttgtcccatgttgataataaagtagtaattacttctaatggrcaaatcctactcattccatattgtgtgtaatactagcaaactaacatatttagactcaggataaagatgaacaaagcaatatcctattctaaaaaaaaacagtgtaattatgcactaaattgtgaaacaaggtaaagaaatacatagatgttgtaaaagaaatattgaaatatactaagaaaaaaactcttctttttctttccagagtgaagtaactggccctcccataaattctagggaaccaggcctcagtgtttattactggaaatgcaccagctttgtggaagtttctggaaagga

SEQ ID NO: 171897 - DNA, 601 bp, Human
agcattaggagaaatacctaatgtagatgatgggttggtgggtgcagcaaacaaccatggcatgggtatacctatgtaacaaacctgcatgttctgcatatgtattccagaacttaaagtataataaaaaagaatagttttcaaaaaataattatatttatttttccactgcaaaattcttattatagttattctttacaaagtaccagaagaatgagaataatcttccaatatgttttgtcccatgttgataataaagtagtaattacttctaatgggcaaatcctactcattccatatkgtgtgtaatactagcaaactaacatatttagactcaggataaagatgaacaaagcaatatcctattctaaaaaaaaacagtgtaattatgcactaaattgtgaaacaaggtaaagaaatacatagatgttgtaaaagaaatattgaaatatactaagaaaaaaactcttctttttctttccagagtgaagtaactggccctcccataaattctagggaaccaggcctcagtgtttattactggaaatgcaccagctttgtggaagtttctggaaaggaatgttgtggaattggtgattaa

SEQ ID NO: 171898 - DNA, 601 bp, Human
tgctttgtgtttttaactttgataagaatagaaacgtgacacgatctctggtgccaacaggttcatagcctacatcttactactcaaacttgtgtaatcaatagaacttctttaaaaagagatgttttgtccacctttagtattgcctgaagttagtttcatgtaacttaaatacatctagacaaagaacaagttatacattccttatacttattcattcaatacatgaccatttattgagagcttactatagttcagttactgggagtatcacagtgacaagggcagacaaaaccccccygacttcacaaactgtttattctggtgggaagaaacagtgtggaaaccaaagaaacaaatatagttaattatgtttttttgagacggagtctcactctgtcgcccagtttggagtgcagcagtgcgatctcagctcactgcaacctccacctcctgggttcaagcgattctcctgcctcagcctcctgaggcaggaaattacaggcatgtgctaccatgcctggctaattttttttttttttttttttttttggtggagacagggtttcaccatgttggccaggctggtctggaacccctg

SEQ ID NO: 171899 - DNA, 601 bp, Human
agttcagttactgggagtatcacagtgacaagggcagacaaaacccccccgacttcacaaactgtttattctggtgggaagaaacagtgtggaaaccaaagaaacaaatatagttaattatgtttttttgagacggagtctcactctgtcgcccagtttggagtgcagcagtgcgatctcagctcactgcaacctccacctcctgggttcaagcgattctcctgcctcagcctcctgaggcaggaaattacaggcatgtgctaccatgcctggctaattttttttttttttttttttttttggtggagacagggtttcaccatgttggccaggctggtctggaacccctgacctcaggtgatccaccagcctcggcctctcaaagtgctaggattacaggagtgagccaccgcacctggccagttaattcttgttatgtacaacagttgtattctataaagttgccacaaatgccaaactgacaaatactaaatgaaccattgcttctgagggagatactggatttgattcctacgaccttctggttacaacattttcatcagcctatgaatacattatcttattgtatgtgtgtttctgt

SEQ ID NO: 171900 - DNA, 601 bp, Human
tcagttactgggagtatcacagtgacaagggcagacaaaacccccccgacttcacaaactgtttattctggtgggaagaaacagtgtggaaaccaaagaaacaaatatagttaattatgtttttttgagacggagtctcactctgtcgcccagtttggagtgcagcagtgcgatctcagctcactgcaacctccacctcctgggttcaagcgattctcctgcctcagcctcctgaggcaggaaattacaggcatgtgctaccatgcctggctaattttttttttttttttttttttttggkggagacagggtttcaccatgttggccaggctggtctggaacccctgacctcaggtgatccaccagcctcggcctctcaaagtgctaggattacaggagtgagccaccgcacctggccagttaattcttgttatgtacaacagttgtattctataaagttgccacaaatgccaaactgacaaatactaaatgaaccattgcttctgagggagatactggatttgattcctacgaccttctggttacaacattttcatcagcctatgaatacattatcttattgtatgtgtgtttctgttta

SEQ ID NO: 171901 - DNA, 601 bp, Human
aggactgatttcatataataaatattcagataggaatgaatgttgcaaaaaaaaatgaaacagatctggagagtgatgggggtttggaagaactgtttgagctgggtgactaggacagtctgccctgaggaggggacactttaatagatacgaatcttcaaaagtagttagccctgtgaagatggaggacagagggagcaagtgttaaagtctgtgaatcaggagcaagcttgacttggtttgtgtgaggaacaggacagaggtcttcatgcctgcaacaacaacaacaaaaaactgaacygacagaagatgagcttgaaaagctaatcagtggtcagataatgtatggtctttttggcctactaagtggcttagactctgttctaaagggtaatgagaagccactgagggttttaaaatatatttgagctatagcttattagataattttacagccttcccccaaagtttacaaatcaaatttacccccaaacaataaccatttaagtgaatcacattaacttaatgtgacaagtggatgcttcactgaaactaaagttctattcacagtatgactatcgggctgacttccctggtgcag

SEQ ID NO: 171902 - DNA, 601 bp, Human
aggatggggagtgtcagagtgggtgggcattggggaaagtgagttcttaagaactggagctttcagtgaaagagaataaagggcattaggaggcttacctagagttgggcggcagtcatgccaggcaagcaggcccccacagtggaatctccgaaccctcccacttcccaatagtgagccgttcacccccagagtgcttgatttggtatggaaaaagagtctctctctctcttcctctctctctctccctccctccctccctctctctctctctctctcacacacacacacacacacacaagcacacaaacacacacacacacacactccaatttatcaaaaatcactttggaatttaaaatctcagctaatgacctttctcagaataaaaaagtcacattttcgtcaagttctatgggttccctattaaattgcaaatgtggaccatttggcatatgcagttcacccatttaaacccatttgactttgtaaggcggggtgataacattttggatttcatttttgtttgtcctataagagtcttgagttttagccaaaaacccaggccttggatgaatgtgctttagacctcactttttgt

SEQ ID NO: 171903 - DNA, 601 bp, Human
gcagaagacttctgtctcaggaaaaagtagctgtcttcaaggcagaactgactgactggattgaactgaattataatttctggttcaagctgagttgtgtccctggggtggtttgacctgtttgtattagctttccactctccatccatatttgtcccggtggtatcaggaacatcacagaactatgagtatgacttaaagctaagttgaaaagaggctctgctgtcttcagaaaggggaatatatgtgtatgtgtgtgtgtgtgtgtatatatatgtgtgtgtgtgtgtgtgtgtgtgtrtgtgtgtgttttctttcattacaggcagcctgcctctttcaatggaggcgcaatatagctgatggttgagccgtagtcattgattgcaaagggatgtgtttaggaaggagagaaatagctgctcagaaattgccttctttctctctcaaattgcactgttgggggaattacataagtgcagaattgtggggaactgtgcgcatgtgtctgtgcattagaggccaagaggaaaaaaaaagtctgccttctcttctcatttgagaattatgttagtttgttagggctgccataacaaactac

SEQ ID NO: 171904 - DNA, 601 bp, Human
tgaaggacccatggatgtcgagggaaagcagcgggaacagttgatgcaatgtggttagcgggagaggtggcttggctgatgctgaatgcagagaccgttgatcaccatcttcagaatacatttactgactggtgcagggtatttagttgccctgtggtgctggtttggattcaggcttctttagagtcagtgcttgtttctaagcatcattgttcttctccagaccaaacatatcagaatatttcatggaaagaaatattcatatctctctctctctctctctctctctctctctctctccccctctctcagtgtctctccaattgaaatttgtgtgtttcagggacatactgatgctttaagtcaaaggataagtttatttgtttttaatgagatacaattaatcagacatttaatttccattgctttgtccctgtgatccacaggaaatttgtggctagatttcctactatccaactcactagtggcctacctttcattacgatttttcatatagctttcttgctcagtagcagtttcctgatcttttcccgtggtgttcaaacatgctgaaatctttgccatgactgggcagcaaatg

SEQ ID NO: 171905 - DNA, 601 bp, Human
taaccaggtttttgcatgttttgctctcctcttcttgactgttttccttaccatctgtcaaagtctatgtatctttcaaggcaggttccctcacctgtcctagataataccatccttgaccacatcagactctggtaacaccaacacaccactaccacccccaatcttcaaattcctctggcacctaacatctgtaccacagaatttagcacctggctacatacttgttctctttctttggtataaacaaggcagagagccagtctgttttccagtgatttgcagacatggtaaattcctyccagagtttttcccagaattgtgtctttgagggggaatttatattcttcctttcttcagatggtaaaaacctgggtacctccttgtgatatgatgtgttttcccttttgtcttagttatcaggaaatttagagctgttgcagaaccatattgtaataatcagcttatctcaggatcctggtaatagctatgtattctacctcccttctttagaactctgttgtgtgtttgttcttaattttgcagtatatttaacttgtaagactccataaatccttttagaacaaagtgagaaaacaga

SEQ ID NO: 171906 - DNA, 601 bp, Human
atcacttaatctcccttcatccctaaacggtggctgctctcggacaattaacgacccttttttgcaaagagcaaaacgttatgcgttcacacctttccctatgggacaggacacacaggcatttgtcagagccgtgttgaaataactttataggcaaatacttggaaaagaaagcttttgtggacgtcgatttttagattgggcttttaaaaagggctatttgtcagtgtttgctacttgtaccgtttctattttgaatccacaaaagacgattctgttgactattttatgtttagatctytcatccatttgatttgtaccaaggtaaatattccttgtctaagatatcaaattcagaggcagacttttacaacagtctccaactttaaacatgaatatcaaactcagtatttttttaaaaatagattttaacatgtcacatttacagcaagtgaaaatacccatttattttaaaaatcagccagtaataaatactgtttttaaattatgctataaaaatttatgttttaaaaactatgccacatgcattgttcctttttgccagtctagcaaaattactgagttgctaattcagctactt

SEQ ID NO: 171907 - DNA, 601 bp, Human
aggcatttgtcagagccgtgttgaaataactttataggcaaatacttggaaaagaaagcttttgtggacgtcgatttttagattgggcttttaaaaagggctatttgtcagtgtttgctacttgtaccgtttctattttgaatccacaaaagacgattctgttgactattttatgtttagatctctcatccatttgatttgtaccaaggtaaatattccttgtctaagatatcaaattcagaggcagacttttacaacagtctccaactttaaacatgaatatcaaactcagtattttttwaaaaatagattttaacatgtcacatttacagcaagtgaaaatacccatttattttaaaaatcagccagtaataaatactgtttttaaattatgctataaaaatttatgttttaaaaactatgccacatgcattgttcctttttgccagtctagcaaaattactgagttgctaattcagctacttggatttttttttaacataaatattattgtccttcaactttataaaataaaatggtctctgcatcacttcttggtttctgattcaagaaagctctctataaataagaatggacaggt

SEQ ID NO: 171908 - DNA, 601 bp, Human
agtgttctacaaactccttaacaattcctatgtaactgtttttcttttaaattttttttaggtaaaatgaaactaatgtctcaacattgataaatataattttttcccttctctttctctagatatcaagagacaaccacataagagtttcatagctaaacattttttaaaaatcattattggtcatgcaaactgtttagttttgtggtaaacataattctgctttaacaataatagtagagatacattgagtccagctcaaatccagtaatgaaccgaacactttttaaaaccttcaaawcatttttgtcttctggcaagttgaacaagatttttcttaaaaattagatttcttaaaaaaatctgaattatcagtagagcagtatgtttggttgttgtttttattattacatttttggaccaggttattccagctgttcctatgcaaggatagttcatatttcccacctcagtatttctgatttctactgcttaatgtaataatttatgatatataaatcttgcctttgcaattaaaatgattgagccaggaaaactgtggaaatatttgtgaaacaaagtacagtataagagacagaga

SEQ ID NO: 171909 - DNA, 601 bp, Human
attacatttttggaccaggttattccagctgttcctatgcaaggatagttcatatttcccacctcagtatttctgatttctactgcttaatgtaataatttatgatatataaatcttgcctttgcaattaaaatgattgagccaggaaaactgtggaaatatttgtgaaacaaagtacagtataagagacagagagaacatatgaattgttttttattattcatcaacttttgaaaggtcattactgatcggattaatgcaaatatattttgtcattttcttcatgcatttatgaattttytagcgcataatataggctgtgatcattattttctatcatttgtaatatatatgaaaagaaactatttttaaatgtttaaaatattgtttcactttgttatagtacttatattccaaataaaaattcttgaaaatgtattaggtattattttaaatgtgtcacaatgtcagtttattttcagtgatttttttgttatattcgtattaagattaaacattttattctatttttaagattgttcatagattacctaattctattcaatatcagattgttcatggaattaggtaatagaattaa

SEQ ID NO: 171910 - DNA, 601 bp, Human
tcagattgttcatggaattaggtaatagaattaagcaagaatcctgtatgaaccttctaaattatggtattaaaaattaactttgaagagtctatagttgaatcacagatttgttttctgggcagcacagtcataataaagtgtattgacagcattatgatccatctaaattcacattgtttcagcctctgaaagatttggttaaaaattcagactctagcttgcacagcaggtacttttattatagaaattgtgtatttttaaaaaataaatgagccggggacttttggggtttttttttgtttttttgtttttttgctcacaattgacatacagtgatttaagcgggtgaaagaatttttattgatttcaagattaagtttaaacatagattcttatatatgatggagtttttattgctattttaaagataggtattgggtcaataatttcgtataaacagatggtttcaattccctgaataacaaaatgccggtggtgctaagccacagtacatgttgtgtttccattctaatgcgacatgtttattagacacaggtcttaaacagtggcatgagatgatcctagtggcccccttttc

SEQ ID NO: 171911 - DNA, 601 bp, Human
gaaaagtttagaggctgggtgcggtgcctcacgcctgtaatcccaacattttgggaggccgtggcaggtggatcacgaggtcaggagttcgagaccaggctggccaacgtagtgaaatcccatctctactaaaaatacaaaaattagccgggcatggtggcaggcacctgtaatcccagctactcaggaggctgaggcaggagaaccacttgaatctgggaggcagaggttgcagtgagccgagattgcaccactgcactccaacctgggtggcagagagactccatctcaaaaaaaaaaraaaaagaaaagaaaagaaaagtttgccaaatatatcatgctaaaattgaaaagttgagttttggttggtatgttcaattaacatatatactatttttctttcattaaagtgtagccaattgagaatgtgattaattagaattttgtgccacttggtggtattcaaatttatcatatgagatatatacctttctagtatgtcttattacatgatacacaaagtattcctgaatgtcatggcatgtaaaaaaggaaaaaaaaaaacaactacaccttttatttcagacaaatctccttgaat

SEQ ID NO: 171912 - DNA, 601 bp, Human
gtttagaggctgggtgcggtgcctcacgcctgtaatcccaacattttgggaggccgtggcaggtggatcacgaggtcaggagttcgagaccaggctggccaacgtagtgaaatcccatctctactaaaaatacaaaaattagccgggcatggtggcaggcacctgtaatcccagctactcaggaggctgaggcaggagaaccacttgaatctgggaggcagaggttgcagtgagccgagattgcaccactgcactccaacctgggtggcagagagactccatctcaaaaaaaaaagaaaaagaaaagaaaagaaaagtttgccaaatatatcatgctaaaattgaaaagttgagttttggttggtatgttcaattaacatatatactatttttctttcattaaagtgtagccaattgagaatgtgattaattagaattttgtgccacttggtggtattcaaatttatcatatgagatatatacctttctagtatgtcttattacatgatacacaaagtattcctgaatgtcatggcatgtaaaaaaggaaaaaaaaaaacaactacaccttttatttcagacaaatctccttgaatttgca

SEQ ID NO: 171913 - DNA, 601 bp, Human
cggtgcctcacgcctgtaatcccaacattttgggaggccgtggcaggtggatcacgaggtcaggagttcgagaccaggctggccaacgtagtgaaatcccatctctactaaaaatacaaaaattagccgggcatggtggcaggcacctgtaatcccagctactcaggaggctgaggcaggagaaccacttgaatctgggaggcagaggttgcagtgagccgagattgcaccactgcactccaacctgggtggcagagagactccatctcaaaaaaaaaagaaaaagaaaagaaaagaaaaatttgccaaatatatcatgctaaaattgaaaagttgagttttggttggtatgttcaattaacatatatactatttttctttcattaaagtgtagccaattgagaatgtgattaattagaattttgtgccacttggtggtattcaaatttatcatatgagatatatacctttctagtatgtcttattacatgatacacaaagtattcctgaatgtcatggcatgtaaaaaaggaaaaaaaaaaacaactacaccttttatttcagacaaatctccttgaatttgcatacgatcttaatttaa

SEQ ID NO: 171914 - DNA, 601 bp, Human
gcagagagactccatctcaaaaaaaaaagaaaaagaaaagaaaagaaaagtttgccaaatatatcatgctaaaattgaaaagttgagttttggttggtatgttcaattaacatatatactatttttctttcattaaagtgtagccaattgagaatgtgattaattagaattttgtgccacttggtggtattcaaatttatcatatgagatatatacctttctagtatgtcttattacatgatacacaaagtattcctgaatgtcatggcatgtaaaaaaggaaaaaaaaaaacaactacaycttttatttcagacaaatctccttgaatttgcatacgatcttaatttaatgttacattatctatcaattgtacttaagattgtgtgtttatttttactgtatgagaaagtgttgaccaaaaccttcatttctggtgaggtaaggaactttttccttaaagaaaaagaaaatattgaactttcaagcaaaacaaaataagagcgttatgtaatgctattttggcataatatgaatctaacattgcattccagggggaaaatataccacatttgtatgcatagcatcctagacctagaaagt

SEQ ID NO: 171915 - DNA, 601 bp, Human
gtgccacttggtggtattcaaatttatcatatgagatatatacctttctagtatgtcttattacatgatacacaaagtattcctgaatgtcatggcatgtaaaaaaggaaaaaaaaaaacaactacaccttttatttcagacaaatctccttgaatttgcatacgatcttaatttaatgttacattatctatcaattgtacttaagattgtgtgtttatttttactgtatgagaaagtgttgaccaaaaccttcatttctggtgaggtaaggaactttttccttaaagaaaaagaaaataytgaactttcaagcaaaacaaaataagagcgttatgtaatgctattttggcataatatgaatctaacattgcattccagggggaaaatataccacatttgtatgcatagcatcctagacctagaaagtactctgtgagtgcctggtggatgggtttagctgatcacactgagaagggttctttatggtttcatcaatcagcattctataaatttggcaatcctaaatggtttgttctacaatggaacttttgatgacatattatatactgctatatggtatagttgattatgtagaaacaa

SEQ ID NO: 171916 - DNA, 601 bp, Human
cactgagaagggttctttatggtttcatcaatcagcattctataaatttggcaatcctaaatggtttgttctacaatggaacttttgatgacatattatatactgctatatggtatagttgattatgtagaaacaagctagacggtgttttttaaaattcagccaggaacaaaaaccgaatgactttagaaatgggagttttctattctggatgcataattctaagtaaaaaaaaaaatctcttgcttttactgcatgttatctatttcatttaacatccccttgactactcctgataccrcaagctgagttccaacagtgacaaaaactctgttaatattggccccagtggtgaagatgcaaatggtctggtgactattgatatagtctggagtctttgggaaagagaataccctctgagtcggaaataccgccagtagtgttacagcagtatttttcttaaatgagtattctttatgtttaatgtatctttctcatggccctcatcaaagtaaaactaaacaacaataacaaaaacagatattctttattggtcacttcctaaaaaataaaaaagagcaaaggagaatgttaaaaaaaa

SEQ ID NO: 171917 - DNA, 601 bp, Human
aaaaaggcttttctctctctttcttttcttcctttcttcctttcttccttttcctttcctttgtttataacaagtgtaattgtgggagagaaatacacatgaagacatgctcagagatacaatggcagaaaatagataaaatttaaaaactctttgctctatctcctttgcatacacataacgtcccttaactcacttaagattgtatacaatattattttatccctctttgttgtattctaaaaggactgaaaaacagattagtttaacaatctgttttatattttaaaaggccttttgraaagtctttattttgacttaaatgttatatatatacacactatatatatgcacacacatacattcatacacactgtctctatgcaataaggaaacacaatatgacatatatacagaattttctgcaataaaagtgattttacagcttttggacagaattacttgaatatgacatattttgtgagtaaatatgattttacaaaagttactttggctgatatgtggctgctaaaatttctttctaggatgctatcatcatttctaaattgtaaagtgttgttatactcatatttgtactatc

SEQ ID NO: 171918 - DNA, 601 bp, Human
aagaaaaagaaaggatatactattttattgagagtaggtaatattacaatctctagcccttctctgaatgaccgaaaatcaggataagcttatacacttgaagagttctttaggtattgtttgatcatatacaaagcaatctatagctcagaaaaactcagacttaacaaaataattgccttaactgtggttttataagtatttttataaattatatttatttgggtagaaggggaacttttgtgtttctctttgtcaccacaaagctttattctaaatcgctgaagacctcgtctgtagaggtacaatgtactaaaaggaaaaatgacttccctacatctgaggcttagctgcagcccacttctgaaagaggtagatcccttaagggcaaatgctgccattattgtgattactataggatcgttcaccagcccagaactgacagaacataactgtgcttaaagagaagtgcaccctctagacaagtaccttctcagccttccaaatcacctaaactgcggaaggccagatggaatgcttcatggcagggtggcacatttggaattagaggtctgatctaaggctggtgcatgactgactg

SEQ ID NO: 171919 - DNA, 601 bp, Human
agttctttaggtattgtttgatcatatacaaagcaatctatagctcagaaaaactcagacttaacaaaataattgccttaactgtggttttataagtatttttataaattatatttatttgggtagaaggggaacttttgtgtttctctttgtcaccacaaagctttattctaaatcgctgaagacctcgtctgtagaggtacaatgtactaaaaggaaaaatgacttccctacatctgaggcttagctgcagcccacttctgaaagaggtagatcccttaagggcaaatgctgccattaytgtgattactataggatcgttcaccagcccagaactgacagaacataactgtgcttaaagagaagtgcaccctctagacaagtaccttctcagccttccaaatcacctaaactgcggaaggccagatggaatgcttcatggcagggtggcacatttggaattagaggtctgatctaaggctggtgcatgactgactgcaggaagggtcgtcgagcaaagagctattcaagaagaaacaaataaggtattgaagactaaattgccagtaggctctgccaccactaccaatattcaaaattg

SEQ ID NO: 171920 - DNA, 601 bp, Human
tactctatttgtgccttcaaaagttacttacatagacaggggttgcatgcaccatttaaattttctgagattcaaaattaaaaatgagcctagcttctgaataagttttgagaaatctccaaactatggcttgcaatttgtttgttttggattgtaggaaggattccattcaattaaatgaaacatgggtaggataataagtcaaaaattaactattaatatacctgaaaacagagctattgttggattttttttcaaatgatgtatgaacacacattttaaagaattaaaaataaaaacractcattgccatgtctccattactgaagagcaagcttttctatgcatatagagctgacttcaacagcacataggccagtatgtatagaattattcacgtgtcctgatgattgatagccagcctatctacctgtctttcttgcagatgtgttttatagaaagcccaccgccattgttaaggcttcagtgctgtcacacagatgcagctgtcataaatatcccctaacaactatgtttgctgcttatctgaattagttagaatgctgtttgcagctccagttttgaaagaagcagtttatct

SEQ ID NO: 171921 - DNA, 601 bp, Human
attgttaaggcttcagtgctgtcacacagatgcagctgtcataaatatcccctaacaactatgtttgctgcttatctgaattagttagaatgctgtttgcagctccagttttgaaagaagcagtttatcttccacctcctattatttctttttccattaacctcttccagggaagattttgttttcagttgtgataaattcacacaggtttcaaatccctgattatattttacagtagtcaaatgataaaattacagaatcattttcagctcaaagtaggatttgaagaataaaatggaawcttaaaaaccatggtttgagagatggacaaatcttatcctagctttattgatttggtatcctattcactagttacctaagaaaatatgcataaatctttaaatttgaactctgaactttgatagcatttcaaatagcttgtttgatacgactatttgggggccaaaagaatagtattcatttcattacaaatttcaataagtataatacatttgacattggatatatgggctttgaaaaattcttggaaaagaaagatgtgggttaacatgagagatcaaatgtaacactgccaaaaaag

SEQ ID NO: 171922 - DNA, 601 bp, Human
tagccagcaagaataagaataaaaaaaagagattcaatgggccatttttttatgctttcaacagtagtttgatgtagtggcatgtgataaactggaagtactgggagctaaaaagggtttgagtaacacaaaataaatacaatacaatgatgatttttaaggggatcacacttaggcaataatagtgtactttgtggaactccttcatgttttccagtaatacagggcctacatcaattctccataagcagcctgtgccttgaatataaataattctcctccttgaggaagtgggcatacraaacacaaaattgaaaagttaaacttggatttgggaggttaattcaaacaagagtcccttaataaaaagaactgcatttgccatcagccagttttaataaccgtgctttatgaaggcctttgtcccctgagcaaggcaaacctgattgcatggctcggtttttgcagcctccagaagagcacagttggtctcagcttagcaagatccaggtatgatcatctgaatcactggtgtttctcattaaatgagtgtggccattaatttcctagattcttgaaggcctttgcaagtactggctta

SEQ ID NO: 171923 - DNA, 601 bp, Human
agagattcaatgggccatttttttatgctttcaacagtagtttgatgtagtggcatgtgataaactggaagtactgggagctaaaaagggtttgagtaacacaaaataaatacaatacaatgatgatttttaaggggatcacacttaggcaataatagtgtactttgtggaactccttcatgttttccagtaatacagggcctacatcaattctccataagcagcctgtgccttgaatataaataattctcctccttgaggaagtgggcatacgaaacacaaaattgaaaagttaaacttrgatttgggaggttaattcaaacaagagtcccttaataaaaagaactgcatttgccatcagccagttttaataaccgtgctttatgaaggcctttgtcccctgagcaaggcaaacctgattgcatggctcggtttttgcagcctccagaagagcacagttggtctcagcttagcaagatccaggtatgatcatctgaatcactggtgtttctcattaaatgagtgtggccattaatttcctagattcttgaaggcctttgcaagtactggcttattcttaggtggataaacaatattattt

SEQ ID NO: 171924 - DNA, 601 bp, Human
gtctctccaatcatctgtgaatcgagattaacccgggcctgtacagaatggagttgtttcttacatgtgtatgtgtgctactgttggcatatctaaaatataatacataatcaaatatctgcttattcatgtttcctgtgtaaatatttatacaccacgtaggtcggacttgaaaagcgaggaagtgaatgaatcattatatttcactttcaaggaaagcttacatgaatttttgagaatgtcagctatcagaacatcttttaaattttaaagcatgagttacttatcatttaagaaatawccaaactgctaacattgtaaaagcaatttcatacttttaacctagtagataaatcagtggcccatttctaagctctttctcctaatagccaaccaatagtttctcaattcagattaaattttttatttgtattggtctcagcattaaggtcccttagatagaaagtgaacataaactaatattttcaaagtgaataaataaataagaaagtgaacaccttctagtatgatttaaaaaaaaaaaagttacccttgtgacttaaaaaaaaaaaattcagattgtcagccctcccttgattat

SEQ ID NO: 171925 - DNA, 601 bp, Human
gcatgagttacttatcatttaagaaatatccaaactgctaacattgtaaaagcaatttcatacttttaacctagtagataaatcagtggcccatttctaagctctttctcctaatagccaaccaatagtttctcaattcagattaaattttttatttgtattggtctcagcattaaggtcccttagatagaaagtgaacataaactaatattttcaaagtgaataaataaataagaaagtgaacaccttctagtatgatttaaaaaaaaaaaagttacccttgtgacttaaaaaaaaaaaattcagattgtcagccctcccttgattatcacattcctcagcttctttttttaacctttggaagaccacatccacagaattgtacaaaaagtggttatttgacaattgtctattaaaacacaataacccagtctagcaaagtgcctggcacaaaataggcacacaataaatatttgatgggtgaatgaatgattcacatgtgaaaatttgaggaaaaattaagggaaagcttaattgtttagagcattcaggatgtagcctccaagttggctacagattgatgcacaggaaaaaaattact

SEQ ID NO: 171926 - DNA, 601 bp, Human
gtagataaatcagtggcccatttctaagctctttctcctaatagccaaccaatagtttctcaattcagattaaattttttatttgtattggtctcagcattaaggtcccttagatagaaagtgaacataaactaatattttcaaagtgaataaataaataagaaagtgaacaccttctagtatgatttaaaaaaaaaaaagttacccttgtgacttaaaaaaaaaaaattcagattgtcagccctcccttgattatcacattcctcagcttctttttttaacctttggaagaccacatccrcagaattgtacaaaaagtggttatttgacaattgtctattaaaacacaataacccagtctagcaaagtgcctggcacaaaataggcacacaataaatatttgatgggtgaatgaatgattcacatgtgaaaatttgaggaaaaattaagggaaagcttaattgtttagagcattcaggatgtagcctccaagttggctacagattgatgcacaggaaaaaaattacttaactgtagttgcacagaaaaggatatttagaaaatatctttagaaaagagtacttacccttccccccaatct

SEQ ID NO: 171927 - DNA, 601 bp, Human
attcaaacagttgtcaaaccactggaaaaatgcttccttttcattgtgctttttttggacactatagatatggtaaatcatgaactgcgttataaaaatacctcttttgtgcccaaacattcagtaggagggaatgacatttcttttattaccttggtaaatgtttttaaggtgtttagcaataagccttctttttgtcaaaactgcttagacgcagtggttgctaagaatttattagaaaacctatagttaataatatcaagaaaagaagggatatgtgtttagtagctaatatgacagwtgagcttgtgtagcacatgcttttgctttttcctaccattttcttgatcttttgtgttatggaaaacaagttattcatgtttagaaagtttatttttcattattgcccatcaaccagcgtttttagcattttctccatcttttgggcagagaaatagattgttccaaatagtagggaaaaaaataaggcgaaaagatttctgaggaaagaaggatgataagattttaatacaaatgtgaagaagactattcatctttaggtctttgtgaattaactctttcttcggatatttgttgttgt

SEQ ID NO: 171928 - DNA, 601 bp, Human
ctaaaaaatgaggaaggtttgactgagaactattcaaaatagttattagccatgtgattataaaaaggaacacatgaatgatatttgcatgtttaaccctggttataaaaagtcatttgatttttttaacagcatgtacagcagttacaaatccttacaactttaggtaaaaatgaagaatcccactgtggaaagtgccacaaggaaagagctggattaggatgtattagtcacatgtgaaaaataaaaaatatgtatgtgcatgtctacatatgtgtgtggatgtgtatagttacaataratacttatattttaaacttgatttttaaaccaacaatggaaagtagcaactctgaaagaatttttcttgtgatttgaaagaactctttccctgtcccccgttcatgaaagttagctattattaaaagcctgactacttaggaaattatttgtgtgggtatttcagacataaaatgtgataaaatataaggtatacttctaaaaaaaaaagtacagctctaaataggtgaaaagaagaaagagaatatgcaaggaagaaagaaaataaaaaaattggaagaaaggaataaacattaagaag

SEQ ID NO: 171929 - DNA, 601 bp, Human
gtttcacacaaatgaggaagtaaagatcagaagtgttaaaaccatgcattccctaaagacacacagcaagttaatggcaaatctgggaaagaaaccaggatctggctggtgaagcagaaaaaaagtcaaccctggctccattctcaaatgttattactccacagtctgtgcctccctttaggtatacaggacacccaggcaaggcgagcaagggttagactgataagtttttcaggggtgaggtgggaccgggttcagaggcagcctccagtccactcaggcagagaggaggggactgatmcctgacatggtccgagaagtagtggggtagcctgggtggtggggctctgggaggctaaaatgatacattttcatgaatttttccacaacttttgcacttttgcttttgcttgtagactttttgtcttccaagaatcttagaagatttaaaacaatctttacaatctttgagcaggtgattcaaaacacattacctgcctgcccttctgtcatggaatgctggcctttctcaaaggggtgagtcttgattgccccacactaacaggtgaaagttatgtggtctttagcaaatcatttagct

SEQ ID NO: 171930 - DNA, 601 bp, Human
ttccctaaagacacacagcaagttaatggcaaatctgggaaagaaaccaggatctggctggtgaagcagaaaaaaagtcaaccctggctccattctcaaatgttattactccacagtctgtgcctccctttaggtatacaggacacccaggcaaggcgagcaagggttagactgataagtttttcaggggtgaggtgggaccgggttcagaggcagcctccagtccactcaggcagagaggaggggactgatccctgacatggtccgagaagtagtggggtagcctgggtggtggggctcygggaggctaaaatgatacattttcatgaatttttccacaacttttgcacttttgcttttgcttgtagactttttgtcttccaagaatcttagaagatttaaaacaatctttacaatctttgagcaggtgattcaaaacacattacctgcctgcccttctgtcatggaatgctggcctttctcaaaggggtgagtcttgattgccccacactaacaggtgaaagttatgtggtctttagcaaatcatttagctccctatactgtcctctcctacctgttaaagaaaggtctacgccctgct

SEQ ID NO: 171931 - DNA, 601 bp, Human
aagtttttcaggggtgaggtgggaccgggttcagaggcagcctccagtccactcaggcagagaggaggggactgatccctgacatggtccgagaagtagtggggtagcctgggtggtggggctctgggaggctaaaatgatacattttcatgaatttttccacaacttttgcacttttgcttttgcttgtagactttttgtcttccaagaatcttagaagatttaaaacaatctttacaatctttgagcaggtgattcaaaacacattacctgcctgcccttctgtcatggaatgctggcmtttctcaaaggggtgagtcttgattgccccacactaacaggtgaaagttatgtggtctttagcaaatcatttagctccctatactgtcctctcctacctgttaaagaaaggtctacgccctgcttcttaacatcctcacataacaatcagaattaattcccaaggaaatttttttaaaaaacagaaaaatactgtaaaattggtatgcatgccacaaaacgtatcattttggggagctgttcaatttgactgacaatttaaagaaaaagaatgcatgacaatccatgatgaactcatagt

SEQ ID NO: 171932 - DNA, 601 bp, Human
gtccactcaggcagagaggaggggactgatccctgacatggtccgagaagtagtggggtagcctgggtggtggggctctgggaggctaaaatgatacattttcatgaatttttccacaacttttgcacttttgcttttgcttgtagactttttgtcttccaagaatcttagaagatttaaaacaatctttacaatctttgagcaggtgattcaaaacacattacctgcctgcccttctgtcatggaatgctggcctttctcaaaggggtgagtcttgattgccccacactaacaggtgaargttatgtggtctttagcaaatcatttagctccctatactgtcctctcctacctgttaaagaaaggtctacgccctgcttcttaacatcctcacataacaatcagaattaattcccaaggaaatttttttaaaaaacagaaaaatactgtaaaattggtatgcatgccacaaaacgtatcattttggggagctgttcaatttgactgacaatttaaagaaaaagaatgcatgacaatccatgatgaactcatagtactttctttactttgattacctttctcatgctctccacatctctgt

SEQ ID NO: 171933 - DNA, 601 bp, Human
cagctctttatgagcaaggtactgtgtattattgagacctatttttttctccaatatttaaagttatatgaagttatggggcattttagctttagcttgattcttactttatatgggaaaaagttataaatgtgttaccatgattaggcttttgtctcttcttgggcttttgtttcatggttatttttggaaaggcttgctcagcggttggaagaaggaaaagaaatagtggtcctattcttttacataaatgtgataccaacccttagttggttatggttttcgtgagcttgtttgtatygtacattttgggggcctcattttccaggtggagtattttctaaaattgaagaaaaaaaatgaagaatcgtggaatataggaaaagagtccaaagtagggaaaacagactgagcaaaagggtatcagaatcattcaagactattgtgaacttgtgttattgcctacaaagaaatttggattcatttcaataattatagtagcatttaaccattcagaaactcattcatgtgactaagtaagaattcttattggtactgcacttcgcaaaataagtcagagaacttactttccttgcctcta

SEQ ID NO: 171934 - DNA, 601 bp, Human
taaaaaatatattaattgagatggctgtatgttcttaatgtttatggaatatgtggatagtgtagtgtagcactagtacctataggtaaattacactatattatagcgtaaaactccaagaaaatgcgtgtaaaatctaaatgaattttattctgtgtgaaaagcattcagacttctactaaatcctgtttctcatcctcaaatttttttttctatcccagatacttgcattatatttttaagcaatttatttttggatgctatgtggagaaatcattatcctttaaaacgactaacaaarattcatacattcagtttgcattggaggaggcgttaatttcctcctcactgaattgtacacagaagatgttttggaaattttataaatccccctttttgatgaatcagtatagcatactggctaaggatgctcatactggaaccagattccattgacacttatatttgcttgctatgcaaccttggtaagattatttaatctttctgtgcctctaatataggaatgtgaggcacaataggattattatgacgaatgagttaatgcatgtaatgtacttagaacagaactcttggtaaataa

SEQ ID NO: 171935 - DNA, 601 bp, Human
taagcaatttatttttggatgctatgtggagaaatcattatcctttaaaacgactaacaaagattcatacattcagtttgcattggaggaggcgttaatttcctcctcactgaattgtacacagaagatgttttggaaattttataaatccccctttttgatgaatcagtatagcatactggctaaggatgctcatactggaaccagattccattgacacttatatttgcttgctatgcaaccttggtaagattatttaatctttctgtgcctctaatataggaatgtgaggcacaatagkattattatgacgaatgagttaatgcatgtaatgtacttagaacagaactcttggtaaataatagctactattactactattcatagttatcatcatataaatcttactggaaaggcccaagtactatttcataggaggaatatttctttgtatatataagctattcttttgcccttcatactgccccatcagcaacactttagaaaaaggattaataccattgactaggaataaaatatacagttatttgaaaatcttggtcattatatgcagtttttatttgcgtgttcactgtaagtc

SEQ ID NO: 171936 - DNA, 601 bp, Human
tatttgcttgctatgcaaccttggtaagattatttaatctttctgtgcctctaatataggaatgtgaggcacaataggattattatgacgaatgagttaatgcatgtaatgtacttagaacagaactcttggtaaataatagctactattactactattcatagttatcatcatataaatcttactggaaaggcccaagtactatttcataggaggaatatttctttgtatatataagctattcttttgcccttcatactgccccatcagcaacactttagaaaaaggattaataccattsactaggaataaaatatacagttatttgaaaatcttggtcattatatgcagtttttatttgcgtgttcactgtaagtctggtcttcttatgaaaaaaatttcattactaaaagcactttgatgtggctactgtaattgtatagtttgcataggtttttaaagttttataaattatgtgagtgcttttgcttccaagagtgacatggttctcttgttagtttaagagcaacacctcaggccctgcttgatccaaagaagaatgtttgatttcctttacattccaagggaaacatctgctttg

SEQ ID NO: 171937 - DNA, 601 bp, Human; identical to SEQ ID NO: 23762

SEQ ID NO: 171938 - DNA, 601 bp, Human
gggtggccggggccccctccgatagcctccctggtttacctcacccgggctggtcccggccggcccccaggtgggcccggcgccccagtctcctgggcagaggagcagcgcctcccggtccccggctcacggtgcttgccccgcaccttcgcctgagctggttccacttaacccgcaccaacctgctggatgtagccagtgggaaacccaggctgcgtgagcctagccactactgtgtctttctcaacaatgagcagctggaatcctccttacacctgctccgaattgacgatattcacayaatttttttttaaatcattgttctcagaattccaccttactccatttaattatttccacaatattcttttaaagataaataaaggaaaaaggaaatactgtagagaggagagagcattaaatattctgggcccattcattaactggatcctcctgttttctagaagctgaacatggttatgcctccatgttaccatacaataacaaggacagagatgccttaaaacggaggaacaaatccaaaaagaataacagcagtagcaggtaatttggtaaatacttctttctgtcttttagatta

SEQ ID NO: 171939 - DNA, 601 bp, Human
aagctgtgaatctcactggagatttggttcatggtcagttaaatcacatattaaagtcctatgcatagtttctggtacatgcaaatagtccatcaatgttgctgcccgtttccccccttctttgcccttaaaatatagttggctaggaaatttgttctattagatcccttcaactatacctttcctgccagtaaattaaaagcattgaccttttcgtcactagtttagaatccttatccctccctcaccctcatgaataactccttgcaagtatctatttggatatcctctgtggcttaayacagaccaggaatttcccacttaaacctaaaaatcacttgttcttgctgcgtcttctgtacttggtttacctctttagtatcgttagtggaaccacaggatgtgagcagcattacttgtgccatgcccttgaataaaaatggcacttgaaggatcaacctggtaattacctggtaggttttgcttgtcctcccaccttagcattacctgaaggtggtagccagtagttttgtgcatgggtatgaaggcactttaagaaagatgttaatactgacttgtaatatgcaatggtgtaaaacca

SEQ ID NO: 171940 - DNA, 601 bp, Human
aatacagaccaggaatttcccacttaaacctaaaaatcacttgttcttgctgcgtcttctgtacttggtttacctctttagtatcgttagtggaaccacaggatgtgagcagcattacttgtgccatgcccttgaataaaaatggcacttgaaggatcaacctggtaattacctggtaggttttgcttgtcctcccaccttagcattacctgaaggtggtagccagtagttttgtgcatgggtatgaaggcactttaagaaagatgttaatactgacttgtaatatgcaatggtgtaaaamcaattaagctgtgttgcattttgttacaatatttttttaattttgtttagaagaattttgaggcctttcagttaatttttctggaaaagcatcatccatttttgcttttattattgtccactaatgatttgagaggaattgtccaagttacttattgaggcttaataccttaacactttgtttttttccttagtttcacaggaaggttgtaggggatgttcactagtggggataagaaaatgagatgttgaagtggcttggtcccaaaaggtgattaggaaagaaaaataatagtagtta

SEQ ID NO: 171941 - DNA, 601 bp, Human
ttttctggaaaagcatcatccatttttgcttttattattgtccactaatgatttgagaggaattgtccaagttacttattgaggcttaataccttaacactttgtttttttccttagtttcacaggaaggttgtaggggatgttcactagtggggataagaaaatgagatgttgaagtggcttggtcccaaaaggtgattaggaaagaaaaataatagtagttaagaatcttaagccaagaaatggattctttctagtatcttctctttaataatcagtactatgccaaaaaaaaaaaaataaaggctacaaatccttctgttaatgggttggtttgctttccatggttagagacgggattatcacagttgtccatacacctgactgatagtgagttagtgtaatatattcagtggtgtaaggatttctgagagaccatgattaaacctagaggtagcaccagccaaacgtgtgaggcaagagcaggcagttttctttcagtgtgatcatttccttcatgactcatttggaatagctccttttctgaggaacaagcaatcataatggagaaagcagcttgaccccatggtttgaatcggct

SEQ ID NO: 171942 - DNA, 601 bp, Human
tatctcagatacaccgtaatttggcttagtttttttttattagagtgtatttttaaatggtgaaatttgacctttatcagtgattccagagttatccattgttttccataatcacatggaaaatagttttgacacaaggtatcagtgtgttcttacagtgctttaattaaaaacgtaaatgtttacccatcaatggaggtggctggcagtctcggaactgatcatttttgaaagggctgctttttattaataactcagtttcagtaaactagatgcacttcagtaatgctctagccattargtacaagtccccctttaaaaagcaccatgtgtttaacactcgagtaatcaaataaaatctgtagttttaaaaattttgttcaaattttggaagaagttgtgcttcctatggagtttgtttaaaagtttattttggggattcagaattttgcataagtatataactctatttattagtttatatattttcaaagaatccagaaatattttggtaagaatttcctgtgtgctgttattttctactctcttctcaacctattcactttcctctcctccacctacaaggggtggtccttgtcta

SEQ ID NO: 171943 - DNA, 601 bp, Human
tcagatacaccgtaatttggcttagtttttttttattagagtgtatttttaaatggtgaaatttgacctttatcagtgattccagagttatccattgttttccataatcacatggaaaatagttttgacacaaggtatcagtgtgttcttacagtgctttaattaaaaacgtaaatgtttacccatcaatggaggtggctggcagtctcggaactgatcatttttgaaagggctgctttttattaataactcagtttcagtaaactagatgcacttcagtaatgctctagccattaagtayaagtccccctttaaaaagcaccatgtgtttaacactcgagtaatcaaataaaatctgtagttttaaaaattttgttcaaattttggaagaagttgtgcttcctatggagtttgtttaaaagtttattttggggattcagaattttgcataagtatataactctatttattagtttatatattttcaaagaatccagaaatattttggtaagaatttcctgtgtgctgttattttctactctcttctcaacctattcactttcctctcctccacctacaaggggtggtccttgtctacagt

SEQ ID NO: 171944 - DNA, 601 bp, Human
tttattaataactcagtttcagtaaactagatgcacttcagtaatgctctagccattaagtacaagtccccctttaaaaagcaccatgtgtttaacactcgagtaatcaaataaaatctgtagttttaaaaattttgttcaaattttggaagaagttgtgcttcctatggagtttgtttaaaagtttattttggggattcagaattttgcataagtatataactctatttattagtttatatattttcaaagaatccagaaatattttggtaagaatttcctgtgtgctgttattttctaytctcttctcaacctattcactttcctctcctccacctacaaggggtggtccttgtctacagttaaagagggtaatctcaaccaactgttggcatatactttcatccattttattttatttatttatttatttttagacagtctcgctctgttgcctaagctagaatgcagtggcaccatctcgacttactacaacctctacctcctgggttcaagtgattctcctgcctcagcctcccgagtagctgggattacaggcgtatgtgaccatgcctggctaatttttgtatttttagtaaag

SEQ ID NO: 171945 - DNA, 601 bp, Human
gccccacagaattcatgagctgaaccagggagtaaactcctgagctggttaaattctagagaattttcatagaaaggtcaagcaagattcagctcctttataatactggtagcttcttccaaatttataactggttaggaaggggttgtgtgaggaggacactaaaggggccacattgacttcttatgactttatggtaacttgtccataaagtcttaggccagaccttgtctttaaggtcagccataaatacactaatcatatggtttcatatccatcacacctttcatccaaggctctytaatcagttttacagctgttacctcattggtccatacttgttcagtaaataattcgtaattatttttattctcattttatagacaggttaaccagtaacaggatggtaaagaattttattcattccacagtatatcagtggcaaagctggacttcacatttcactaacttctgctttaagcaacctatcatctttatattgagctgaactttggaaaccccttcctaaaatcatttggttgctatttaacagtagcatcttgtacatgatagttacttcagggagtcagaagtttgggga

SEQ ID NO: 171946 - DNA, 601 bp, Human
gcggggagctttgttgcattctctgttcatgcagttcaaacttggttgctctttttgactcttcccactagtagcacctgatttcagaattcacccagcgccctctaagcagcatcgctcataaattacttaggtagatgtagagcttgccagttaaaagaccacacccctaaccctcacccgcaccagcccactcctgaagaaggcctttgaatgactattccacagaccaaagcattttagtcagaggcaacatttccacaaatagtgtttttaaaaaaattacatgctactgaatatmattggcagtgttatctaaaatacatatacacagatatatatacacataatatacatgtaagtatatattaacacatgtgtattaacgtgtatgtatgtgtatttgcagtttacttgtgaatgaagagtctcaaaattcaggcaaatgtatgcatggcagaaattggagatggtgcctaactagaggaggactgccaccctcactgggctccatcttgccgcagcctgagtggaatctctctcacctggattgcctcttgctgcttacttaaatctttattttccaaatcaagttgcccct

SEQ ID NO: 171947 - DNA, 601 bp, Human
ctggccaggtacagtggctcatacctgtaatcccagcactttgggaggccaaagtgggtggatcacctgaggtcaggagttcgagaccagcctggccaacatggcaaaaccctgtttcaactaataatacaaaaattagccaggtgtggtggcacgtgcctgtaatcccagctacttgggaggctgaggcaggagaatcgcttgaaccctagaggcggaggttgcggtgagccgagatcccgccactgcactccggcttgggcaacagagtgagactccgtctcaaaaaaaaaaaaaaaaagtagagtgactaatgtaatcaactcctatgtatccattacccagcttcagtaattatcaacattttgccagtcttctgtaagcaaaaccacctattcccatgaagtattttaaagcaaattttcttgtatctctagtaaacaccaaaaaaaaaaaaaaacacacaaaacacccaaaacaacaacaaaaaaaaaaccacttgcttttaccatactgaaaaaaattaatgataactttttgtggagcttttaaaagccaacaaacaaacaaacaaaataatgcccagaccttacccttagca

SEQ ID NO: 171948 - DNA, 601 bp, Human
ggcaggagaatcgcttgaaccctagaggcggaggttgcggtgagccgagatcccgccactgcactccggcttgggcaacagagtgagactccgtctcaaaaaaaaaaaaaaaaagtagagtgactaatgtaatcaactcctatgtatccattacccagcttcagtaattatcaacattttgccagtcttctgtaagcaaaaccacctattcccatgaagtattttaaagcaaattttcttgtatctctagtaaacaccaaaaaaaaaaaaaaacacacaaaacacccaaaacaacaacaamaaaaaaaccacttgcttttaccatactgaaaaaaattaatgataactttttgtggagcttttaaaagccaacaaacaaacaaacaaaataatgcccagaccttacccttagcaattctgatttaattggtttgggttgaggctctgcactcgtatgtttcaaaagctccccaggtgattctcatgtgcagccatggcggagaaccattgaactagcctcattctggtctctgagctcccatcaatttgaaatgcgggctacccatccaaattgagtgctttctcagtgccctgcatgaac

SEQ ID NO: 171949 - DNA, 601 bp, Human
tcaaaagctccccaggtgattctcatgtgcagccatggcggagaaccattgaactagcctcattctggtctctgagctcccatcaatttgaaatgcgggctacccatccaaattgagtgctttctcagtgccctgcatgaacaagaaaaggatgtgtaatgatggctctataaagacatgtggttatttcctgccaaccctctttgaaaaaggagcctgactctgaaagtcaggatctgaatgatatttatgtttaatcagtgaaagggcagactaaacccttcccaggcaggtagaatcygggaagagggcggttagctttactccactatggaatttcgtgtgtgtgtgtgtgtgtgtgtgtgatgctgagtgtgcctcactgcatatatgcttctgctcatcccatcgtcttcccttttaattgttctatgattgtgactgaccatgttttaagttggagcttcctttatgctttagctatttacatatcatgaactagaaactcaaaagtatctcttcttaaaggggaaaggtagtcagttgtggcttctctttctcatttttagattttctcttcagattctctcccttcttcctg

SEQ ID NO: 171950 - DNA, 601 bp, Human
agtagctgagttctataaaagaataccactcgggtaaatgctaatatactttagccattttttacctgataacattgcataaaaagattatcatggctttcattgcttcttggccttttggctaaaatcaagtgtaaaaagattgccatggctctcaaaaaaaaaaggaagaagaagaaaagacaacttaggaaaagaacttctaacagtgggattttcccttttcttgatattgcagagttgattatacttgggttagttttcttgaatggaaaccttttctatggcactttagagattstaaataattagtgttactctatgttatcaggactccactgtaaggatattatacccaacaccaacactttgaagtatcttcgcattggtgggacaataaaagaaaagacttctagaatggtggtggtggtagtattttctactcaacagaataggtgttgagcacctaagatgccgtgtagtaggtgctgggactacagaatccagtaaagactacgcactgctgtggaggagctcagattaatatcactctacagggggtttgtcagtcagcacatggcctgtgtttctctgcatttta

SEQ ID NO: 171951 - DNA, 601 bp, Human
ttttgtgtagaaagttagaaaattcagaaaagcacaaagaatataaaaatcacctgtaataggcctctcagaggtaacacctgctaacatttgttctatatccatctagacttttgtgtgtacttttttttaaccaacatgggatcatatagtaataatttgtagcatcttttccagttataaacattttccaatgtcattaaatctcctttttcaacattacttaatgcccagtattatattatatgaatatgttaaacctcatataatcagtcccctggtttagattcttcccagaacytaaacaatgctttcttaaaccacctgtagaaaaatctctgtccaacatcataattatttccttaggataaatgtatagctatggaattggtggtgaacacgtttttaggattgctggattgtccaccaggcaggttacaggcattattttccctgcacttcacaagttgatgttataacttaaaacctttatgagtttgataagtaaaaaataaaaaaacacacaggcaacttgttttaatttgcatttctcatactactagcatagttgaacaatttttatgtctttgactctgtgtgt

SEQ ID NO: 171952 - DNA, 601 bp, Human
caatttttatgtctttgactctgtgtgtctctttgtgtgaattgtctattaaatagcctttgcccaattttctactaaagaatttatctttttctttattttaaaaagtttccataatataaaggacatatatgaaagatattgacactttttctatcacataactgtccagtttatcatttagctatacagaatcagtcttccctcactgattcaagttgctacctttggtgtatacttatttttgtttatggctaagtctctttctagacttattcttccagtccattgatccatctcktcttcctgtgccaatatataccctttcattctcctttttttttttccatgcccttatctattttcaccagtttatttttcctgaaaaaaattttaatctgtgaattccccaacccctaaattctttggggagtttaaaaattgacattgcataattccaatataaattaacctttaaaagttcatgcttatatattagatcttttcatccaggatttggtatgtgccttaatttattcagatttctcttctgtctctaagcaaagttttgtagcaaagttttccacacaggtcttataca

SEQ ID NO: 171953 - DNA, 601 bp, Human
acccctaaattctttggggagtttaaaaattgacattgcataattccaatataaattaacctttaaaagttcatgcttatatattagatcttttcatccaggatttggtatgtgccttaatttattcagatttctcttctgtctctaagcaaagttttgtagcaaagttttccacacaggtcttatacatgtcctgtaaaaggtattcctggatttatatatttttagattgctattggtttcccatcttagttaactaattgattattgttggaatataaacatatttgaatcttttgtygttacataccctttattgatgataattctgctatttctttctcttaactgagaattcctccaatttaaaacaaagcctttcaatgaatccctcagcaaatggagactgagcaaacacatataagctacagccaataggtcaggagccaggtggtagaatagactcttttttcaaaagatggctctggcgtctcctttaatagtagacatccatttttctggagtggtacatatgcagctcttgctagaattaggtgcctggtctagagctactacctctgccagagtcttctgaccctgt

SEQ ID NO: 171954 - DNA, 601 bp, Human
ataatagttctctctctttttttgagatggagtcttgctctgtcacccaggctggagtacagtggcacaatcttggctcactgcaacctctgcctcccaggttcaagcgattcttgtgcctcaacctcctgagtagctgggattacagatgtgtgccaccgcacctggctaatttttgtattgttagtagagatgggtttcgccatgttgcctaggctggtctcaaactcctggcctcaagtgatccaccctcctcggcctccgaaagtgctgggattacaggcgtgagccactgcgcccrgcccagcctgttacactttcaataaagagaactaatcacagataacagtgcttccttcaaacacacacacatacccacacacccttcatttggtaccacttctggtcttgattacatccaagtcaggaagaactttaaggatagtatatttaatgcaggaggcactatctacagatagcaccatctacctaataatcctactctgttgaatctattccccaatttgcagatctactagcctgagagagatccatagatagaatcaaggaagcatggtctggaggcagaaataagaagagc

SEQ ID NO: 171955 - DNA, 601 bp, Human
ttaacctcctcactctcttgccattttctgaataatccattctttccctaaggatttatggtgttatctcctttatgtgctaaattcctatctattcttaggtctgtttctggggatttctatcctattcatttgatttgtctgcctattcctgtattagtactacactgtttttaattattgaagctttataatacaatttaatatctggtacagcacattcctcctcattattcttcttattcaaaaattttggcagtgtcacacacatctattcttctagatgaagtgtagtcccagygttaaaaagaacactgttgggagtttttttcttggaattgtgttaaatttgtaaacaaacttgaggaacattgacattttttgtttggaggattcatatccaggaatctgctatttttttcatttactcaattttcttgtgtctttcaacaaagttttatagttttcttcccatagatccttcccaacctgttttaaatttgctcctcaatatgttatactttcttcttgctattgcacatgagatatgtgaagatctctgtgcttggacttcccaagtcaatacatatttgcctctatt

SEQ ID NO: 171956 - DNA, 601 bp, Human
ttcttctaattggaaaattagctcatacctgtaatcccagcactttgggaggctgaggcaggcagattgcttgaggtcaggagttcgagaccagcctggccaacatggtgaaaccccatctctgctaaaaatacaaaaattagccggacgtggtggcgggcgcctgtaatcccagatactcaggaggctgaagaaggagaatctgttgagcctgggaggcagaggttgccatgagctgagatcacggcactgtactccagcctgggcgacaagagcaagaactctgtctcaaaaaaaaaamaaaaaaaaaaaaacaaaaaaagaaaattagtctataagttttatggcaagaaatagacaaatttataaatgtataaattatactttctcatagtgtttctaataacatgatctattttcatggctctttttgaagaatattatccaagatgaacaagtatattttacatacaagttttcttcccttccctggtccccaccacatgcagtagtgggaggagcacacctgtaacatgagtctttgctctgactctgccacatggacaggtttttcagaagaagtgaaagacttacaaaatag

SEQ ID NO: 171957 - DNA, 601 bp, Human
tgaatgctgtactccccaagcttgccaagccttagagcacccttggagagtttaggacaacttcctcatgacctagaagaggcaggaggctcagaaggaaggaagtctaatgccttgcttactagccctgccttaggggaacatcctgaagtctccctggagagtgtgaattgacttcttacattaatatcatgcatattcacctgtcctatagctttctgaagccatttcctttctttggtctatattttcaacttttgctattacagtacaattcttaagaggaaaaagggcaaacctrtaaggcattgcattgtttcccaattcagctggaggggagcctcctagaccccagggaactctgctccaagtaggttgtgtgtgggcaatgaatgttatctaaaacctgaagactctgagcactgctgaaggtgcaaagatgcagtagagatggactctgtcctctagaagcttaaagtctagttgaatagatgacataatccattcagcaaacacttattaagcatgtgtgtgtttgaggcacggtgacagcacagcaatgattaagctgcaatcctgactttctaaggagactgcaatg

SEQ ID NO: 171958 - DNA, 601 bp, Human
tttaggacaacttcctcatgacctagaagaggcaggaggctcagaaggaaggaagtctaatgccttgcttactagccctgccttaggggaacatcctgaagtctccctggagagtgtgaattgacttcttacattaatatcatgcatattcacctgtcctatagctttctgaagccatttcctttctttggtctatattttcaacttttgctattacagtacaattcttaagaggaaaaagggcaaacctataaggcattgcattgtttcccaattcagctggaggggagcctcctagacyccagggaactctgctccaagtaggttgtgtgtgggcaatgaatgttatctaaaacctgaagactctgagcactgctgaaggtgcaaagatgcagtagagatggactctgtcctctagaagcttaaagtctagttgaatagatgacataatccattcagcaaacacttattaagcatgtgtgtgtttgaggcacggtgacagcacagcaatgattaagctgcaatcctgactttctaaggagactgcaatgaatggttaagtaagaaatatgaaacaagtcaggcagtacagtgaacttcc

SEQ ID NO: 171959 - DNA, 601 bp, Human
tctgctccaagtaggttgtgtgtgggcaatgaatgttatctaaaacctgaagactctgagcactgctgaaggtgcaaagatgcagtagagatggactctgtcctctagaagcttaaagtctagttgaatagatgacataatccattcagcaaacacttattaagcatgtgtgtgtttgaggcacggtgacagcacagcaatgattaagctgcaatcctgactttctaaggagactgcaatgaatggttaagtaagaaatatgaaacaagtcaggcagtacagtgaacttcccagtgaatartataaacagttaagtggtgcttagaaaatagaggaatcactgtgagctaggatggcttgggaaggctttaaggaggtggtaagcttaagcaaaacccccaaatctcagctgcttcttacattcatagaattttccaggttctagaataaagcacaaaccatttcaaggaaatgtaaatttctcagttggagcaactctcgtgctctctcttcagtcagttgccgtggctgctgcttcatccagcccttctccctctcccactccgtgccattgcatcagtctgacatactccaagaacaa

SEQ ID NO: 171960 - DNA, 601 bp, Human
gatggcttgggaaggctttaaggaggtggtaagcttaagcaaaacccccaaatctcagctgcttcttacattcatagaattttccaggttctagaataaagcacaaaccatttcaaggaaatgtaaatttctcagttggagcaactctcgtgctctctcttcagtcagttgccgtggctgctgcttcatccagcccttctccctctcccactccgtgccattgcatcagtctgacatactccaagaacaaaaagtataaaaaatgactcagtaaaaacccccatcacttccttccttatckctgtctgactgttccttgccttctccctgcccagccagtttcttatgtgtcattccagagtttgtctacatacaagaaaacatgaatatagattcttgttttcctccatctttaagatagcatggtatactcacagtttggaatcttgcttttctccacttaacaatatatctggaaaatctttcctaataggacataaagcacattctcattctttttgatagctacatagtactacacggtgtggatgtagcataatttatttaaccagttccctcctgggtggtcatttgggttgtt

SEQ ID NO: 171961 - DNA, 601 bp, Human
cagatattattccctaccccagcacttgtattatcaatagacttagcttcgaaaaccttggattttgcttctcattggttttcaccagagttgtctggttcaaaatatgtttattcagcaaaaggtcattggtagcatttgccatcgcaaggcctgggcaacttcacactctttgagaactcattctgcctggggtgcttctggcccactgtgaaactctcaaatgctactgtggtcttgttttcatagacgggctcatcttcgcttgtgcctggagaagttgaaggggctggtgccactkggacccgaatcaagtcgacacactacgttgagtttattaacaaaagccaaattgcacataaaggtaagtgtattgttgggatgctgctttatctttacctgttcagtgagggtttgtctgttgttacatctccaggacagtcctctcccctgaactcctccagtctagctattggatgaatcacaggtacctcaaatgcaacatattcaaaacccaactgagtgtttctcactcccatgcaccagaggttaaatggtccatccaactctccatccagttgtacaagccagaaattcagga

SEQ ID NO: 171962 - DNA, 601 bp, Human
catcttgttccccaattcccctttctccagcccttcttccagtccctggcactgtcatattgtcttactttagggcctttgtcaatgctcttccctctgcttggtacactttcctctctcttcttcacctagaggacttctacttattcttcagatcacagtgcaagtctctctagctctgataatccttcgctgactttcccaactcagtgacctccttcctgtgacaggtggtcccatcactgggtatctcttagccctgtcataactgacatttgacagtggtttgtgtgaccattgkgttgtctcaatccttagactatacaccccacgagggaggggactgggtctttgtgctcacctcacagccccagcacctcctagggtatcgggcacagagttgacactctctttgctacctgaatagcaaagggtaaggggaattggattcaaagtcttgagagccacagccaaaatccctgtttagcatgtttgtataatcatattatagttggacaaatgttactttaattatggttagaagcctgcattcatgacaattctgggagaaaacctctatttaaagcaaaacagctacaat

SEQ ID NO: 171963 - DNA, 601 bp, Human
ttaaacaatcttcttaattatctgaagaatatgagaagctgggggcagatttataaaaatgagtattctatggaaatgtgttttctaaactcttctgttggacaaattagaatcaggacatcaaaagggactattatttcctgctaacaaacagaagttaattgagatttggcatgacacaaaaaagtgcttatgtaattgggacatgtacttgaataaacatagttttaaatggaagcgtgtttcttaagctcccatcaagtgcagttttctagtccggagatcaggtgttcaggggatygctgcaaacaagggagatcaggttggggactgctgcctgcagtctttctgatactaaaactgagggctaccagggtgccagtatgtgagagctcacccccagaatccctgtgacaggacaagtacccccagcactggcgatgctgaagagtcagacgaagccaggagtcactggccagtcgacttcctgtctcagggagaagcttgatgagtggcaccgaaaggcgtctgaggaagtgtggcgcattccactgctagaagggaagatgcgggggccattgcccatttagagatctccctg

SEQ ID NO: 171964 - DNA, 601 bp, Human
cagcttcagcgagagcagcgacacctgaagaggcagctggagaagctgggcattgagaggatccggatggacagcatcggctccaccgtctcctcggagcgctccgactccgacaggggtgagcctctctcactctcctccctgtctcccttgtgctccccaaccccagagcaggggttcagtactgcggacaggaggcagagtgtaagaagaactaagacactgggtatgatgtagagaagtcgaacagtgtgacctccagtgacaggttccttctccctgctaacacttaggtgacaaycccagaagagtttgattggtgtcagttttcagcctagtttgttttgttttgttttgagacggaatcttgctctgtcacccaggctggagtgcagtggtgtgatcttggctcactgcaacctccgcctcccgggttcaagcgattcccctgcctaagcctcccaagcagctgggattacaggcacacaccacaatgcctggcaaattttcctatttttgtagagatgaggtttcaccatattggccaggctggtctcgaactcctgacctcaagtaattcacccaccttggcctcccaaag

SEQ ID NO: 171965 - DNA, 601 bp, Human
gagcgctccgactccgacaggggtgagcctctctcactctcctccctgtctcccttgtgctccccaaccccagagcaggggttcagtactgcggacaggaggcagagtgtaagaagaactaagacactgggtatgatgtagagaagtcgaacagtgtgacctccagtgacaggttccttctccctgctaacacttaggtgacaaccccagaagagtttgattggtgtcagttttcagcctagtttgttttgttttgttttgagacggaatcttgctctgtcacccaggctggagtgcagtsgtgtgatcttggctcactgcaacctccgcctcccgggttcaagcgattcccctgcctaagcctcccaagcagctgggattacaggcacacaccacaatgcctggcaaattttcctatttttgtagagatgaggtttcaccatattggccaggctggtctcgaactcctgacctcaagtaattcacccaccttggcctcccaaagtgctgggattacaggcgtgagccaccacacccagccaaatttttgtattagtagaaacagggtttcactgtgttggcccagctggtctcaaactcc

SEQ ID NO: 171966 - DNA, 601 bp, Human
actcctaacctcaagtgatccacccgcctttgcctcccaaagtgctgggattacaagcatgagccaccacgcctgagctttctgcagagcgctttcatcaatgtccttctctcttgtcctccctgcagaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcrtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacat

SEQ ID NO: 171967 - DNA, 601 bp, Human; identical to SEQ ID NO: 26796

SEQ ID NO: 171968 - DNA, 601 bp, Human; identical to SEQ ID NO: 26797

SEQ ID NO: 171969 - DNA, 601 bp, Human; identical to SEQ ID NO: 26798

SEQ ID NO: 171970 - DNA, 601 bp, Human; identical to SEQ ID NO: 26799

SEQ ID NO: 171971 - DNA, 601 bp, Human; identical to SEQ ID NO: 26800

SEQ ID NO: 171972 - DNA, 601 bp, Human
gggattacaggtgtgagccaccatgcctggccagctgcaggcttttaaagatggtctataatttacagatctgcatcttagcaaatgggaaagccacacaataacagtatagttatctcaaaagagaacactcatgcatttgagagtaaaccacacaaaggatattaaggtgtctggatttgagggaattaactttcatcaactaacaccagcaatgtttttctagtctagtgtgtagcttttagttcacaagttgaatatttttaaagtaaccaaggccaattcagactcactatacacatatttttatttttttactgtggaaaatttcaaatttatatatggagaagagtagtatacatcacccatatgctcactacaaatgtttgaacttattaactgtaccttgaatactcctcaaaataatcttgcagtataaactttcgggaagtttgtctcagaatatgattccaaagtattggtgacaagaaatcaaatactggtattctctaacttaacatggagatgccgaacactcagatgtagcaaatgaaggaatttccagtgagccatttaggtatgtgggtgataaaaattcaga

SEQ ID NO: 171973 - DNA, 601 bp, Human
agctgggcacagtggctcaagcctgaaatcctagcactttgggaggccgaggtaggcagttcacttgagaccaggagttagagaccagcctggccaacatggtgaaacctcatctctactacaataaatacaaaaatcagccaggtgtggtggcgcatgcctgtaatcccagctacctgggaaggggaggcacaagaatcacttgaacttgggaggtggacattgcagtgagctcatattacaccacagtactccagccagggtgacagagcaagacactgccctccctgcccccccaccaaaaaaaaaggacataaaaaacactgacaaccaaatacaatcaataatgtttaaatggatcccggatgaggggaaaatagttttttcttacagaattaataaatgtagaaagaatgagagaaatagaaaatcaccattaaaacaccacagtaataatttctaaaggaagatccacccatggaagctcacattagttgatgaaaccttaaaaggggaaacagggtatctgaatagcctcaaagtacctccactaaaatatttattaaaaattggttttgggacaggtgcggtggctcacgcc

SEQ ID NO: 171974 - DNA, 601 bp, Human
tcactggcaatgacttgtaaaaattttaaagcaacgaggccaagacaaagtttaatatattgggactatattttgtctaaaaaaattagagaataaaaatgttatataactcaaactaataaaacacaatgggaattctattaccaagatcaatgctgacaggcaacactgaaatgaagttagaaaaagtcacttgcggctggctgtggtggctcacgcctgtaatcccagcactttgggaagctggggtgggcggatcatgacatcaggagatcaagaccacctggccaacatggtgaamccctgtctctactgaaaatacgaaaactagccaggtgtggtggcgcatgcctgtaatcccagctacttaggaggctgaggcaggagaatagcttgaacctgggaggcagagtttgcagtgagctgagatcatgccattgcactccagcctgggcaacagagtgagactctgtctaaaaaaaaaaaaagaaaaagtcacttgcatttaagagtaaataaatgaaaaagaatatgctttacttaatttatatgcagaaaaaactaactttttaaataagaatcgaagcatatatacatatta

SEQ ID NO: 171975 - DNA, 601 bp, Human
aaaaacaaaacttcccttttctgctggtgttccaggtaggtgaggctatgtgataaatagaacctggatgtttaattataaattcaagtagcagaaaaaaattccaatttttacacctacagtgcaaaatatcaaatgacattataggccattttaaaattctttccatagcctcctaaacagatttgttaaaataaaaaactaattcaaaagactagaaagctactaaaatagaggaatatacaattttatttcaagtacagttaattaatttttttttagagatgtggtcttgttatgytgcccaggctggtctcaaattcctgggctcaagtgatcctccagcctctgcctcccaaagtgttgggattacaggcatcagtcactgtgcacatcaacaattaatagtttgagagtcactggcaatgacttgtaaaaattttaaagcaacgaggccaagacaaagtttaatatattgggactatattttgtctaaaaaaattagagaataaaaatgttatataactcaaactaataaaacacaatgggaattctattaccaagatcaatgctgacaggcaacactgaaatgaagttagaa

SEQ ID NO: 171976 - DNA, 601 bp, Human
ggcgcacagcgagactctgtctcaaaaaaaaaaacaaaacttcccttttctgctggtgttccaggtaggtgaggctatgtgataaatagaacctggatgtttaattataaattcaagtagcagaaaaaaattccaatttttacacctacagtgcaaaatatcaaatgacattataggccattttaaaattctttccatagcctcctaaacagatttgttaaaataaaaaactaattcaaaagactagaaagctactaaaatagaggaatatacaattttatttcaagtacagttaattaatttttttttagagatgtggtcttgttatgctgcccaggctggtctcaaattcctgggctcaagtgatcctccagcctctgcctcccaaagtgttgggattacaggcatcagtcactgtgcacatcaacaattaatagtttgagagtcactggcaatgacttgtaaaaattttaaagcaacgaggccaagacaaagtttaatatattgggactatattttgtctaaaaaaattagagaataaaaatgttatataactcaaactaataaaacacaatgggaattctattaccaagatcaatgc

SEQ ID NO: 171977 - DNA, 601 bp, Human
gaatgaaaacagtaatcccttcactttatatcagaaccattaaaaaagcattggagagaaataaccaacccatatctgaagtttttaaaaaagacaattatcaaaaaaagaaacactttaaaaatgcaaaattgttggaccaacactttaaaatggacacatacatcaatttgacaaagcatatttggaaagaaaagttacccatatttgacaggccttaaacaacattttggattgctctttgggaaacaaaatttgaggagcaactcaagcatttggaagatctgggtatgaagcccaratggtgacctcaagaaaggagggtattttgccccttagttggtgaaagtagttctaaggcatcagctgctaccaaacgggtcagaaagcttgaactagcaccaaagtagcggacaagttatacttggtcaacactgagaagggagaaaagtattgctagagagacaaatagaaataatatctcctcccgcccccctcccccaaatatcaaacaaaaaaacttcaggtggttagtgaataccctttcaagagatttcattttatgtttaagaagatacaattaccttgtgaacgctgtgtg

SEQ ID NO: 171978 - DNA, 601 bp, Human
cacaaaatgcatggtatcatagaagtacccaacagatctaaattccttagttacagcacaattttactaaagattgtcaccaagctagcttgatacctatataagaaagtaaaacatgtacaatggcaaatttgtctcttaagagctatgctaattgaaaaaggattttaagataattgaaaaccaaaggtttattcatcaatgggaaaacaatcttttgctgttaacttcttgaatgatctctaaacaatgtaatacattatattcaagttataaaattaatgtacaaaattcacaacasaattattttcaagttatgtctacatataattgtttctaattaaaaggattttatttatcttctgttacttacgatattcttccaaatggtgcaaaagcagcttttatatcttcagttgtaatttctgggctgagatcaccaacaaagacatggaaatgatcttataaggggaaggaaggggaagtgaaaagaaaaatagaactttagaatttaaaaagtactaaaatctatccaataaagtattcttaaaatgattatggcttatgataaagtataaataaaacactatcctatatctat

SEQ ID NO: 171979 - DNA, 601 bp, Human
tgctgtggcatgatctcggctcactgcaacctgtgcctcctgggttcaagtgatcctcctgcctcagcttcccgagtagctgggactacaggcgcctgccaccacgcccggataatttttgtatttttagtagaaacagggtttcaccaggttgacctggctgttctcaaagtcctgacctcaggtgatccacccgcctcagcctcccaaagtgttgggattacaggtgtgagccactgcgtccggcctcctcacagtattttattagctacttttaaactaccatgggaatataaactasggagataatgaattaaatccataaatgagattttcaacatctacctttggctgataatttaaacaactttactttctacattctgaaaacatcttatcagtactctgcatgcctcaggtgccaataaatgttaaacagacaaaacagaagaaatcttctagtgagggtttattttaatcatcagtaaaataaacagcagacgaaaaaaagattagtaattaaaacggagtgtttccattctttactctttaagcattatccatgcacttctcactgagctcacccatttgttgaaaaagg

SEQ ID NO: 171980 - DNA, 601 bp, Human
tgaaggaacaggcaaattcaaggcctttcttgaaatatgaaaacgaaatgctttaaaaaaaaattaaatagggtcttattctgtcatccaggcatgatcacagcttactgtagccttgaactccttgggctcaagtgatactcccacctcagcctcctagtagctaggactataagcatgcaccaacaaggttggctgttttttttatttttttcatttctttactatggtaggaacagcctttactggttgcaacaggcaatgggagggattcggggtccacagactaggtcgccaggctttttttttttttttttttttaatggagacagggtcttgctgttgcccaggctggtttctaactcctgggctcaagcagtcctcctcctgccttggcctcccaaagttctgttattacaggaatgagccactgtgcctggcaggaaatgcacattcttaaaaagaaacaaatattatcaccccaaccagtccgaactccatgagacgcttaactaatgttatgtgttgaattgtgtccctcaaaacgatatgaagtcctataccctggtatctgtgaaatatggccttatttggaaacagg

SEQ ID NO: 171981 - DNA, 601 bp, Human
agagtaaaaccagcttagagtagactaaaaagtaaatggagtgtaacttttgtgtgcacacatcaaaggtaagcttaatctactactgaaggaacaggcaaattcaaggcctttcttgaaatatgaaaacgaaatgctttaaaaaaaaattaaatagggtcttattctgtcatccaggcatgatcacagcttactgtagccttgaactccttgggctcaagtgatactcccacctcagcctcctagtagctaggactataagcatgcaccaacaaggttggctgttttttttatttttttmatttctttactatggtaggaacagcctttactggttgcaacaggcaatgggagggattcggggtccacagactaggtcgccaggctttttttttttttttttttttaatggagacagggtcttgctgttgcccaggctggtttctaactcctgggctcaagcagtcctcctcctgccttggcctcccaaagttctgttattacaggaatgagccactgtgcctggcaggaaatgcacattcttaaaaagaaacaaatattatcaccccaaccagtccgaactccatgagacgcttaacta

SEQ ID NO: 171982 - DNA, 601 bp, Human
aactcttaggttcctctagagaaattggaaagacagcatttattgaaatgcggagaaagactaggaaagaaaaggggaacaggtctgaggaagaaacaaaaagctccattaagaaaaaactttgagatgcctgtgagacatataaatgaagaccatttgttaataaatgtggaacgcagagaagtagactgaagatacaaaattcatgcagactagagaaagagcctaggacagagccctgaaaaacagcaaaacttgaaaaatgggtaaaggaataatcactagctaaggtgactagggaggagtagccagtgatgaaggaagaaagccacaaaagtgtatggtccagggagccaagaaaacagaggttaagaggtgaccttgaaaatagagtagcattggtacaaagtgagagtaaaaccagcttagagtagactaaaaagtaaatggagtgtaacttttgtgtgcacacatcaaaggtaagcttaatctactactgaaggaacaggcaaattcaaggcctttcttgaaatatgaaaacgaaatgctttaaaaaaaaattaaatagggtcttattctgtcatccaggcatgatcacagc

SEQ ID NO: 171983 - DNA, 601 bp, Human
aaataatgggggctggaggggacaccacaagcaaaaggagagaaaagataactcttaggttcctctagagaaattggaaagacagcatttattgaaatgcggagaaagactaggaaagaaaaggggaacaggtctgaggaagaaacaaaaagctccattaagaaaaaactttgagatgcctgtgagacatataaatgaagaccatttgttaataaatgtggaacgcagagaagtagactgaagatacaaaattcatgcagactagagaaagagcctaggacagagccctgaaaaacagcaraacttgaaaaatgggtaaaggaataatcactagctaaggtgactagggaggagtagccagtgatgaaggaagaaagccacaaaagtgtatggtccagggagccaagaaaacagaggttaagaggtgaccttgaaaatagagtagcattggtacaaagtgagagtaaaaccagcttagagtagactaaaaagtaaatggagtgtaacttttgtgtgcacacatcaaaggtaagcttaatctactactgaaggaacaggcaaattcaaggcctttcttgaaatatgaaaacgaaatgcttta

SEQ ID NO: 171984 - DNA, 601 bp, Human
aacttggtgcttttcacaaatgtttaagtgaaaatgctctatgaaatacacaacatatgatagctttcctaaaatgcaatggtgctttttatatttttaaattttattttatttattttttcagatagagtctcgctctgtcacccaggatggagtgcagtggtgtgatcttgggtcactgcaacctccgccaactgggttcaagcgattctcctgcctcagcctcctgagtagcggggattacaggcatctgccaccatgcctggctaatttttgtatttgtagtagagatggggtttcrccatattggccaggctggtctcgaacttcttcttctttttttcttttttaagtctcgctctgtggcccaggctggagtgtaatggcgtgatctcggctcactgcaagctctgcctcccaggttcacgccattctcctgcctcagcctcccaagtagctgggactacgggcacctgccaccacgcctggctcattttttgtatttttagtagagacacggtttcgccatgttagccaggatggtctcgatctcctgacctcgtgatcctcccaactcggcctctcaaagtgctgggattac

SEQ ID NO: 171985 - DNA, 601 bp, Human
gcttacttaaatccttgctggttccatgcctggccatacattccatatgcaggaacttgccaaccattaggcatatactggccaatttgttgtgcatttccataccactggccccactggccataaggttggggatatccaatttgattctgctattaaataaaatttagtattacttgaagttaactatatatatacaatcctaatatgctgataccacaaattcttagccaaaacacacagggccatcattacaattaaaatgacaggataaacaagagttgactgctaaaaaaaaaamaaaaaaacaaaaaaacaaaaaacaacaacaaaacaagtgaggttatactgctgtaactctacgtgatactctgaatggcatagtttttggaaggcatcagttgataccctagtaataaatgttaaacttagtagaatgtttaagtgtttggtatactatctacatgattgtttcctttagatagggaagatgtgattaattatttctatattcagcttacttaagacacttatatagtttaggatttgcttactcccatctctgtgctccatttacagtttcctcatagaaatctttgtg

SEQ ID NO: 171986 - DNA, 601 bp, Human
aattaaagctaagaaaataccctgaacttatcaacattcatctcctttgaatatagaaaaacctaaccccattcttggaaaagaaagctatccatctcatctctatgccttggttgaacatatttgctgaggaaaccactacctgaaagagtcaggtaggttccctacaacgaaaaaggaacattatactactcaaagaagaaatcaaaacaattattagcatatgaaagctcataaaaattcataacattacaagattttcttttcttttcttttttttttttttttaagacaggttttmattgtgtcacccaggctggagtacagtggtatgatctcagctcactgcaacctacgtctccccaggctcaagcgattctcctacctcagtctcccgaacatctgggattataggcacgcaaccaccatgcctggctaattttttttgtaccttttgtagagatgagatttcgccatgttgcccaggctgatcttaaactcctggactcaagtgatccgcctgccttggccttccaaagtgctaggattataggcatgagccaccatgcccaaccacaaaatccttttttttttttgagac

SEQ ID NO: 171987 - DNA, 601 bp, Human; identical to SEQ ID NO: 171972

SEQ ID NO: 171988 - DNA, 601 bp, Human; identical to SEQ ID NO: 171973

SEQ ID NO: 171989 - DNA, 601 bp, Human; identical to SEQ ID NO: 171974

SEQ ID NO: 171990 - DNA, 601 bp, Human; identical to SEQ ID NO: 171975

SEQ ID NO: 171991 - DNA, 601 bp, Human; identical to SEQ ID NO: 171976

SEQ ID NO: 171992 - DNA, 601 bp, Human; identical to SEQ ID NO: 171977

SEQ ID NO: 171993 - DNA, 601 bp, Human; identical to SEQ ID NO: 171978

SEQ ID NO: 171994 - DNA, 601 bp, Human; identical to SEQ ID NO: 171979

SEQ ID NO: 171995 - DNA, 601 bp, Human; identical to SEQ ID NO: 171980

SEQ ID NO: 171996 - DNA, 601 bp, Human; identical to SEQ ID NO: 171981

SEQ ID NO: 171997 - DNA, 601 bp, Human; identical to SEQ ID NO: 171982

SEQ ID NO: 171998 - DNA, 601 bp, Human; identical to SEQ ID NO: 171983

SEQ ID NO: 171999 - DNA, 601 bp, Human; identical to SEQ ID NO: 171984

SEQ ID NO: 172000 - DNA, 601 bp, Human; identical to SEQ ID NO: 171985

SEQ ID NO: 172001 - DNA, 601 bp, Human; identical to SEQ ID NO: 171986

SEQ ID NO: 172002 - DNA, 601 bp, Human
tcgaactcctgacttcaggtgatcagccggccttggcctcccaaagtgctgggattacaggtgtgagccactgcgcccagccagtgctgggatattataggcctgacccactgcgcctggcctagtctacctttttttttttttttttttttttttttgagatggagtcttgctctgtcaccaggctggagtgcagtggcgtgatcttggctcactgcaacctctgccttccgggttcaagtgattctcctgcctcagcctcctgagtagttggggctacaggcgtgagccaccgcgcccrgcccccccccttttttttttttttttttttgatagtctcattctgttgctcaggctggagggcagtaatgtgatctcagctcactgcaacctccaccttccaggctcaagtgatgctctcacctcagccttccgagtagatgggactacaaggtgcatgctgccacaccaagctaattttttttttctttttttgagatggagtctcactctgtctcccaggctggagtgcagtggcttgatctcagttcactgcaacctccgtctcccaggctcaagagattatcctgcctcagcctcc

SEQ ID NO: 172003 - DNA, 601 bp, Human
ctcccacagcactttaagttgtctgcttctagagcatttattatcctacttcctaagtgcctgctaactcctttgtctccctactaaactgtaaaattctctgggccaaggaactatctttattcaccagtgtatctctagcacttactgcagtatctagtacataggaaatagtccaaaaaaaaaaaagaaagctgatcaatgaacaaaaacacaaggaagaaaagcctaaaacatgactaattgggtgctgctacagtcttagcaggaaagtataaaaaggtaagtatttgctacagasacacgagacgaacggtgctgcacactacacacataataacttcgtgttctcgcacatgaacacatgctgtctaaatcgttaacattcttattggaattgtatgaaatactttccaatttttcaccattctgaaatgagctctaataatgttctgaaagcagaatcacttcaagataaccacaccatgaagaatgaccgtttgagcttaacagcacggaaactttgccctcttaaataaaactccattctaagcctagtttgtcagccaaatcaaagtaataagtcaacacaacacaaatc

SEQ ID NO: 172004 - DNA, 601 bp, Human
tcttatttacaccaccaagtgacatcctaaaaatcaattatgggctgggtgcagtggctcacacctgtaatcccagcactttggaaggctgaggcagctggatcacttgaggtcaggagttcgagaccagcctgaccaacatggtgagacccccatctctaccaaaaatacaaaaaattagctgggtgtggtggcgggcgcctgtaatcccagctactcaggaggctgaggcaggagaatcgtttgaacctgggaggcagaggttgcagtgagccaagatcgtgccactgcactccagccygggcaacagagccagactctgtctcaaaaaaaagtgctcacgcctgtaacccaagcactttgggagggcgaggtgggcggttcacgaggtcagaagatcaagaccatcctggctaatatggtgaaaccttgtctctattaaaaatacaaaaaataaaaaaataaaaaatattagctgggcatgatggcacgcacctgtagtcccagctacttgggaggctgaggcaggagaatcacttgaacccaggaggccaaggctgcagtgagccgagatcatgccattgcactccagcctgggcaa

SEQ ID NO: 172005 - DNA, 601 bp, Human
actttaggaaactagtctactcgtgaataccaatttcaaatctatctaatagtaggccagctcccaatcaatgtatgcacgtgcatgtatatatacacatatattcactgacatcacatattttatatattcacatcacactgcatatcatctaatttaagacaccacttatttctaagtcacatcccaactgtcagatattaaaattctaaaaaaatttgacttagaatcaataatatatatttgtattatataaggaaagctagaatctatgataacaacatctaaagtaaaaaaaaaatcataaaactatgggggaaaaaggatttttcacatactgaaatgaaatttatgaaagaaaaataaatagctgctagatactctgctagagtttataccctctggaagcttcttatttacaccaccaagtgacatcctaaaaatcaattatgggctgggtgcagtggctcacacctgtaatcccagcactttggaaggctgaggcagctggatcacttgaggtcaggagttcgagaccagcctgaccaacatggtgagacccccatctctaccaaaaatacaaaaaattagctgggtgtgg

SEQ ID NO: 172006 - DNA, 601 bp, Human
caaatgaaaacacacatttaaattcttgtaaaagagttattacatttaccataaatattcattgaagaaaggacatcaaaataaataagaggctaaaattgtgctagttgagttttcctttcactcctatctcttttgccccaatggtctctaaggaaaacactgataatcacagcaaaacatacaggggtccaacagcagatctatgataatcccatacactttaggaaactagtctactcgtgaataccaatttcaaatctatctaatagtaggccagctcccaatcaatgtatgcacgtgcatgtatatatacacatatattcactgacatcacatattttatatattcacatcacactgcatatcatctaatttaagacaccacttatttctaagtcacatcccaactgtcagatattaaaattctaaaaaaatttgacttagaatcaataatatatatttgtattatataaggaaagctagaatctatgataacaacatctaaagtaaaaaaaaaatcataaaactatgggggaaaaaggatttttcacatactgaaatgaaatttatgaaagaaaaataaatagctgctagatac

SEQ ID NO: 172007 - DNA, 601 bp, Human
tgacaacaaaactatgggctctcatacaaaatcctactgttgtagccacgtgaatgctgttcttaagaggtaaagaaaggaaatgggggaagacttcaaatgaaaacacacatttaaattcttgtaaaagagttattacatttaccataaatattcattgaagaaaggacatcaaaataaataagaggctaaaattgtgctagttgagttttcctttcactcctatctcttttgccccaatggtctctaaggaaaacactgataatcacagcaaaacatacaggggtccaacagcagatcyatgataatcccatacactttaggaaactagtctactcgtgaataccaatttcaaatctatctaatagtaggccagctcccaatcaatgtatgcacgtgcatgtatatatacacatatattcactgacatcacatattttatatattcacatcacactgcatatcatctaatttaagacaccacttatttctaagtcacatcccaactgtcagatattaaaattctaaaaaaatttgacttagaatcaataatatatatttgtattatataaggaaagctagaatctatgataacaacatc

SEQ ID NO: 172008 - DNA, 601 bp, Human
aattttaacacacacagtggacatatcttactttcttgtgtacttttaggtgcaggtggtttacgagtggcccaattggttcggatttgacgaccacccaaccactgaccgcccatatgcacaatcgcattttctgcatcctatggataaaaaagaaagcacaatcacaaagaaaagagtgataaataagactcagtaagatgaaataaaatatcggcgctgctggttccatacaaatcagtagatgaatttactaaatatcctaaacaaaacgaaactgaactattaccaattagaaaaygatttgaacttgagattcaatctaagcaaaaacagaatactctggccctttatcttaccacttcaataaaatgtagatgacctgtaatcccagcactttgggaggccaaggcaggaggatcacttgagatcagaagtttgagactagcctggcgaacccaagtgaaaccatgtctctaccaaaaatataaaaatgagctgggtgtggtggcacatgcttgtaatcccagctactcaggaggctgaggcagcgcgatcgcttgaacccgggaggtggaggttgcagtgggctgagatggca

SEQ ID NO: 172009 - DNA, 601 bp, Human
tgaaactcttctgttaattactatatactattaagatatgcctcaggccgggcacccagcactttgggaggctgaggtgggcagatcacctgaggtcaggagttcgagaccagcctggccaacatgacgaaatcctgtctctactaaaaatacaaaaattaaggcagggcacggtggctcacgcctgtaatcccagcactttgggaggctgaggcaggtggatcacgaggtcacgagttcgagaccagcctgaccaacacggtgaaaccctgtctctactaaaaatacaaaaattggctgrgtgtggtggcacacgcctgtaattccagccactcaggaggctgaggcaggagaatcgcttgaacctgcgaggcggaggttgcagtgaactgagatcgcaccactgtactccagcctgggtgacagagcgagactccacctcaaaaaaaaaaaaaaaaaaaaaaaaagatatgcctcaatgggaggagaaaacataatttttcttgatgctatgatttgacacagacttgatctataaaatcaggtgattcacagctccaaaaatacttataccacagcccaattattttcagataatgaa

SEQ ID NO: 172010 - DNA, 601 bp, Human
gagaagtaatttcttagcctcataaatcatattttgttagattagtttctataatgctcataatgccaaatagctcaatgtatataattaaaatagattctccctaggaaaacacacttttatttattttgtcagaaccatacgtttctatactggaaaaacccaaacaacttactctactccaaatccttgttgattccatggttgcccgtatactccataaggcggtacttgccacccatttgccatatactgtccatactgttgtgggtttccatacacttggctccattggccccaytgactatagtcaacctaggaaaaagcaaagtattgttttagggaacacataagaaacaccgtatatgaagaaagagtgggagacaaggaagagaaaaactaagtaagcacccttatgtgaataggactctgttatttatcattgtctaagtttattggggtggtgacacctgtgaaaagaaagtattaagattcagttaataccgcaaataatcaattttgaaatacaatcaactgaaagtagctatatgctttattttattgttcattttacagagtttccaaagcttttatgtgacat

SEQ ID NO: 172011 - DNA, 601 bp, Human; identical to SEQ ID NO: 172003

SEQ ID NO: 172012 - DNA, 601 bp, Human; identical to SEQ ID NO: 172004

SEQ ID NO: 172013 - DNA, 601 bp, Human; identical to SEQ ID NO: 172005

SEQ ID NO: 172014 - DNA, 601 bp, Human; identical to SEQ ID NO: 172006

SEQ ID NO: 172015 - DNA, 601 bp, Human; identical to SEQ ID NO: 172007

SEQ ID NO: 172016 - DNA, 601 bp, Human; identical to SEQ ID NO: 172008

SEQ ID NO: 172017 - DNA, 601 bp, Human; identical to SEQ ID NO: 172009

SEQ ID NO: 172018 - DNA, 601 bp, Human; identical to SEQ ID NO: 172010

SEQ ID NO: 172019 - DNA, 601 bp, Human
gttggtttgaatttttctaagacttcctgactgtctttcaagtttaaggcttttggctatggcaccccacccttttcaaatccatcttgactgatatcagtatagacagatcttgatgagacagcatttgcaaactccactcacccagtggcatctctcttttccaagtcactatccccagcctccaatatgactgagcagacagggatagcccttaggctgagggcacttctgcaactcagggtcccctgctcagggacacactaagtaatgaattcctaagccatctcagctcagttaygacccgtgggcgcggtggctcatgcctgtaataccagcactttgggaggccaaggcaggcagattgcttgagctcaggagttcaagaccagcctgggcaacatggtgaaatcccgtctccacaaaaaatacaaaaattaggccaggcgtggcaactcacaccagcactttgggaggacgaggtgggcagatcacaaagtcaggagttcgagatcagcctggccaacatggtgaaaccctgtctctactaaagatacaaacaattagcctggagtggtggtgcgcacctgtaatcccagct

SEQ ID NO: 172020 - DNA, 601 bp, Human
aggctgcagtgatccatgattgggccactgtactccagcctggatgacagcaagaccctgtctcaatcaatcaatcatcaataaagcagaaacccagaaacccagcagggaccatgcttcaatgctcattggcaatagagtacgtaagagaattatttgggacaaatcctttcctctaaccatgaaggaaactcacttaaacacatcaccaaatggagctgatgcttttctaaagtgaccctccagttcgtggatattaaattagttccctgttctctttgtaaatgctgcagtggcaagytcctgaacactgagtttctttccaacaaagtataaatccaattaaaagatcattattacaagaaatttctgcagcagggttcattctgccaagcattccactaatttactcttctgctctttgcccagagaatacagtttgacagtttactccatttccccagcagatcttctcttaagtaaataaatctagagacacaagttcactgttccaggaacaatctaggcagctgcaaatttctcttgccatggcagaaccactttggccataagttttcaaccttggtctgaaaggattcca

SEQ ID NO: 172021 - DNA, 601 bp, Human
acactgagaagtctcctgggaggaacagggaatctccaaataacacactttggccacttgcctgtaggaggagggaacaattaaagcatgcttcattctatggcatgtgatcccttcctggagtcaaggaagaaccatggaatgtcacttcagatggggccaggttcaaaacccagtttctggccgggcacggtggctcacgcctgtaatcctagcactttagggggctgaggcgggtggatcacttgaggtcaggagttcaagaccagcttggccaacatggtgaaaccccgtctgtacyaaaaataaaaaaaagtagctgggtgtggtggtgggtgcctgtagtcccagctacttgggaggctgaggcaggggaatcatttgaacctgggaggcggaggttgcagtgagccaagatcgtgccactgcactctagtctgggtgacaagagcgaaactctgactcaaacgaaacaaaacaaaacaaaacaaaaaacccagtttccccaattcaaaactataggatcttgggcaaaattcttgtgtatatttgaaaatcatcccccatctcttgggttatcataaggattcaaaaatggaag

SEQ ID NO: 172022 - DNA, 601 bp, Human
cttgtatctccagcacctagctcattatctggcacagagattaaaaaactcattgcaggacgggacccacgtgatggcgcaaaatgtcagagggttgccagaatacccaggcatcaagataaatgtcatttcaggcaatagctctttttgtttgtttgtttgtttttgacagagtcactctgtttcccagtctggagtgcagtagcacagtctcggctcactgcaacctctgcctcctagattcaagcgattctcctgcctcagcctcccaagtagctgagattataggtgattcccaccrcacccagctaatttttgtattcttaatagagacggggttttaccatgttggccaggctggtctcgaactcttgacctcaggtgatccacccacctcggcctcccaaagtgctgggattacatgcatgagccaccgcgcccagttcctcaggcaatactttttcaaaaaatcaaaatttatgctaaaaaatccatgatgaacaaaatacccaaattttaaataaagacaggatcggttatgctgatttttccttttgcttcagagtccaatatggctcagcatcacactgttatttttcct

SEQ ID NO: 172023 - DNA, 601 bp, Human
aaacaaatggcatttcccttcaaagactgatttggcaaaattcaacagaggagcatggttcagttactcttcgaaaaccccactctgaaaaacaaatgagtatgtttaatgttaaagctataatttcatatgcatttgaccttaatggttttgacattgtaaagaagagtacaaatgaagcaggaatgtactcatatttctaagctgacaataaattaccaaaaagtaaattaaagtggaagatatattggttccttccagacagtgtttaaacaaagtacattcctctaaaatcaggctkttttttaaacaaaagaaaagaaagcacattaagtatgtctaaagacaccatgatacaaactattttaagttggaggtatgtgtgttttcttatggccgatcttgggcagtccatggcacagccagctactctgctgtgcagagacctcctgagttgcaaacactgctcacagtggcctggcgaccaggaactagaagcctagtaccacctgccactccctccctgggagctccaacaggcaccaactgcatgaggactcatcctattcctgacccaagacttaaagacagaagtaaccag

SEQ ID NO: 172024 - DNA, 601 bp, Human
ccaagacaggcggatcacttgaggtcagaagttctagaccagcctggcaaacatggtgaaaccctgtctctattcaaaatacaaaaattagccaagcatggtagcacacacttgtaatcccagctactcgggaggctgaggcaggaggatcacctgaacccaggaggcggaggctgcagtgagccaagacctcaccactgcactccagcctgggcaacagagtcagaccttgtctcaaaaaaggaaaagaagtcctatgctggatgtcaggggtacaggcatggaaaggggctgcccattyggaagctctctctgtaggatgtggacagggcagggcaacccaacaccagacctgcctgacctgaaaggctggaagaggcacattgaaagtttgaccccctccttccaaccactccattaaagtcctacaggggctttcccagccctgctcaccttggcacccagattcccaggtgtggctgccctgccagcctgaagcacagcacagtggcctccccctcaaacatgccattcagcccttctggtcttccctcagctcttgtcgccagccctgcctgcccacacactgtccctgctcccg

SEQ ID NO: 172025 - DNA, 601 bp, Human
gtggcacatgcctgtaatcccagctactcagtaggctgaggcagaagaatcacttgaacccgggaggcggagattgcagtgagcagagatcgtgccactgcactctagcctgggcgagaagagcgaaactccgtctcaaaaaaaaaaaaaaaaacaaagacattcagttaggcgacttctcccagtgcctatgttcctccacactttttgtagtaatttagagcttactccctggttttacttcctaggcagcgggactcactagggaatgcctggagtcagaaatgtggctctgaattcttttttttttttgttgagacagggtgtcactttgtcatccaggctggagtgcagtggcgcaatcatacctcactgcagccttgacctccctgggcaactacaggcgcactccatcatgtctagctaattttttttttttttttggtattttttgtagagacaaggtctcaccatgttgctcagactggtcttgaactcctgggctcaagtgatccacccaccttgacctcccaaagtgttataattgcaggcgtgagccactgtgcccagcctcgggcgagctgccgcttaaccactcaag

SEQ ID NO: 172026 - DNA, 601 bp, Human
aaaaaaaaaaaacagaacagtttacatataaattactgattctcaacaaaagtagaagactaaggaataatgtcttcaaacttctgagtgtgtttcaccccagaattctatgctctgtcagattaccagtgaagtaggagagtagggaaaaaaataacatttccactcaacaaggtctttacatacctacctgccagaccccccttctcaggaagctattgccagctgtgttttgagctcttctctcatgagtcattctggagggaagaagtcattctcgtgtgctgttcccaaaatgagrgaatgactcaggagagaagaggacttggatccaggaaatggaatgccttcatcctacaaagaggaaggaggttcaccatgtgtcaggcatgggtctagaccctcggagacagtggggaagaagaggccccccactcccagattccagaagacaaaccacacagaagacggacaagtaaatgacatggatatgtgaagttgttgaatgctggataatccacgtcaaggaatgaaccaacacaggtcctattaaaacaacagaggcgagagtgggatttgtatcgactcctcaacagcctta

SEQ ID NO: 172027 - DNA, 601 bp, Human
attgatgagggcggcagaaagaagccatcagacccccaggtcctccaccccaggtcctgctccaaacttgagcagtcaggtggctcccccgccaccttcaacagaagagttgagttttcttatctaaagaaacagacccagggaggctccggaacagagaggcacagaggacggcaagaatgagacgccgaaccgaataaagggattcagggaaattccaaatatagaccccccgcgccagcaaaattctcctgacacagttaattagaaatatgtttagttcaggaacatatcaggcttrtggccccccaggaagagactagagggcccttgtctggaaaaataaaaaagcagaaaaaactcaataggaggatctgaagatgtagtcaaaatctccaaaagcaaaaaaaaaaaaaaattaaaaaataggaagaataaaacatgaaattaagggctcaatgcagggcgtgaaaggtcatcattggaaaagagaccagagacaatggaaggaaaaaaagttactaaaatgatgataacaataacaacataagaccatttcccagaactacaaatttccagattatatggctccacaaagaat

SEQ ID NO: 172028 - DNA, 601 bp, Human
catttacagccatcctgtggccgggcacagtggctcatgcctgtaatcccagcactttgggaagccgaggcagattgatcacctgaggtcaggagttcgagagcagcctggccaacatggtgaaaccccatctctagtaaaaagacaaaaattagccaggcgtggtggtgcaaacctgtaatctcagctactcaggaggctgaggcaggagaattgcttgaacccaggaaagagaggttgcagtgagctgagattgcaccactgaactccagcctgggtgacagagtgagactgtctctcaaaaaaaaaaaaaaaaaaatcaagttaaagtatgcacacctactatccctaccagttattaagcgcccactgggctgcaggcacctgcttggagggatcccatttccttaatcccctggacatgcagcaaagggcattttcttgttagccccactttccccatgaggacacagaggtcaggagaggtggcatggcttatctgagagcttccgggagccttaggactgtttggctccaaggcctctgaattctgctcagttccacttccgcaagacacattggcccctccaggttgtgcggt

SEQ ID NO: 172029 - DNA, 601 bp, Human
aaacagccactgttcacatccctgcaattaaactgtctaccacagcctcggggcctgacccagccagtccctcccaactgaactttcaccaccccctcatgtgctacattcctacaatgctgaccccctaacgcacctgctgcccctgcctcggggcctttgcgctcacctctccttggaaggtcccggctcccaggtcctctcatccagatcccgcttgccattcagatcccagtcacctctccagggagccctccttgagcacagaccctagcaggcctcttccagtacctctcagctyatcccctgttgcatttccttcttagcattgatctttctctgccctccgtgtgggggcagatgctgatttccctgttgtacacacagttcctagcacagtccctggtacagagtagggcctcagttcataattgcagcataaaggaatgaataaaacaacaaatccacaaaccagcagaccaacaaggactgaatcaaatctcctaggaatagatatttttgtttatttgttttttgagatggagtctcgctctgttacccaggctagagttgaatggtgcaatctcggctcactgcaacc

SEQ ID NO: 172030 - DNA, 601 bp, Human
gagcagacttcaatgtgttccattcttcaatgtttgagtacagcctgaaaggaccaataacgtcatcgatttcctgctaagaagagagaaggagcggcaggactgggggatcttaacttttcacttcatacccacctggacacatgaattttcttttctttatcttaacaataagcatgtactaattcaataacttaagataattttaggccagacactgtggctcacacctgtaatcacagcagcactttaggaagccaaggctggaggattgcttgagcccaggagttcaagaccggcytgggcaacatagtaagaccccatccctagaaaaatatattttaaaaattagccaagtgtggtggcacatgcctatagtcccagctactcagcagtctaaggttagaggatggatcgagcctgggaggtcaaggctacagtgagccatgatggtgccactgtattccagcctcgatgacagagggagacccagtataaaaaaaattaaaataggcagggcgcagtggttcatgcctgtaatcccagcactttgggaggctgaggtgggcagatcacttgaggtcaggagttcataaatacc

SEQ ID NO: 172031 - DNA, 601 bp, Human
gattcaagcaactctcctgcctcagcctcccaagtagctggaattacaggcacgtgccaccacacccagctaatttttgtatttttagtagagacggggtttcaccatgttagccaggctggtctcaatctcttgactttgtcatcctcccgcctcagccacccaaagtgctgggattacaggcgtgagccaccatgcccagcaccaaataccattttaaagttgcaagaaacatctcaaagtatctcgaatactgcccttcccatcctgaccctcgtgaggcagatggctacggtgtacrcagacagccaacctcccttctgtttgaacaaaaaaccacacctgccctttctagcggagcatgctggaaaatacccatttcttccctgcatttgatcttttggagcaaatgtcacctggcacccataagactgacacatcctaagtccctggctctggccaccaccacagcctctgccaccacccaggagaggggaccatggtcatgcaggggcactcaggccaaggtcctgtttggagaaataatggggcaagggagagaatgggcccccaaatgactgccacaggccggacagcccct

SEQ ID NO: 172032 - DNA, 601 bp, Human
ggtgggattggaactccagaaggagtctggacaccagcgggatcagagagacctcgcttggacgatatcccctcccaagctcacgggttcacgcgtgtggcggtcacacgtgtggagcggattgtccgcttttttctaccgtccacacgattcaaattccaggcccaaatgacatgactcactttctgctgggggtgaaggcattttaattttgccttttgccatcggaaggggagttgaatgctcctctgagtgccactctcccctcctcttcccccaaatacttttatttatttatttwttttgagacggagtctcactctgtcgccaggctggagtgcagcggcgcgatctcagctcaccgcaacctccaactccctgattcaagcaactctcctgcctcagcctcccaagtagctggaattacaggcacgtgccaccacacccagctaatttttgtatttttagtagagacggggtttcaccatgttagccaggctggtctcaatctcttgactttgtcatcctcccgcctcagccacccaaagtgctgggattacaggcgtgagccaccatgcccagcaccaaataccattttaaa

SEQ ID NO: 172033 - DNA, 601 bp, Human
gaaaagaaaaaagagtctgaaggctgaggctaatccaggccataaatcatcccatcagatatgtattaatacctaccatgtgccaaagaatactaacacatgcaaagaacacactaagaaagctcaaataagtcatctgctagacaaggcagatttcctggagatttttggtcattatgcaataatctcaatggaatatatagacagtcacatgaacaaatatgcctttattttccacggaaatatagattcacacagcactgattcagacccttgtaccaagaagtccttcaagactctycactttatttgcctagataagacaaggatgtatttctccaagagcttgagacagccgaatagaaaccatttctgtagagacagtggtgttaaaaagatcactgacatatcatatgatgccagcattgttaagactcccagtaagtctggcatccgagatctcaaacaaacctattattgtaccaggagtcaaaatgaggcgtgctcactgcagggcagggcagcaaaactataatcttagcaagggaacaggtcccaaataaagaatagagcagccagctgcagaatgccaacatctgtg

SEQ ID NO: 172034 - DNA, 601 bp, Human
tgtttcccggcttaggaggcggtggttgcggctgctgctcctacggatattgcgcaagactggggcgttggaaaccctgtaggtctggggaatgaaaaaggaagtgggactttgggaagtggttgctccttagtcttggcgggggttgggaatgggaaataagctggggaaaatttttatcttgggtaaggtacacctcgaagaataatcacttaattctgaaatctgattatgagaaggatacacagttaatgcctgtaaaatgaatgggcagcaaacattggctagtttttattttttrtttaaaaagtacagtagtttttatggtggaggtgatatgacttagtagtgaatactttttcacgttttaaagagactggtctagtaaagctttagcgttaaatttttaacagcttataaaataggcccttgaccatacacagtattatactagcatcgttgagctttgtgattcccgcctccccagaccaataatagaggacggaagtaaagttttctcagtatcttttgaagattgaaaatataagttaaataatctaacttattccttattaaaaataaaaatattgcttatatttaa

SEQ ID NO: 172035 - DNA, 601 bp, Human
tgctgggattacaggcgtgagccaccatgcccggcctaaaactagttttttaccgtcttactttggttatggaagaagagatggtgtggtccctggtcatttcttgtttgcatgctagtcaccttgttatccctaggcatataccgtcaggaaggagcattgtttggtgatgcgggccatcaggacaggttgcccagcctctgaactcctgtactggagaagtggccttagggttcatgctttggggatgagtcagggattcctattggagagttcatttctttctttctttctttctttyttttttttttgagatgtaacacctcgctgtgtcgcccaggttggagtgcagtggctcaatctcggctcactgcatcctccacctcccaggttcaagcgattctcctgcctcagcctcctgagtagctgagattacaggcgcatgccaccacgcctggctaatttttgtatttttagtagagatgggatttcaccatattggccagactggtcttgaactttgatctgactgactttgtgatctgcccgcctcagcctcccaaagtgctaggattacaggcatgagccaccgagagttcat

SEQ ID NO: 172036 - DNA, 601 bp, Human
actccacttgcctgactggtgatgatgctcttttcgctctatccagctgtcctacagtcctgtcatttaaaggctacctctgttaatattttttggttttgttttgttttgttgttttgttctgtttttgagacagggtctcactctgtcacccaggctggagtgcatggttgcgatcctggctcacggcagcgtcggtctccctgggctcaggtgatcctcccacttcagcctccagagtagctggggctatgggcccaccccaccaagccctgctgatttttgtattttttgtagagayagggtttccccatgttgcccaggctggtctcaaactcctgggctcaagcaatccacctgcctcagcctcaaagtgctggggttacaggtgtgagccaccgtagccggcctactacttggtaactatcttatatcttaattttgtttctttatgtttgagtatttaggtcattctactttctgctgttacatatagtaattctgtgattaacatttttgctgaaactgacatttttcactgttgcataagatagcttcccaggagtactaggtagacgtatataaacatttaatacatgtt

SEQ ID NO: 172037 - DNA, 601 bp, Human
gaggatagaaattttccacctgtcattactattctatgagtgtctattcctggccttggttgtgccccatactgttaaagaggagacagctaaggtacccagactgtgcagaactatgttgcctagatggttatttgcatgttgaaaacatgctaattttgctaataaattagcaaatagctaatttgtggctgatccagaatttgatctcaattatctctacttttaatatttacaaaatgagagataaatgtataaagtagggtggtgcacattcatgtttgacagacctaggttttaactccacacagactccctctgatggctgggggttggggaggtggtcctggaccatactttgagaaccagtgagctaatacatggtaaatgataaaggtaatgctgggaaagttaggtagaggtctttttgtgaaggatcttacatctatgctatacttagattttattctacagaccgataatagcaattctggacagtctgcattgtaactcctagagacatggagaaagtagggaggtgttaagaaaatagacatgctggtccactccagcgtcattcccccatctcaccttctccagc

SEQ ID NO: 172038 - DNA, 601 bp, Human
ccacctgtcattactattctatgagtgtctattcctggccttggttgtgccccatactgttaaagaggagacagctaaggtacccagactgtgcagaactatgttgcctagatggttatttgcatgttgaaaacatgctaattttgctaataaattagcaaatagctaatttgtggctgatccagaatttgatctcaattatctctacttttaatatttacaaaatgagagataaatgtataaagtagggtggtgcacattcatgtttgacagacctaggttttaactccacacagactcyctctgatggctgggggttggggaggtggtcctggaccatactttgagaaccagtgagctaatacatggtaaatgataaaggtaatgctgggaaagttaggtagaggtctttttgtgaaggatcttacatctatgctatacttagattttattctacagaccgataatagcaattctggacagtctgcattgtaactcctagagacatggagaaagtagggaggtgttaagaaaatagacatgctggtccactccagcgtcattcccccatctcaccttctccagcctgctccttgagttg

SEQ ID NO: 172039 - DNA, 601 bp, Human
cagacctaggttttaactccacacagactccctctgatggctgggggttggggaggtggtcctggaccatactttgagaaccagtgagctaatacatggtaaatgataaaggtaatgctgggaaagttaggtagaggtctttttgtgaaggatcttacatctatgctatacttagattttattctacagaccgataatagcaattctggacagtctgcattgtaactcctagagacatggagaaagtagggaggtgttaagaaaatagacatgctggtccactccagcgtcattcccccayctcaccttctccagcctgctccttgagttgtactctgaaccttcacttacttagataggttctggtagaaaaggtgagaatcattagtctgggtttctggagcactactgagtcttttaagaaaggtaaacagtcatttgtgttttacaaagttgaatctgatagcagtatgaagggtggcattttggaagctgttgaaatataagaagtgagatgtgagggcctgaagtgaactgagatggggaaatagagtgtatacaacacatctgataagaattaagaaaggagtctcaatgattc

SEQ ID NO: 172040 - DNA, 601 bp, Human
acatcagtcttaaaataacagccaaaagaaggatatactagtgattgttcctgagaaggtgtggtcaaggaggagggaggagaaccagagatgtcagaaaagccagggagagtttcaagaaaggagttattaccagagtcaaataatgctgggaggaccggtaaggtgaggttgagaaagtacctattccatttggcacataggagtgctttggtgactagaaaaaacagtttgggttggggtatgggaagaagctagattatagggtgaagggtgggtttagtgtctttccattttttttaacattttgaaagtagatggtaggagctagaggaagattggttgaaggagagtgtgccccttccactgccttttttttttttttttaaagagagaactagagaatatttttcttattatttcttgtctatgtgtatatcctctttagcctgggaagatcttatgttgcagtcttgataaatataaaaattttaatcatttgtttattcagtgttgtagcttataggtttaaaaaaactaataatagctttattgagatataagtacctaccataagatttattcatttaaagtctatgat

SEQ ID NO: 172041 - DNA, 601 bp, Human
agagatgtcagaaaagccagggagagtttcaagaaaggagttattaccagagtcaaataatgctgggaggaccggtaaggtgaggttgagaaagtacctattccatttggcacataggagtgctttggtgactagaaaaaacagtttgggttggggtatgggaagaagctagattatagggtgaagggtgggtttagtgtctttccattttttttaacattttgaaagtagatggtaggagctagaggaagattggttgaaggagagtgtgccccttccactgccttttttttttttttttaaagagagaactagagaatatttttcttattatttcttgtctatgtgtatatcctctttagcctgggaagatcttatgttgcagtcttgataaatataaaaattttaatcatttgtttattcagtgttgtagcttataggtttaaaaaaactaataatagctttattgagatataagtacctaccataagatttattcatttaaagtctatgattcactagttttttattacattgatgaagttatgcaacaataaccataatcaattttaggacattttcttcactttctgtacccatt

SEQ ID NO: 172042 - DNA, 601 bp, Human
tttattacattgatgaagttatgcaacaataaccataatcaattttaggacattttcttcactttctgtacccattagcagtcactccccgccttcccataagccccaggcaaccacaaatctaccttctgtttccatagatttaagtattctggacattttatataaatggaatcatacaatatgtggtgttttgtgactgactccacctaacatgatgatttcaagtttcatccatgttatagtattgatccgtagtacttttggcctttttatggctgaataatattctattgtatarataccacattttgtttatccattcatcgtgttgatgggtatttgaattgtttccactttttggctaatgtgaataatgcaactatgaacatttgtgtacaagtttctgtgtggacacattttcaggtctcttgggtatatatctaagtgtggaattgctcagtcacgtggtaacactatgtttaacattttgcggaactgccagactgttatccaaagctgctgcacatattacattccaatcaggaatatatgagggttccagttcctctacatcttcaccgatacttgttgctgtctt

SEQ ID NO: 172043 - DNA, 601 bp, Human
tcactccccgccttcccataagccccaggcaaccacaaatctaccttctgtttccatagatttaagtattctggacattttatataaatggaatcatacaatatgtggtgttttgtgactgactccacctaacatgatgatttcaagtttcatccatgttatagtattgatccgtagtacttttggcctttttatggctgaataatattctattgtatagataccacattttgtttatccattcatcgtgttgatgggtatttgaattgtttccactttttggctaatgtgaataatgcarctatgaacatttgtgtacaagtttctgtgtggacacattttcaggtctcttgggtatatatctaagtgtggaattgctcagtcacgtggtaacactatgtttaacattttgcggaactgccagactgttatccaaagctgctgcacatattacattccaatcaggaatatatgagggttccagttcctctacatcttcaccgatacttgttgctgtctttttgattataggcatcctactgggtgtgaagtggtatcttcttgtggttagcttgtaagattttgtgtgtcttaatttgtc

SEQ ID NO: 172044 - DNA, 601 bp, Human
tggcctttttatggctgaataatattctattgtatagataccacattttgtttatccattcatcgtgttgatgggtatttgaattgtttccactttttggctaatgtgaataatgcaactatgaacatttgtgtacaagtttctgtgtggacacattttcaggtctcttgggtatatatctaagtgtggaattgctcagtcacgtggtaacactatgtttaacattttgcggaactgccagactgttatccaaagctgctgcacatattacattccaatcaggaatatatgagggttccasttcctctacatcttcaccgatacttgttgctgtctttttgattataggcatcctactgggtgtgaagtggtatcttcttgtggttagcttgtaagattttgtgtgtcttaatttgtctttcaaagctagagtgataggaaatattttccagtccttgcatttgagctaatcttagtgcttacccagtgccactggtttagttatggttttcttatccatcctttgatgagtattcacctaaacatatttacatcaactaacttcagaagtggaagtgaacttttaagtaactctccagac

SEQ ID NO: 172045 - DNA, 601 bp, Human
tgttatccaaagctgctgcacatattacattccaatcaggaatatatgagggttccagttcctctacatcttcaccgatacttgttgctgtctttttgattataggcatcctactgggtgtgaagtggtatcttcttgtggttagcttgtaagattttgtgtgtcttaatttgtctttcaaagctagagtgataggaaatattttccagtccttgcatttgagctaatcttagtgcttacccagtgccactggtttagttatggttttcttatccatcctttgatgagtattcacctaaayatatttacatcaactaacttcagaagtggaagtgaacttttaagtaactctccagacatggttcactgagacagtaaactaaaaatttactttaagcattctcaagaatgttttactttatttactttcaaaatatattaacttttttccatcaatatttgatatttaacttggaaaaaggatttttaaaggatgaaactgaaagtaagacattaacatttaggtggctgtaggttttttgttcatatgttaaatacttctgtgtttctgtagcactgagttcattagattcataaatat

SEQ ID NO: 172046 - DNA, 601 bp, Human
tttactttatttactttcaaaatatattaacttttttccatcaatatttgatatttaacttggaaaaaggatttttaaaggatgaaactgaaagtaagacattaacatttaggtggctgtaggttttttgttcatatgttaaatacttctgtgtttctgtagcactgagttcattagattcataaatatttacatttctgtcttccccagactgaacgcctcccaggctagagactgggacttaattatccctgtatccccattgcttaatatagtgcttggcatttaataggcactaatrtccattgcatgtgcagacattgtagacaaacttaatgctgtaagacagatttattcttcaggtgaattcttcagtggtccaagggtttgtcttctagacgatcatgagaactgcttcttcccctcctacacagatgtgctcacataactcgttgtattttcagtatccactgaaaaagaaaatacaagataagagctacattgaattcaaatattttaaataaatatgattttattagctgcagtttcttaaggtaacttctgtatttgtgcatcccacacccaatggatcatactttgt

SEQ ID NO: 172047 - DNA, 601 bp, Human
ccagtccattcaacacatcatactcactttcaagtggcagcatctgtaggctaatggaaaccatactggttgtacaatcaggagatgtgggctgcactggaagcatggtttaatttttattattaaaaatataagttaaaaaaactcattgctccctttgatgaccattacaattattggaaattttaaatgtgtattttgaaagtcaattcaaaacatatgatccaagtgctgctcctttttcaaactgtaattatgtctgtctctctttccagagagatttgattccctgatttttccsttctcagctccctccaattttaaatatatatatatagttttttttaataattaaaaaaaaatacttcacctggaagttttcatccaattttgtaactttggtcctagttgagaatcacaggcctataggataaagtctgtacttcttagcctggcattccagaaccttcttaacataatgtcacagtacctttccagtgttaaacttctatactctggtatgtatcctctcttctttttgaaggaagctattcctggtccttgagcatacctactaaatgaatgaaatcttgcttatctg

SEQ ID NO: 172048 - DNA, 601 bp, Human
tgagttgaaaacttgataaggtaaatcaggtgatatgcaatttctaaaccactagtcttttccaaatatgagttgaactcctcttccagcattttatatttcctgtagtatttaagtttctttagattcatgcagtcaaaccttgacaattatctccttccttctgaaatcacacaaaaatcttgtttgcatttgtacagtattgtagggtctgtagctggcctatggcagatataagaagcaaacagtagttgctccctaaaagttttttttggagaaagtggagtgtggactgtattartccattttcacactgctatgaagaactgcccgagactgggtaatttataaaggaaagaggtttaattgactcacagttcagcatggctggggaggcctcaggaaacttacgattgtggtggaaggtgaaggggaagcaaggcaccttcttcacaaggtggcaggaaggagaatgaacatgggaggaactaccaaacatttgtaaaaccatcagatcttgtgagaactcactatcaggagaacagcatgggggattataattacatagggattataattcaagatgagatttggtggggac

SEQ ID NO: 172049 - DNA, 601 bp, Human
aaacagtagttgctccctaaaagttttttttggagaaagtggagtgtggactgtattagtccattttcacactgctatgaagaactgcccgagactgggtaatttataaaggaaagaggtttaattgactcacagttcagcatggctggggaggcctcaggaaacttacgattgtggtggaaggtgaaggggaagcaaggcaccttcttcacaaggtggcaggaaggagaatgaacatgggaggaactaccaaacatttgtaaaaccatcagatcttgtgagaactcactatcaggagaayagcatgggggattataattacatagggattataattcaagatgagatttggtggggacacaaagcctagtcatatcgtggaccatgataatctcagaggctttgggaagtgtgctaatatctacatttcctgtaataacttttatatctaatcggcatttaaaaagctattttaacaacatttgagtgactgtcctgataggctctgaaggaatgcaaagatttgtctctgtcatccatccatggtctctgtcatccatccatggtctctatcatttatccattcatacagaaggtattt

SEQ ID NO: 172050 - DNA, 601 bp, Human
cctgtgtgtctgcctgcctgcctttgtgcctccctttgaaattctatttgcctactcacctttctctacctactcagtcagttggttgtctgtgcccaagatttattaatgtgtgttaacgtgtgggtagtagagatagactggaaggtactttgtagtttagaaatgtctgtaatttacacctagttgtttgtaattcatctaatacggtaaatagattatacaaggggacttcaaaaagctcatggaaaaatggaattaagtaaataaatgttatttattaataaatttataaatagaytaaaattaaaatataaagttaatttctgaacataaactccatcagtttacttttataagtgatgatacaccaaccattttgtttatccctaagaactgagggtcctagaaatttaaccatttcaatgcagtttttttacattattaactgaagagtaatgaatgccctttaaagatttttttgagattaggaaacaaaacgaaggcagaaggagccaaatcaggactgtaaggtggatgcctaatggcttcccatctgaactctcacaaaattgcccttgtttgatgagaggaatgagca

SEQ ID NO: 172051 - DNA, 601 bp, Human
ctcctattacagtccttttaagaaatgcttcaggatcttgatcccacttgtttatttatttatttatttattatttttcattttgtttttgagatggagtctcgctctgtcacccaggctggggtgcaggggcatgatctctgctcactgcagtctccgcctcctgggttcaagcgattctccagcctcagcctcccaagtagctgggattacaggtgtgcgccaccacacccagctaatttttgtatttttagtatagacaaggttttgccatgttgtccaggctggtcttggactcctkacctcaggtaatccacccgccttggcctcccaaagtgctgagattacaggcatgacagtttaacatttccattgaaagctctgctcttgtctgtagctatctgggtgcaatcattttggcaccaattgagtggcaatttgttcagctttaatttttcagtcagaattgtgtaagctgagcaacttaagatgtctgtggtgttggctattgtttatgctgttaattgcaggttctcttcagttagggcaagtgacaagatgaatttttttctcaaaaatcaatgtggatggtctgctgcta

SEQ ID NO: 172052 - DNA, 601 bp, Human
cataaatttgatgttttgttcttgcttcagttttttagcagaattcatgttgttctgataggggctcttttcaaactgatatcttatacttcttagtgcttcaaatgagatcctgttcatcagacatgttataagaagttagtatgagtttattttggtgcaaaacaaaattgaaatccatgcatagttttttccatggtacatattttccatgaactttctgaagaccccttgtatgaatgccaaggagaaacatagggtgggtggttattagtaataggattttgcaactgaaataatyaaacatgttcagatatttatctccacacccattcactgacattattagatggtgcacaaaagtaaaaagtttattttaaaattactttataatttagatagaagattattaaaattcatttttaagaaacagagtctgtctctgttgctcaagcttgagtgcagtggcacaatcacagctcactgtagcctcaaactcctggactcaacagatccgcctgccttagcctcctaagtagataggactacaggcatgagccactgctccctggtggattacttttaaagtatgttttttttt

SEQ ID NO: 172053 - DNA, 601 bp, Human
catgttcagatatttatctccacacccattcactgacattattagatggtgcacaaaagtaaaaagtttattttaaaattactttataatttagatagaagattattaaaattcatttttaagaaacagagtctgtctctgttgctcaagcttgagtgcagtggcacaatcacagctcactgtagcctcaaactcctggactcaacagatccgcctgccttagcctcctaagtagataggactacaggcatgagccactgctccctggtggattacttttaaagtatgtttttttttttttgaaaatgcaacttaaactagaagtacaggatgaatatttaaccaatacatttaatttcttgtcattgctttattagatgctgtttttgtattgtttataaggtctcagcatcatatgtatgatattttcaaatatgttctaaaatgacctcatcatttatttctctagttgttaaagaaggtatagaggttttatcattttttaaaataggatgtaggttggattagatctataaattattattttgcctttaaaacaggttatagataaaagagggaaaggtaatctggtgatactact

SEQ ID NO: 172054 - DNA, 601 bp, Human
gtaaacttgagaagaatgtgtattctgtagttgttgtcttaggtagtctatagacgtgcattatatatccagttgattgatgatgctgttaagttcatctgtgtccttactcatttcctgcttgcttgatctgtccatttctgatagaggagtacggaagtcttcaactataatagtggattcaaatatttctccttgcagttctatcagttttggctcacatatttttatgcacaattgttagacacatatggattaaggattatgctgtcttcttggagaactgacccctttatcatgwtgtaaagccaccctatccctgataactttacttgccatgaaatctgctttatctgaaattaataactagtctcattttatttttgtgttagctgatatatttttttccatccatttgcttttaatctgtgtgtgtttgtatatttaaagtggatctcttgtagacagcatatagttaggtcttggtttttaatccactctgacaatcttttaattggtacatttagaccattcacgttcagagtgattactgatagcattggattaatgtctaccatatttgccactattttctgttgtc

SEQ ID NO: 172055 - DNA, 601 bp, Human
gcggccgggcgtggtggctcacacctgtaattctagcactttgggaggctgaggcgggcagatcacgtgagctcagaagttcgagaccagcctggccaacatggcgaaaccccatctctactaaaaatagaaaaattagctgggcctggtggtgggcgcgtgtaatcccagctattcgggaggctgaggcaggagaatcgcttgaacccatgaggtggaggttgcagtcagccaagatcacgccactgcactccagcctgggcaatagagcaagactccatctcaaaaaaaaaaaaaaaaagaaaaagaaaaaagaaagaaaaagaaaatggtaaggatatagaaaactagtgtttctaggtccattaaggggagggtaaactggtgaagcctgttttggaaggcagtttggccacttctaatagaattgataaatgtacatactctttgatccagcatgtcaactttagggatctttccgtaaaaatacttgcatatgtgcataaaatagtatgtccaagtatgcaacaatttttgtgaaacaacctaaaatagctattagtaaggagactttgcataactggttacctaaaaggaaaca

SEQ ID NO: 172056 - DNA, 601 bp, Human
gtccaagtatgcaacaatttttgtgaaacaacctaaaatagctattagtaaggagactttgcataactggttacctaaaaggaaacagatgtggaggggagagagtttggctttttcattttatacctgtatgcagaaaagagtaacatagcaggcctaagactactatccttagaaaggcctgcttacaatgttatcccttggctggtgtctgggaacttagacttttgggagaatttccattatcccctgataagagtggttcactgtgcccaaactgtacaaacaatgtggtttatgrgctgggcccagtggctcaattgtgtaatctcagtgctttgggaggccgaggcaggaggattccttgaggccagcttgggccacatagtaagacctcatctctacaaaacatttttaaaaattagccagatgtcatggtgtgcacctgtgtagtcttagctactttgggaagctgaggcaggcagataacttgagtccagtagttcaaagttgcagtgagccttaatcatgccactgcactccagcatgggtagcagaacaagactctctctctgaaaaacaaaaataaaaaataatatgg

SEQ ID NO: 172057 - DNA, 601 bp, Human
ataaacttactgaactaaatgtgaaaatagggtgccaattcactgactatgtgatgttccgaatgggttatcaatgtctattacgtctagcagacttgccctgctttgttgaatgtgtatttggaagacactaggctctgtgggggaagaaaaagaaataggttattatctgtgaggcagtgaattataatcttgggtgatggcggcattggtagtgatgggataaaatgtgtaaacatgatggatattaaaggcaagaatgacaagtactatatgactaggacatgtttttggaatataagcctcattagagcagggattttgtcctgttcatctcttatcactagcacctaaaacagtccctgggcataggataggttaggtggagttaatgtgaagccagtcgtcgtcataaaagtgataattgagtttgaagaggaagttctttttattataaatctctgaatccagtatgtcagcaaacttaaaaatattttttgggaatatcataacagttaattcatgaataggtcagaactttctaatgttgtatgaatattatgtgacctggtaatctgagacactttaatggcgcttgcct

SEQ ID NO: 172058 - DNA, 601 bp, Human
atatgcctcattagagcagggattttgtcctgttcatctcttatcactagcacctaaaacagtccctgggcataggataggttaggtggagttaatgtgaagccagtcgtcgtcataaaagtgataattgagtttgaagaggaagttctttttattataaatctctgaatccagtatgtcagcaaacttaaaaatattttttgggaatatcataacagttaattcatgaataggtcagaactttctaatgttgtatgaatattatgtgacctggtaatctgagacactttaatggcgcttrcctgcaactagctgttctttttgatactggataggacatttaattctgtacaaacaactactaagggtttctttcccttaaaaaattttttttaattgtggtaaaatacatgtaacatgaaaacctatcatctaagccatttttaaatgtacagttcaatagcgttaagtacattcacattgttgtataaccaatctctagaactcttctcatcttagaaagctaaaactctgttcccattaaaccaccctctttattccaaactcattctcctccttcctccaacctgtagcaccattc

SEQ ID NO: 172059 - DNA, 601 bp, Human
tttaattctgtacaaacaactactaagggtttctttcccttaaaaaattttttttaattgtggtaaaatacatgtaacatgaaaacctatcatctaagccatttttaaatgtacagttcaatagcgttaagtacattcacattgttgtataaccaatctctagaactcttctcatcttagaaagctaaaactctgttcccattaaaccaccctctttattccaaactcattctcctccttcctccaacctgtagcaccattctattacactttctgtctgtatggatttgacaattctagrtgcctcatataattaggattataaaatattgtctttttgtgactggtgtatttcagttagcataatgtcctcagggttcatccatgttgtagtatgtgtcaaaatcttcctttttaaagggttgaaaaatactgcattgtatgtatatactacattttgtttatctatttgcccatagcatgacacttaggttgcttccaccttttggctattgtgaatgctcctgctgtgaacatggttgtacaaatatctgttcgagaccctgctttccgttctttggggtatatacccaaaaatgga

SEQ ID NO: 172060 - DNA, 601 bp, Human
aaagtttggtcagctgaccacagcactgtggcagtctccggccttgcaaaaataacttttttccatatagtggtcaataagtattgaggtctcttaaactacacaagtgactcttcctgtgctatatttgtttttgcagagagaagtgtgaattctgaatctctgctactaatttgggagtctttgttttatatttgtaatcggaggtaaagagaattgatgtaattgtggcttaatatgttaatactagaacttaatattctcaattttactgtatgtttttaattaattaattaattatttttatttatttatttatttatttttgagacagagtcttgctctgtcgcccaggctggaatgcagtggcacgatctcggctcactgcaagctccgcctcctgggttcatgccattctcctgcctcagcctcccaagtagctgggactacaagtgcccatcaccacgcccaactaatttttgtatttttagtagagacggggtttcaccgtgttagccaggatggtctcggtctcctgacctcatgatctgcccgcctcggcctaccaaagtgtatttatttattttttgagacagagtct

SEQ ID NO: 172061 - DNA, 601 bp, Human
gatgatgaggaaatgggtaaaagaaagtgagggccttgtgagttgaaacaaaaataatcaaacctggaacactttccatttattgtattagatatcttcatttcaataaaattaatgtatatgacaaaattttattgtcctcctagttcaagtggtattctacttttatttccataaaaatatactttcaggatagggaaagggtaaacttgcattataagtttgtattttctcacgaagggacaggagagaagaaaaaaatcatttgcttattgtctaggctatgcaaaaaaaaaaaaaaagaacagccttgtttttttattacattttttcatttagtttatgatttgccatatttattattttaaaacatgaagtctgtagtacaaggttttatttaaaaacattctcaaaatcaaggactattactacatgcattcagggaagattatctagctatattggagagatctccttcgctagtaattgatgaaacctaggaattgaaccccagcttctctgacttaaagctgccctattgtgaagtagaaatgaagtgtaagcaatatattcttaagtatactggtcaattctgatttac

SEQ ID NO: 172062 - DNA, 601 bp, Human
ttaaaaatgtttctctgacttgtctgagaaggctcagtaaataattcttcaatttgtaatgagagttttgctttgcattagctattggtctataaagtccagtaagatagtctaatctctgccttcagttttatagattagtggacgagacagacaagtactgaaatacttaagaaatacttttcacaagtggcaatagaacaatgtgttatggactcattgcagaaggctgaggagcagtaaaggagggaaggttcaagaaagccttcaaaaaggaaataacactttagccagagccctrctcaccagtaagagcaaaaattgtgcaactttgatatttaagaaatggagggttactgctagtcgtagtggtggtgagtaattctatatgactaaagcatcaaactctaataagagcattataaaaagaggctagaaaattggacaggcaacattcaacatatcttataattaaagatttggtagtttatgttagaggtgatagacacataggagagtttttaaatgtgggagtaaaatggtcagacttgactttttagaacagtaataaaggagtgcagttatttttggaattcattta

SEQ ID NO: 172063 - DNA, 601 bp, Human
ttttgctttgcattagctattggtctataaagtccagtaagatagtctaatctctgccttcagttttatagattagtggacgagacagacaagtactgaaatacttaagaaatacttttcacaagtggcaatagaacaatgtgttatggactcattgcagaaggctgaggagcagtaaaggagggaaggttcaagaaagccttcaaaaaggaaataacactttagccagagccctgctcaccagtaagagcaaaaattgtgcaactttgatatttaagaaatggagggttactgctagtcrtagtggtggtgagtaattctatatgactaaagcatcaaactctaataagagcattataaaaagaggctagaaaattggacaggcaacattcaacatatcttataattaaagatttggtagtttatgttagaggtgatagacacataggagagtttttaaatgtgggagtaaaatggtcagacttgactttttagaacagtaataaaggagtgcagttatttttggaattcatttatgtgactttttaaagacttctggggtaggctggtgcagtggcttatggctgtaatcccatcactt

SEQ ID NO: 172064 - DNA, 601 bp, Human
aatttcaggcagataaattgacctggaatatgcaactctttctgatctttgatctaggaaaggttttaaagaaataaatctgaagtaacaacatttaaagagttccagtaattagttcaataataatagttaacatttattgagccattttatgtactagaccttttgctgagtaaaggttattatctcagttttatagatgagacacagagaggttaaatatgttaattgtcacacagctaagaaagtaccagatccagaattttaatttatgtagcttactataaagctgacatttttyggtgggaaataagttccaacttgtagatacctttttaaagtacaaaacaaagtttttacttgttttatggaccacttttgtatctctgatgggcatgaaaattgctaagaacactattgtagatttttattttaatagagcattctccattttaaactttaattatagaaagcattttaagaaatggcatgctaggctttaagaaaactggataaatgaaaatccaaacttaaataagataaatatttggacgcaaaagttctcaaggttcattatgagaaatgtagtcatttcacataa

SEQ ID NO: 172065 - DNA, 601 bp, Human
acctttttaaagtacaaaacaaagtttttacttgttttatggaccacttttgtatctctgatgggcatgaaaattgctaagaacactattgtagatttttattttaatagagcattctccattttaaactttaattatagaaagcattttaagaaatggcatgctaggctttaagaaaactggataaatgaaaatccaaacttaaataagataaatatttggacgcaaaagttctcaaggttcattatgagaaatgtagtcatttcacataaaagctttgttttgcacatttctcaataaygtaatttgtcatgtaaaagaagaaaagtctggagtgggccaggcatggtggcttacacttgtattccccagcactttggaatgttgaggcaggaggattgctggagcccaggagttcgagaccagcctccgcaacatacatggggagaccccagccctacaaaaaatagtaataataattagctgggcatggtgacatgagcctgtggttccagccactttggaggctgaggcaggaggatcatttgaacatgggagtttgaagctatggtgagccatgatcatgccactgcattccagt

SEQ ID NO: 172066 - DNA, 601 bp, Human
gcaggaggatcatttgaacatgggagtttgaagctatggtgagccatgatcatgccactgcattccagtttagacaacagagtgagactccgtctgtgaatgagtgaatgaatgaatgaaaaagaaaaagcttagagtgattgtaccaggcattcctgaggtacattcacattttataattaaactcaaccactctttgtactaaattttttctcgctgacattgacctaagatatattcctttcccctctgtgtttctgcaactatttaagttgatatccttctctaagtcagattcaatataatattttgaaatgcactgatactataagtatctaaaaatacatcttttcagatgcttaatctttgagcagagaaaatacaaacattctaattaaatgtgcaagatgcgtatataagtaaccatgaggatctttgttaatatggagtaacgacatcataaacaatcttttctactgtccttttttatttacgttcaattttttgaacaggcaatacagtcatacaatccaaaagatatgaaaagacataatagtaatgtctcattctcatccgtttcccttaggtacccatttccctt

SEQ ID NO: 172067 - DNA, 601 bp, Human
ggaggatcatttgaacatgggagtttgaagctatggtgagccatgatcatgccactgcattccagtttagacaacagagtgagactccgtctgtgaatgagtgaatgaatgaatgaaaaagaaaaagcttagagtgattgtaccaggcattcctgaggtacattcacattttataattaaactcaaccactctttgtactaaattttttctcgctgacattgacctaagatatattcctttcccctctgtgtttctgcaactatttaagttgatatccttctctaagtcagattcaaaatratattttgaaatgcactgatactataagtatctaaaaatacatcttttcagatgcttaatctttgagcagagaaaatacaaacattctaattaaatgtgcaagatgcgtatataagtaaccatgaggatctttgttaatatggagtaacgacatcataaacaatcttttctactgtccttttttatttacgttcaattttttgaacaggcaatacagtcatacaatccaaaagatatgaaaagacataatagtaatgtctcattctcatccgtttcccttaggtacccatttcccttccc

SEQ ID NO: 172068 - DNA, 601 bp, Human
ataatagtaatgtctcattctcatccgtttcccttaggtacccatttcccttccccacagacacatactttgttaatagtttttcttccagagatgatatatgcatatgtacaagcaaatgcaaatgtttttatttctttttaacaccagtagtaatatattacatatatacatactgcactgtgtatataatgtacactattgtttcctgctttttacatttatacttaatatgtatttttcagatactgtcatcttactatatataaaaagctaactcatttgtttttcagctctctcwtatttgatggtatgaataaaacaaatttagccagttttgtattaagaggtttctttgattgtagttttttgctgttactaacaatgctgcagtggttgggcgcgtggctcacacctgtaatctcagcactttggaaggctgaggcgggtggatcacctaaggtcaggagttcaagaccagcctggataacatagtgaaacgctgtctctactaaaaatatgaaaattagctggacctggtggcacgcatctgtaattccagctactcaggaggctgaggcacaagaattgcttgaacctg

SEQ ID NO: 172069 - DNA, 601 bp, Human
ttcttattcagtcttaaaggttgttctctctaaaatgcctttaaagttcttggtgacttttttttttttttttgtgacagtcttgctctgtagcccaggctggagtgcggtggtgggatcttggctcactgcaacctctgcctcccaggttcaagcgactcttgtaccttagcctcctgagagctgggacagctctaatacaggtgcctgccaccatacccagctaattttttgtattttagtagagacagggtttcaccatgttgcccagggcccagtggctttttaattgccagatttsgtggtctttttttactgtttattctaacaggaagaatattgattattcaagaatgttgaactattttgatgccattgatcaatccctatttttgaaattttcttcttccatgataactcttttaaaacacctcttccctctcatctctttccctcttttctccactaacttctttgcctcaatttaatccttcatccttttgttgttctacattattatcagctgtgggatatgtggatagcctgtgttggcagaattaacaagtggcaacataacataatggtatagtgttctgattct

SEQ ID NO: 172070 - DNA, 601 bp, Human
tatctcaaaaaaaaaaaaaacaaaaaaacaaaaaaaaccagtgtacctagcacatagtaaccaatcattaagcttttgcaaaataaccagtatacctagcacatagtaaccaatcattaagcttttgcaaaatacactccacttttctcacctgttgtcttagtctgttcaggctattacagaaataccataaacagggttgcttattaataacagacatttgtatcttcaaattctagagactgggaagtccaagatgaaggcaccagcagatatgctgtctagtgaagggtcactctgsctcatagatggtgccttctcactgcacttcacatggtggaaggggcaaacaagctctctcgggcctctttagtaaaagctggtaatcccattcacaaggcataatctaatcatctcctaaaggccctaccacttaatactgttgcattggaatttatgttttaacttatgaatttgggaaggacacaaatattcagaccatagcaccagtctgcctcagaataggggatgacatggctttctggatacttcgtattaagcaagataattttaaggtgatcctacattgctctggaattat

SEQ ID NO: 172071 - DNA, 601 bp, Human
ggttagtggtgtagtgttaaactggtcctctgaaagttctgatttgtattgtttgctgatttctgtgataaatggattatttaccataatcatcacagcaaaactctgaggtaagtactgttatgtgccattttgcaaacaggaaactgagacagagaggttaaaaagcttgtcacacagttaaatattgtggggtaagaatttaaacacaggcggttttaaagccttcactagggtgattttgcctctcaagggacacttagcaatgtctggagagatttggttgtcacaactggggtaygggagtggacaggctgctaatggcatctaacaagtagaggctaggaatactgctacacatcctgcagtgcataggatgcagcccccttccccaaacaaagacttctcgccaaaatatatgagtgtcagcgttgagagaccttgtccaagagcttgagttcttaattactgtgcagtaatcagattgacagtgccttttttcctttaagttatttaaagtttgataagtaggtctccagtaaatttctagttattttgacttgggatttttttttcttttttttgagacagaatctcactc

SEQ ID NO: 172072 - DNA, 601 bp, Human
atatatgagtgtcagcgttgagagaccttgtccaagagcttgagttcttaattactgtgcagtaatcagattgacagtgccttttttcctttaagttatttaaagtttgataagtaggtctccagtaaatttctagttattttgacttgggatttttttttcttttttttgagacagaatctcactcttgtcgccctggctggagtgcagtgtgggatctcggctcactgcaacctctatctcccgggtttaagcaattctcgtgcctcagcctcccaagtagctgggattacaagcaccygccaccatgcccagctaattttttggtatttttagtagagacagggtttcaccatgtcggccaggctggtctcaaactcctgacctcaggtgatccacccgcttcagcctcccaaagtactaggattactggtgtgagccactgcacctggcctggaaatttatattgaaagtaattgtactgagagatatgtgcttatttactgttagataactatttaattcattgcccgggcacagtggctcatgcatgtaatcccagcactttaggaggccaagctgggcagattatttgagctca

SEQ ID NO: 172073 - DNA, 601 bp, Human
gcagtaatcagattgacagtgccttttttcctttaagttatttaaagtttgataagtaggtctccagtaaatttctagttattttgacttgggatttttttttcttttttttgagacagaatctcactcttgtcgccctggctggagtgcagtgtgggatctcggctcactgcaacctctatctcccgggtttaagcaattctcgtgcctcagcctcccaagtagctgggattacaagcacctgccaccatgcccagctaattttttggtatttttagtagagacagggtttcaccatgtyggccaggctggtctcaaactcctgacctcaggtgatccacccgcttcagcctcccaaagtactaggattactggtgtgagccactgcacctggcctggaaatttatattgaaagtaattgtactgagagatatgtgcttatttactgttagataactatttaattcattgcccgggcacagtggctcatgcatgtaatcccagcactttaggaggccaagctgggcagattatttgagctcaggagttcaagaccagcctgggcaacatagcaaaactcaacacacacacgcacgcacgc

SEQ ID NO: 172074 - DNA, 601 bp, Human
ggctacattttcagccttgttgctcaccgcttccttccagtagtcccatgttgcttcatatctcttcagtacatgtattatttagacccagagccttggcttttaaatcaggcagccccagtttcaaatgtgtcactgccatctcagttttgtgatttgggcatacctctgtctgtgcatagcgatattaacttctatctccatgggtgtgtggtgaggataaaattatgtgcttagaggaaacgttcattccatggtagctattttttattaattctatacttttgaacctattatgctrcctataatgccctattttttttttctttttaatcattggcaaacttctcattccctgagacccagcttgtcacacctctgaagactgctgatatcctcaagatgttccttactccctttccttgctactactttactatggatatatgaacaacattattgtgcttattacatgcaataaatatttattggatgaatgatactaaaattcacatttaaaatgccaaaatcaaaatacacatgatatgctgtataagtagcataatgttgatttttaaatctaatgtgctgtgggtacata

SEQ ID NO: 172075 - DNA, 601 bp, Human
ccaggccgggcacggtggctcatgtccgtaatcccagcactttgggagacctaggcgggtggatcacctgagatcaggagttcgagaccagcctggccaacatggggaaacccagtctctactaaaaatacaaaaattagccggtcatggtggtgcatgcctgtaataccagcttctcgggagactgaggcaggagaatcgcctgaacccaggaggtggaagttgcagtaagccgagatcgtgccaatgcactccagtctgggtgacagagcaagactccgtctcaaaaaaaaaaaaaaaagtttatgtggtaaaattattatctatgtcaatattcagcagtcatggttttaaataaaaatttctttttttaacaaagttaaaaaccaaaatgaatacattaaataaaaactaataaattgatagtttgctatttcagatgttgtcaatgttcatattctttttttaaggctgtttgttaaaagttatagtttttacttatgcttaatgacactgattcattgtatgagtcagttatgtaccagtttagtattttagtcagtgacattgtttggtttatattctcatgttcattattaaa

SEQ ID NO: 172076 - DNA, 601 bp, Human
tccataattatgtttacttattgctgatgtttactaaaaagatggacccatttttaggatgtctcattaaatttttacaaactaggctaaatattttaagaaggtgtgataataatttaaatcttgtcctaagtcagtaagtaatgatacagctatcaaacaacttataaaaagcagaaaaggattagtgctctaataggtcagtaaaatacttgatagtacagttatactcatttgagtccctcttctcaggaaaatatatataaacacataactataaatagactataaatatgcagtrtaagagaatttcatctatccctggagttcattcagtgccctcttgttcttttggatgaagggaaataatatgcccttagatttagaagcagagaaattagaatactgcgaagagctaccctatactgctctgtagtattcttgaaacctaaccatgtgcattgatacttttcattgtgtggatgtggaaaatcagtaatgtgaaactttcatttttgtcttacggctttttaatggaattgtaatgattctaaagcattgacatcctctggtctttgaaagattaataaaaggggggaaa

SEQ ID NO: 172077 - DNA, 601 bp, Human
aacacataactataaatagactataaatatgcagtataagagaatttcatctatccctggagttcattcagtgccctcttgttcttttggatgaagggaaataatatgcccttagatttagaagcagagaaattagaatactgcgaagagctaccctatactgctctgtagtattcttgaaacctaaccatgtgcattgatacttttcattgtgtggatgtggaaaatcagtaatgtgaaactttcatttttgtcttacggctttttaatggaattgtaatgattctaaagcattgacatsctctggtctttgaaagattaataaaaggggggaaattttccagttatttatatttgctgtacttcactttaaaaactagatgtgcttggggattgagaaagagcatgaagaaactttctggatgatgggaacatcctgtatcttgataagatttgtgttgcacagatgtgtgtatttgtccaaactcggagaatgttcactttaggatttgtgcatttcattatatgtaaaatttgcctcaagggaaaaatactggaaacaatataaaaattatgttctagattggccgcgtggggtggc

SEQ ID NO: 172078 - DNA, 601 bp, Human
ttcactttaaaaactagatgtgcttggggattgagaaagagcatgaagaaactttctggatgatgggaacatcctgtatcttgataagatttgtgttgcacagatgtgtgtatttgtccaaactcggagaatgttcactttaggatttgtgcatttcattatatgtaaaatttgcctcaagggaaaaatactggaaacaatataaaaattatgttctagattggccgcgtggggtggctcatgcctgtaatcccagcactttgggaggccgaggtgggcagatcacgaggtcaggagatcragaccatcctggctaacacggtgaaaccctgtctctactaaaaatacaaaaaattagctggacgtggtggcgggcgcctgtagtcccagctactcagcaggctaaggcaggagaatggcgtgaacccgggaggcagcgcttgcagtgagctgagatagcgccactgcactccagcctgggcgacagagcgagactccgtctcaaaaaaaaaaaaaaaaatttattgtgttctagataataatatgcatgctgaagtattttggggagagtgtactgatgttcacaacttactttgaaatg

SEQ ID NO: 172079 - DNA, 601 bp, Human
acacatttaatattgaaactacttttttaggcaagccaattatacttctcggtgcaaaattcttgaaatctgtattttattaaaaagtaaaattgtgtttaactgatacgttctttatctcactccccaccatcactttttagatcattgtaatggcctgccgagaatttgagatgggaagggtatgtataatctattcctcttactatttcatttttacggataaatattcttagtcttttattattatagtcttaacataagcggttaatgtagatacttcttttattttggggtactrctgttgcttttatttcatacaagggacaaaataatctctcaagcatgttgttttcttttatattttgtaagtatgttttatcacacacaggcatacctcagagatattataggttcagttccagaccaccacaatagcgcaattcaaacaaattttttgttttcttagtgcatataaaagtcatatttatactgtattatagtctgttaaatgttcagtagcattatacctataaaacacttcatgccttattttatttttttattttttctagacagagtctcgctctgttgcccaggc

SEQ ID NO: 172080 - DNA, 601 bp, Human
ccaccacaatagcgcaattcaaacaaattttttgttttcttagtgcatataaaagtcatatttatactgtattatagtctgttaaatgttcagtagcattatacctataaaacacttcatgccttattttatttttttattttttctagacagagtctcgctctgttgcccaggctggagtgcagtggtacaatcttggctcactgcaacctccgcctcccaggttcaagcgactctcctgccttagccttctgagtagctgggattataggcatgtgccaccacaactggctaatttttrtagttttagtaaagatggggtttcaccatgttggccaggctggtttcgaactcctgacctcaggtgttctgcccacctcggcctcccaaagtgctaggattatagacgtgagccactgcgcctggccttccatgccttaatttaaaaataatttattgctaaaaaatgttaatgatcatctgagccttcagctagttgtaatctttatgctggtaaagggttttgttgacgttgatggctgccgactgatcaagttggtatttgctaaaggttggggtagctgtggcaatttttgataaa

SEQ ID NO: 172081 - DNA, 601 bp, Human
tgacctcaggtgttctgcccacctcggcctcccaaagtgctaggattatagacgtgagccactgcgcctggccttccatgccttaatttaaaaataatttattgctaaaaaatgttaatgatcatctgagccttcagctagttgtaatctttatgctggtaaagggttttgttgacgttgatggctgccgactgatcaagttggtatttgctaaaggttggggtagctgtggcaatttttgataaaatacaagacaggaccaggaacggtagttcacatttgaatcccagcactttgggargtggaggtgggaggatcacttgagcccagaaggttgaggctgcggtgagctatgattatgctactgtactccagcctgggcagagggagactccacctataaaaacataaaataagaaacagtgaagtttgccacattgattgtctcttcctttcatgaaagattgctctgtagcatgccatgctgtttgatagcaacagcagttgctgttctacccacagtagaactacttggcaaattggagtcagtcctttcaaacccttccactgctttatcaactaagttgatttaatgtcctaa

SEQ ID NO: 172082 - DNA, 601 bp, Human
tctcaggaaataggaaagcccaaggagaggaagagagactgtacaaaaacttgtcaatggaacagtgagaatgctcacaacatctgttgattaagtttgccattttatatgggagcagtttgtagcaccccaaaacagagtagtaacttcaaacatcactgatcagattacaataacagatatcatcataatgaaaaagtttggaatactgcaagagtttccaaaatgtgacacagacctgaagtgagcatatgctgttgaaaaaatgataccgatatacttgcttggtgcagggttgccrcaaaacttcaatttgtaaaatatgcagtgtctgagaaacacagtaaaatgaggtatgcctgtacttaacaataattaattaggtattgttacttagtaaacttcaaatattcagtggtgttgtaactagaatgctatctatggactgaaatagagaggtatttttaaataggaataaaattgaacaagtggaaatacattttaaaaatctggttatcattaatatatggtttgaatttttgtttgtttgtttgttttgagactgtgagacagaatcctgctgtgtcagtcaggctggagt

SEQ ID NO: 172083 - DNA, 601 bp, Human
tttattccattactcccaactatttcctatgtcagtattaagtaatgttggacagaaagtgaataaaatgagaaaatataaaaactgagaaattattaagtaatcaagttatctatttaagggttgtcaatatatacattaatattattaatcaattgtctaagagaatttaaatgtcattctcctaatgttttaagttactgttaaggtttaggatgtatttctcttttcattatattagtaagctcatagtatgtatcaagttattgatgaaaaatcaagtagcattgagtacataatkttttgaagcgaaaggtttttgtgattcactgtgtcttattagtaatagattatgagcaagttaggaactatgaaattatctgataaccttgactttgatcttgactttgaatgtgacctggtggaaaaagcatagataattaaatcagacaaacctaccttttacaagcattttgaccatggtgcagtacagttcactctgagcttcagtttcctcacatttgaaaggaaataatacccaccttgcagtgttagagattatgtatgtatgatatttaacacatagtttttgatatcatta

SEQ ID NO: 172084 - DNA, 601 bp, Human
tgagtagctgggattaaaggcatgtgccaccatgcctggctaatttttttgtatttttgagtagagacaaggttttgccatgttggccagtctggtcttgaactccttgccttaagtcatccacccacgttggccttccaaagtgctgggattataggcatgagccaccacgcccggcctccatctattaaaaaaaaaaaaaattagccggttgtggtggcacacgcctgtggtcccagctactcaggaggctgaggtgggaagatcacttgagcccagaaggtagaggctgcagtgagcygtgattgcaccactgcacactccagcctgggtgacaaagtgagaccctatctaaaaaaagagagaatttaatttaatcattttctgtaaacatctcttggaaaatgagatttggaagttacctgtgtttttaagcctctaaaatgttagctaacccaacataccagacagttctactttgtttctctgtgagcattactgtcaacttatagttcattcagcctataggtaataactccatttactgtatttggaactgtgaagatttaattaggaattcattaaccaatgcatttcccac

SEQ ID NO: 172085 - DNA, 601 bp, Human
acttttttaaaattagtttttcttgtctagaggaggatctttggtctactctgtagacctggcagatagcaatgaacagttatgcacttaagtcagtaaggttcttatgactattcttggagaagacacagtagcctattttttaaaacaactgggtaaatctaagctctctcagctccatgcctgctaatgtgggtttttctgttttggggaagtagaagtaagcagaacctcaggacacaaaatatttataacagtttaagaaaaacttacatgaattacttactaattttttttttttggatgacagaaaaaatgtgagcgctattggcctttgtatggagaagaccccataacgtttgcaccatttaaaatttcttgtgtaagtatccatttttgtaaacacttttttcagaaaattggcatgctatactgatgaataattaaattataatgtggtatgaacccaggcttatagacgccaaggactcacaaacctatgcttacatttaaaaaaattttgtttatatactgcttttaaatttggaagcttttgggttgacttcataaatgcatattttccttgtatcttactatattg

SEQ ID NO: 172086 - DNA, 601 bp, Human
tctccaaaaacagtgtcacagaaataactagaataatgtttgaccaaatattctgggcacactgtggcccagccaagttgacagataaaattaaatatcacattccttattcagagtttcttgtttttgactttgttttccatgattaaacgaaatataatttctgtggttttacttgtcattgctgagttcttgaactccataattttatgacttagttatactcatgacttctgaattcctctcatacatacccaaagtttagtgctttctaggttgacataaaaaaggacaggactgwatctgtattatgctgtctactttataaatcaatgttgtttttataatgttaactataactcaccattgaactttttggatgtagtatttagtcaatattcttaaggtgctgattagaattaactatttgtggggtaaatgtaaaaattttaggccaggtgcagtggctcacacctgtcatcccagcactttgggaggctgaggtggggaggattgcttgagcccaggagtttgagacaagcccgggcaaaatagtgagacattattaacatttttaaaaacgttaaaaatcccactgcat

SEQ ID NO: 172087 - DNA, 601 bp, Human
tttttttaatgaattttttttcttcaagtttcttagtttagtaggtaacttgattcccaaattcacttctcttatttgtacatattgtttgggtctatctgttaggagactttatctgataggagacttcattttaaggtttttaaaaaaattttttttttagtgttttttgttttgagacagggtctcactgtgtcacccagactggaatgcagcgacgtgatcgcagctcactatatagccttggcctcactgctgggcttagtgatccacctacctcagcctcccaagtagctgagascacaggcttacgcctcaatgtccagctagtttttgtatttttttgtagagacagggttctgctatattgttcaggctggtcttgaacccctaggctaaagcgatccgtccacctcagcctctcaaactactggcattacaggtgtgagccactgcctaactttttcaagactattttttttagagcagttttaggtttacagcaaaattgagaggaaggtacagagatttcttatatacaccctgtccccacacatgtagccctcattatcaacattccctaccagagcagtctctttgt

SEQ ID NO: 172088 - DNA, 601 bp, Human
gttacaattcacaaacctacattgacaagtcattatcaccaagagttcacattttacattagggttcattcttggtgctatacattctgtgggtttgaagaaatatatgatgacgtgtatccaccattgtggtatcatacagaatagtgtcattgctctaaaagtcctgtgctccacctattcattcatctcacccccttcccaaccctaggtagtcattatttttactgtctccatagttttgcctttttcagaagtcatatagtttgtttttgtttgtttgtttgtttgttttgagacrgagtcttgctctgtcgcccaggctggagtgcggtggcactatctcagctcactataacctctgcctcctgggttcaagcaattctactgcctcaacctcctgagtagctgggattacaggtgcgcgccaccacacacagctaagttttgtattttcgtagagatggggttttaccatgttggccaggctggtctcgaactcctgacctcaagtgatccacctgcctcagcctcctgaagtgctggaattacaggcatgagccactgctcccagctcagaagtcatatagtttgaatcata

SEQ ID NO: 172089 - DNA, 601 bp, Human
atatctgctttatagttttttgtaagtaaaaaaagtaacagcaatttttatttttaaagcatgtgaagttagtttttgtctttgcaaactaatcaacttttagctactaaaaaaataaaacaagctatataaatagtatactatgttatttaacataattaatgaaatttggtaattttttagttacgaagatgaaatgagagtgtaatatttagtcttgacatttatgcttatcacattacataaaaagtaatattaattataacataccctaaatttgttaaatttggaatagttatascttctttgcagcaaatatttttattctattgcagtaagcaggttattgcattgtttatataattattaccctgttttactggtttacaatttgttaaagaaaagtcactatcaaagctaagtcttcatttagatatatattgtttttagttgaaaccccccacagcgccccgacttttttttttttttttttggcaacagggtctcactatatattgcccaggctggactcaaactcctgagctcaagcagtcctcccatctccaccttcctagtatctgagactatagggatgagccac

SEQ ID NO: 172090 - DNA, 601 bp, Human
taccttaatgaatttctgtggtagatcaggcatcttaattctgctaactgcatcatatccagatactgttacgtctgttgcacatagatgaagatacagaagctttaagaagttaaatagcttacctgaagttatttaggaaatggccaaagtaggaatttgagtatggtttgcttagattccgagtattgctctttctgttaaacacctgcaataaccattctcaaaacatttgacatcagtactcctttacattcttcaaagttattgaggatcccaaagtttttgtttctgggggttrtatctttcagtatatactatatttgaaattaaaactgagaaatttttaaaaaacatgaatacataagcatatattgtattggctgttaaagaataaggcacgtgacattttagtattattctgagaattatttaaagctcatagactccctcaaaagggttgaggggagggggtacccagaccgtatattgagaaccactaatctgtaagaagactagtgagtttggcattggacaaattcatctctccattctttttcagtttaatgttctgttagtcttctgattacaatggatacta

SEQ ID NO: 172091 - DNA, 601 bp, Human
ttaagaagttaaatagcttacctgaagttatttaggaaatggccaaagtaggaatttgagtatggtttgcttagattccgagtattgctctttctgttaaacacctgcaataaccattctcaaaacatttgacatcagtactcctttacattcttcaaagttattgaggatcccaaagtttttgtttctgggggttgtatctttcagtatatactatatttgaaattaaaactgagaaatttttaaaaaacatgaatacataagcatatattgtattggctgttaaagaataaggcacgtracattttagtattattctgagaattatttaaagctcatagactccctcaaaagggttgaggggagggggtacccagaccgtatattgagaaccactaatctgtaagaagactagtgagtttggcattggacaaattcatctctccattctttttcagtttaatgttctgttagtcttctgattacaatggatactactctaacctactctaacatggtgcttacggtatattgctcatccatttaatagtgtagattagttaaatagtatatatagtgttatgtttacagtacatgctct

SEQ ID NO: 172092 - DNA, 601 bp, Human
aaactattgatacacatttactagacatttttattatgttttatagtagattacttcattataaggattacataaaattcaatgattactgacctagttaagctacctctgaatgtgaaaggacaagtataggtgcacctactttaaattgcacaatataaatcttttcatttattcaaataatatttgaagttcagttaggttttgcaaaattactcgtttggatgtgttaagaaatcatgtaaactcttcctttgactttgggggaatgaacatgagatttgtttattcttggggggcrgttaattttgtattctagaaggggggttaatgtataatatattttagctaagagaaatcagtttaagataaccaacttttcttaatctaacattttggcttatttctgtcatctggtcattctcatacaaataatacaaagctaaatatacataatacatatgcacatatatgtatatgtatacattatatgtaatacataaaacaaagctaaatttgtattatggatttaggagtgtaatggaaaatacccctttaagaggaaaagcacaaaactgaattagtcaagaaaataataaat

SEQ ID NO: 172093 - DNA, 601 bp, Human
agtagattacttcattataaggattacataaaattcaatgattactgacctagttaagctacctctgaatgtgaaaggacaagtataggtgcacctactttaaattgcacaatataaatcttttcatttattcaaataatatttgaagttcagttaggttttgcaaaattactcgtttggatgtgttaagaaatcatgtaaactcttcctttgactttgggggaatgaacatgagatttgtttattcttggggggcagttaattttgtattctagaaggggggttaatgtataatatattktagctaagagaaatcagtttaagataaccaacttttcttaatctaacattttggcttatttctgtcatctggtcattctcatacaaataatacaaagctaaatatacataatacatatgcacatatatgtatatgtatacattatatgtaatacataaaacaaagctaaatttgtattatggatttaggagtgtaatggaaaatacccctttaagaggaaaagcacaaaactgaattagtcaagaaaataataaatgtttgcaataagtgtcatgaccgggtatagtggctcagtgcttt

SEQ ID NO: 172094 - DNA, 601 bp, Human
gtgggaatcagttaacaacttggttcattaaaactatttttttctgtggttaattcagtggttagttgaccatttaattaagtaggattgaccagttaaaaataaacaatatgtttaattatagaattaaaagataaagaaattgctttcactttgacttcttataagttagttaaaataatttcctgttcaatcataaatccatttgtataggaaggcttttcatcaaaaactaaattgaccgttaaatatttttagacaatcaaaacagtacgttaactgtaaggacttagaaaacacrtccataaaagcaagaaaattcttttgctttccactagttccactggagataaccattgttaaaactcgagaatgtgtcctttcagtgtgtgtatgtgtacatacagtattgttttgttttattttgtttgacggagttttgctcttgttgcccaggctggagtgcagtggcacaatctcggctcactgcaacctccgcctcaactattttaaacagcagtttaaatgcttagtggccactctgtttttttgtttttaatttactttaatggccatcttattgttaaatctttgagcacat

SEQ ID NO: 172095 - DNA, 601 bp, Human
ggctggagtgcaatggcacgatctcagctcactgcaacctctgcctcctgggttcatgcgattctcctgcctcagcctcccgagtactgggattacaggcacacaccactacacccagctaattttgggtattttttagtagagacggggtttcactatgttggccagactggtcttgaactcctgacctcatgatctgcccgcctccacctcccaaagtgctgggattacaggtgtgagccacggttcccagcctttgtttgcatttttttcttccttttttttttttttttttttttttgagacggagtcttgggctgtcgcctgggctggagtgcaatggtgcgatcttggcttgctgcaacctctgcctcctgggttcaagtgattctcctgcctcagcctcccgagtagctgggattataggcatgcaccaccacacccggttaattttatatttttagtagagttggggattctccatgtttgtcaggctggtcttgaactcctgacctcaggtgatcacctgcctcggcctcccaaagtgctgggattacaggcgtgaaccactgcgcccggcctcatcttttaatagttatac

SEQ ID NO: 172096 - DNA, 601 bp, Human
attttcattgcctttttttttttttcttttttttccgagatagagtttcactcttgttgcccaggctggagtgcgatggtgcgatctcagctcactgcaacctccacctcctgggttgaagccattctcctgcttcagcctccctagcagctgggattacaggtgcctgccatcacgcccagctaatgttttatatttttggtacagacagggtttcaccatgttggccaggctggtctcgaacttctgacctcaggtgatccactcatctcggccttccaaagtgccgggattgtaggcrtgagctacggtgcctggcccattgccttttatgtttactctaggtataagtgtatttcactcagtatgtatttatgcctgctggagacattatagtattgtagtctatgaatgctgactcgagccaaattgcccagattataattctggctttctcatttactagctgtgggatcttggtcaaaatactaatcccatagtgcctctatttctttatcagaaaataggggtcatagtagtagtaatgcataagaattaaataacttttgtgaagttcttcagaactatgtggtaaattgta

SEQ ID NO: 172097 - DNA, 601 bp, Human
ttatagtttccatgaattgttcatctttgtcttgtacagagtagaattaataaaatgtttattttttctttttcttccttcttccccttatttctcttttttccctgccatctctccattttttattgttgcaaggaaatatttacatgttaaacagttccttaaaaagccctctggggttaaatatttttttcctcaaaaactataatcatctaattctcaaatgaaaatgcttaagtgaacaaaatttaactggaattcgatcacattttaacataaaagtcaaagattaaaattggartgagaagggacacataaatgaatgctagcaaacaaaacaaacatttggtcattttaaaagttgtgtattttggataggtgccatggcttatgccataattccagcacttttgaaggctgaggtgggcggatcacctgaggtcaggagtttgagaccaacctggccaacatggtgaaaccccatttctactaaaaatacaaaaattagccaggcgtggtggccggcgcctgtaatcccagttacttgtcaggctgaggcaggagaattgcttgaacctggaaggcagaggttgcagtgagc

SEQ ID NO: 172098 - DNA, 601 bp, Human
ccaccgtactccagcctgggcgacagagcgagactccgtctcaaaaaaaaaacaacaaaaaaaaaacccaaaaatcttatgatgtatataaggacttccaagcagcaaacctggaaatcatttttaacccttccatcttaatcactccaaaatattcttgttgataacagttatgatatttctgcttctgtaaacctccgccagtttctcactctttcagactgtcctcttccttgatacaaaaattgtgtgaatatcagatcttctcatgtcaacattgcctattgcagtagtcgcaatkccatatacacaaaagaattgtctaggtcgtttcataattagttccccaacttggagccaaaggatctatatttttacctaggtcttttagctggtccttatatagccaatccaggagatactggccaatagaataaattcagtctctttattatgttcacagtctgatcctaaatatccttatcttctctcctcctttgagtaccttctccttcttttagtcttaggctttgtttacatcaaacttctcaattccccacatagattatacattgaatctgctgtgcttatgtatatttcc

SEQ ID NO: 172099 - DNA, 601 bp, Human
ctattgcagtagtcgcaattccatatacacaaaagaattgtctaggtcgtttcataattagttccccaacttggagccaaaggatctatatttttacctaggtcttttagctggtccttatatagccaatccaggagatactggccaatagaataaattcagtctctttattatgttcacagtctgatcctaaatatccttatcttctctcctcctttgagtaccttctccttcttttagtcttaggctttgtttacatcaaacttctcaattccccacatagattatacattgaatctggtgtgcttatgtatatttccttcactttttatgggataaccttcttttgatatccaactatgttgtagctgcacacactcaacagttagccatagcctctttattccctgtatactgcagtcatactttggctggacataactgtctccccatcttgaatgctgagggtcaagaacagttttgtttccacagtgccaagcacagtgtctgagatgcattaagtggtgttcaataaatgtttgcagtaaaccagcaggtatttaagttttatgtgaaaagctgaagaagattttactatttt

SEQ ID NO: 172100 - DNA, 601 bp, Human
gggataaccttcttttgatatccaactatgttgtagctgcacacactcaacagttagccatagcctctttattccctgtatactgcagtcatactttggctggacataactgtctccccatcttgaatgctgagggtcaagaacagttttgtttccacagtgccaagcacagtgtctgagatgcattaagtggtgttcaataaatgtttgcagtaaaccagcaggtatttaagttttatgtgaaaagctgaagaagattttactattttctgaatagatacacaaagttgatgtattaaaytttctgttttagaaaataccagaggaatttaatgtatttaatttaatacaagaaatgagaacacaaaggcattctgcagtacaaacaaaggtatagttgtttgtttccctttataaactgctattttataaatgctttcttcttttttaaaatgttgttttcattttgttttttaatcatttttctccttcataggagcaatatgaacttgttcatagagctattgcccaactgtttgaaaaacagctacaactatatgaaattcatggagctcagaaaattgctgatggagtggtaggt

SEQ ID NO: 172101 - DNA, 601 bp, Human
tgtgttttgtctaacatgagaagaatatccaggacacttaacatttttacttaaactcatttccttcttattcgtatctgtattatgatggctatttaatgactccgatataaggtaaattatgttctaaatgaaataaagttaggaaagatctcatgtcaaaaatcatataattcgttaatgttttacttttttaaaaaataattgcattgttctctttactcttcccttccacccccacccaagtaattctgcattgattctacttgaatttcattttgtataaagtgttttagttatytgtgtatatgcttttcttttcttttcttttttttgagacagagtttcactcttgttgcccaggctggagtgcaatggcacagtctcagctcactgcaacctctacctcccaagttcaagtgattttcctgcctcagcctcctgagtagctgggattacaggcgcacgccactgtgcccagctagtttttgtatttttagtagagacggagtttcgccatgttgaccaggctggtctcgaactcctgacctcaggtggtctgcccgccttggcctcccagtgtgcaatgtgctgggattac

SEQ ID NO: 172102 - DNA, 601 bp, Human
taaagaaaatgtggaatctgaaaaattgagaaaaatcatcttagaactgtgtggttgaatgaaatgacttgaaaggtgtattaactatttagaagctatgctgtgagaagtaaaaataagtccccacttactacttttctgacaatttaatcggtaaaagttttgtttaaatgttctgtgttccagtattatttctgtagaaattttagtttgatatactagttggttgtttaagactttaaaatgaatagtgttttttagagatatttataactacagtgacttcctggagtgagagatstaaagagaaaatttattctgtaagcctgtatcatattgactgaggatttagaggtaccttaataagcaaacatctgttaagttgtgcagtgtgcctttttatcttgtgtgtaaaggacaccgttacaagtactgtcaacaccagtatttcagttctagaatgattaagtaatagcaataacagtttgtattatcgtccttttattgtgtttgtatagtacattttagatgtgataatgaattctggattttttttcctaaaatataatttttttatttttaaagcaccctgatttataat

SEQ ID NO: 172103 - DNA, 601 bp, Human
atgatggggccaggcgtggtggctcacgcctgtaatcccagcactttggtaggccaaggcaggcggatcacaaggtcaggagtttaagaccagcctgatcaatatggtgaaaccccgtctctactaaaaatagaaaaattagccaggcgtggtggcacgcgcctgcagttccagctacttgggagactgaggcaggagaatcgcttgaacccaggaagcgaaggtgccagtgagccaagttcatgccactgcactccagcctgggtgaaaaagcgagactttgtctcaaaaataaaaaaasaaaaataaagtacatgttggctgggcatagtggctcacgcctgtagtcccaacattttgggaggctaaggtgggcggattgcttgaatccatatatatatatatataaaaatatgtgttgtgtgtatatttcatttttatttatttatttatttatttactttttaaacgtttttgttaaaaataagacacacacacacagtagcctaagcatacacagggtcaggatcatcaatatcactgccttctgcctccatatcttgtcctgctggaaggtatcgggcagaaacacacatggagc

SEQ ID NO: 172104 - DNA, 601 bp, Human
gttcgagaccagcctggccaccatagcgaaaccctgtgtctcctaaaaatacaaaaattagctgggcgttgtggcgggcacctgtagtctcagctacttgggaggctaaggcaaaagaattgcttgaacccgggaagtggaggttgcagtgagccaagattgcaccactggactccagcctgggtgtgacagagcgagactccatctcaaaaaaaaaagtacataagccaataactattttctttatcattattatcaaggattgtgtcctgtacgtaattacatgtgctgtgcttttatrtgactgacagcatagtagctttgtttataccagcatcacaacaaacgtgaatgacgcattttgctacaaattcatgggaatttttcagctccattataactttgtggggccaccatgttatgtgtggcccatcattgactgaaacgtcacatgactgtacatgtctttcagtaatttttaatattccaattctttctgttttattttgttttgttttcagacagagccttgctcttttgcgcaggctggagtgcagtggtgtgattatggctcactgcagcctcgacctcaattgaacct

SEQ ID NO: 172105 - DNA, 601 bp, Human
tcgcgccactgctctccagcctgggcaacagaatgagactcttgtctcaaaaaaaaagaaagaaagaaattaaaatactataaatttaaaaattaagcagaagtttggaaaataaggaactccattttccaataaaatttccaaaataaagaaattcattcatttcaagaaaatgaatggataaagaaaaagtaggagagaaaagataaggaaattagaaagcaaaactagaagatctgtcactgaactaataatagtctaaaaggagagtagggaagaagaaattagcaaaaaaaaaaaagaagaaaaaatgtgttagaattaaagggcataaatttttatatagagcgtatacaccaagcttgatatacaccaccaaatgtgatggataaaaataaaattgttaaaaaatatagttttttaagttacattatgaaattatagaacatccaacataagaaccttgcttaggtttagagtaagataaaaataatgctgaaatttggagtaagtttttttaaattaaaaactttgaaaatactcgattaacaaacccatatatcatactcgatatctgtcaagcactgttctaattgttgtt

SEQ ID NO: 172106 - DNA, 601 bp, Human
cagaaagaggaaaatgagacctgggaaacaggagaatctgaaaccagagagaacattagctctgtgatggactagggaaccagtagtccacactggagcaggaggccaaaagttactaacaaggatgtctgtggtattgatacttactatgtgtgcttgtcattattgagaggaggtataccaatctgcaagaaagttagaagaaaagctgagtaactgatgatgcatagagagctaagccatcagaaatccaaggcagtcattaggggaaaacaagacactatagaagaaaagatacgawatcatggtgtcatagatgggaatactatctgcagtcatacgactgaggtaatgaaaaattacaatataacagtattggaaagatagagaaggacacttccacagtaggaagtcagtagaaaatgtgtgaaacaaagatcaagaaataacttttgaaatagtctgaaatacagaggtgtaaattttagaagcagctataaaaaaatgttgaaagttgatgcctctggctaacaggagggctgcggggcagagactatgtttttcattcaaagtcttgtatttgactttttaaacagtatat

SEQ ID NO: 172107 - DNA, 601 bp, Human
ggaaaacaagacactatagaagaaaagatacgaaatcatggtgtcatagatgggaatactatctgcagtcatacgactgaggtaatgaaaaattacaatataacagtattggaaagatagagaaggacacttccacagtaggaagtcagtagaaaatgtgtgaaacaaagatcaagaaataacttttgaaatagtctgaaatacagaggtgtaaattttagaagcagctataaaaaaatgttgaaagttgatgcctctggctaacaggagggctgcggggcagagactatgtttttcattmaaagtcttgtatttgactttttaaacagtatatgtgtattaccttgatgaacattaaattttcttagtctgaaaaactgcagtttttattcgcaaccagattgtaatggctcttaatatgctactcttagctacataattctcaggtatcaacttgtttaacagtcttaaaatgccctttttaaatgtttgtttttcagttgccttgttgaaggggatgctaaagaagaaatactgcagccaccggaacctcatccagtgccacccatcttgacaccttctcccccttcagcttttccaa

SEQ ID NO: 172108 - DNA, 601 bp, Human
aaagaattattatttttttagcactcttagcatttcaagataatgcatgcactcagttcccaaagtgtattattgcttcttgaaactcctctttgatctgctgaaagtaatgatggctaccatcttaaacagaccctaaggttgagagtaaacatataaatttgaaagctgtttattgatatattgattatcagtggtcacttacctatcagtgaactttggtagtgacacatacagactggtatttataacgtgcaggcaaaataagtactgtgaccttgaaagatttttttttttttttgagacttgcactcaaaagattttttttttgagtcttgcactgtcacccaggctagagtgcagtggcaagatctcggctcagcctcccaagtagctgggattacaggcacccactaccacacccagctaatttttatgtttttagtagagacagggtttcgatatgtttgccaggctggtctcaaattcctggcctcaagtgatctgcccacctaggcctcccaaagtgctgggattacagacgtgagctaccacacctggccttgaaagattattttctatttctgacccattatatacc

SEQ ID NO: 172109 - DNA, 601 bp, Human
taatgatggctaccatcttaaacagaccctaaggttgagagtaaacatataaatttgaaagctgtttattgatatattgattatcagtggtcacttacctatcagtgaactttggtagtgacacatacagactggtatttataacgtgcaggcaaaataagtactgtgaccttgaaagatttttttttttttttgagacttgcactcaaaagattttttttttgagtcttgcactgtcacccaggctagagtgcagtggcaagatctcggctcagcctcccaagtagctgggattacaggyacccactaccacacccagctaatttttatgtttttagtagagacagggtttcgatatgtttgccaggctggtctcaaattcctggcctcaagtgatctgcccacctaggcctcccaaagtgctgggattacagacgtgagctaccacacctggccttgaaagattattttctatttctgacccattatataccacccatactgtagtgcttgtattttctctcacacatactgtattttttaacttgagagagtgtatttggtagactagatgacagtctttttgagacagagttttgct

SEQ ID NO: 172110 - DNA, 601 bp, Human
tgtttttagtagagacagggtttcgatatgtttgccaggctggtctcaaattcctggcctcaagtgatctgcccacctaggcctcccaaagtgctgggattacagacgtgagctaccacacctggccttgaaagattattttctatttctgacccattatataccacccatactgtagtgcttgtattttctctcacacatactgtattttttaacttgagagagtgtatttggtagactagatgacagtctttttgagacagagttttgctcttgttgcccaggctgaagtgcagtggcscaatcttggctcactgcaacctccgcctcctgggttcaaggaattctcctgcctcatcctccctagtagttgggaatacaggcatgcgccaccatgcctggctaattttttgtatttttagtagagacagggtttcactgtgttagccaggatggtctggatctcctgacctcgtgatccgcccacctcggcctcccaaagggctgggattacaggcgtgagccaccacgcccagccaggtgacagtcttaaactatttgcttaaattacagaattatcttttcttgatttatctttgtt

SEQ ID NO: 172111 - DNA, 601 bp, Human
gttcctcagcttcagaatttgaaatataactgcccagctgtaactatataagaaaatatgtagataagaaattttcattttgagtttttagtatatcaagcatgtggtattgtacctaggaagttttattgtttttttgttgttgttttgttcttttgcttttttttttaaaaaaaaccaaaaaaccattactggaaataggatttggtgagggccagaaagatgtatgatgtgatatgcttattaaaagttactactacatgacgagtctgttggtggctcatgcctgtaatcccagcaytttgggaggctgaggcaggaagttcacttgagcccaggagttcataaccagtctgggtgacatagtgacacccaatctctacaaaagataaaaaactagccgggcatggtggtgcacacttgtggtcccagctactctggaggctgaggtaggaagatcacttgagcctaggagctcaaggctgcagtgagccataattgcgtcccggcactctgcctgggcaacagagggagaccctgtctcaaaaaaaaaaaaaaaaaaagagtaagatatagctaaaagcaccctactatgtgccag

SEQ ID NO: 172112 - DNA, 601 bp, Human
aaaaaaagagtaagatatagctaaaagcaccctactatgtgccagctcatttctgtttgtttggttttgtatttcaaagcaaaaatcactatacatgtgatttctggtttctttttactcaaccttaactatgttattggtttgattttaaccgaagattttcctgtgtgtaaatgttctttgttgcagcataactacaagtagtctcatttttaatgtgttgccaaatatttaccatatggattatttactttatagattgtttatttaccttatagattattatttcctttgtagatcwttatcttatagagccattggcaccagaattagagttttggggggttttttggtcctagaacttgttagtgaattacagtcacacatttcttaatggcagggatatgttctaagaaaaatatgtcattaggcagttttgccattgtgtgaatgtcatagaatgtatttacacaaacctagatggtatagtatatactacacatctgggccatacaatgtaacctcttgctcctaggctacaaacttgtatagcatattaccatactcaacaattgtaacacaatggtaagtatttgtgtat

SEQ ID NO: 172113 - DNA, 601 bp, Human
tttaccttatagattattatttcctttgtagatcattatcttatagagccattggcaccagaattagagttttggggggttttttggtcctagaacttgttagtgaattacagtcacacatttcttaatggcagggatatgttctaagaaaaatatgtcattaggcagttttgccattgtgtgaatgtcatagaatgtatttacacaaacctagatggtatagtatatactacacatctgggccatacaatgtaacctcttgctcctaggctacaaacttgtatagcatattaccatactsaacaattgtaacacaatggtaagtatttgtgtatctaaacatagaaaaggtacagtaaaaatatggtatcataatcttacaggaccgctgttgtttatgcggtcttgttgatgaaaacatcattatgtagtgcatgactataatggaatacttttgtattgatacctaaaaaaaacttttgcataagttactgcctgacaaaaattcttagctatcaattctaatttcagtcttgacttaggcctcctgaaagatttctcagattcaactacagaaggccccatacagtgtatgatttgc

SEQ ID NO: 172114 - DNA, 601 bp, Human
agtggaaaaggtttcttgcatttttttgcatttttaaaaactgatctagatatttgtgacaggaatttttagaatgtcaagaaagctctctgattttgtttagatgacatgttaatttgtctaaatttttatgtgtttaatttagatgttgatgttagtgaagattcacctcctcccctacctgaaagaactcctgaatcgtttgtgttagcaagtgaacatagtgagtgtctcttttgcttttacatttacttcatattctaataataaactccgaaaaacatacctgattttaatctaktagctattgtgctacataattaaattcaaaaacaagtaaattgatgttgacatgcttttaattctttgtttgaaaaatgcttttaaattatattttttacttgctaagatcgatagaaattactgcatttatgttagatatcagaattcaattcatttaaatgtaattataggctgggcatggtggttcaagcctgtgatcctagcactttgggaggcctaggcaggtggatcacctgaggtcaggagttggagaccagcctggccaacatggtgaaactccatctctactaaaaatata

SEQ ID NO: 172115 - DNA, 601 bp, Human
gctgcctccctggagcacaggacttgggtgcagtggcagagttggagatcaaagagaaatgttaccaaaattgtaacaggtgaagccacagttaagtacagttactgaagttctcccatcctactaatttgaaagccatagaaggcatttcagatttcacaagaaggagcttaggtgagtatattaggaccctggtcaaaaagccaggctgcaatcacctgcagtttttgttgattaatttacctacatggagtaagtaggcctcatctgatgtaggtaatcttcagcaaggggacctcasgttttatgagactgttgctgcagactgattgtgtgttgacttaagacagttgttccttaagctctttttcaatttagcctgttttctctttccatattgctattcataatatttggggtttgatatgaagggattccggctattcagtgacttgtatgcgtcttgaaaaagtagattcttatggctagggagttttaaaggtaaaggaagctgcaccataaaatttccttcttcaaataaagtagatctgaaatgttggcctagatatgctcccatcccagattcccgattcacgtttaa

SEQ ID NO: 172116 - DNA, 601 bp, Human
caggattattaatgtgctggtgggaagagatcaaaccttaccaataaaacctctccgccgagcctcatgcctttctcttaccgcccaagctcactaaccctcttaaactctctaagtaagtttcaaagcggacgaaaaaggaggacggaaagacaaattgtgggcgcctatggagacagaaaaaaaaatctatcctacaacgtgacccctcagcaaccctcctccacctttaaatggctttttgtttttggaaatgcctggataaaccgcaaaactctcggcgcgctcttctctggctggmtacaactccttaacccccccacccccacccagcgtgctcagggcacccgcaccgtgctagcttgtggcggctctcaaactaatcctgactgagtttttgaggcagccttctattcccactcgcaccaacccagcacgcttaccaaaattcccaagtaaccttctctttgttacgcaaacgccaggagctgcttgattctttcttctctccacccctatcccctttccagcctagccggcttcctggccgggcaagctgggaattcagcgactgaagggccttggaaggtgccggagggga

SEQ ID NO: 172117 - DNA, 601 bp, Human
attatgcaacccccataatctcgctgcagatctgcgagggcacagatgtgtctggtttcttttacaaatagacttaatatgttcttggcaaaaaaaaaaaaaaaaaaaagaaatcttccacttatgcacggaatacagagagagtgaaagaaacgtagacacctcaacccggggctctcttttaaagttcagcaagagtcacacactgagaaggaaccggtggtggggtgttttcgtaggaaaggggcggcaggtcaggatgagattctcactgtcatgagtatgggtttgggcgggaggkggagggattgccaaacgcgtgttgtacaaacctgccctggggctacaactccccttcctcaaaactaccacccctctggaactgacggagaacctctccagggtgtgtgtgtgtgtgtgtgtgtgtgtgtgtgtgtgtgtcaagttccagggagaagtgtggaggatgagggctgtggtctcaattctgccagagtaggggatgctaatattagcaggattattaatgtgctggtgggaagagatcaaaccttaccaataaaacctctccgccgagcctcatgcctttctcttaccgccc

SEQ ID NO: 172118 - DNA, 601 bp, Human
gacttctgttttcttttttgccttgttggatctctgcagagcttgtccttctttagttgccttcaataaaacttcactagccagtagaggggcagaatgaagtatttttcagaaacattccgcttttcatggtcgaaataattttatttatccagaatatacagtttaattcctctatctacacttatttacatggctaaaataacattgaaaaaagtcttttgaaaagttgaggtcatagatttcaaggcaccattgaaagtgtccacagttgcgcaaaaaaagtcctctgtaaaaaaagggggggtcttttgaaatgcaataacttacatgcaaaaaaaagctttacacatgaatctttttcagttttccgaacttccccatatgaattcctttctttatgattttctagaacagcaaaacacagtagtcccaaaaaagagagtaagagagagcagcccatctaatagagtgtcccggaggccagcgccagcgggtgctgtaaggagcccggcggcggcaggtgggaattgattgagctggctgcacttgtgtaccaggatgcagagttctccaggtagctggacgctggggactggtt

SEQ ID NO: 172119 - DNA, 601 bp, Human
atggcaagcacgttgtgggtgtgctgagtcatgttttaacatgttattgtggagttattggaagataatttcaaaagacatttcccctgaccactattgtgattactgttaaatagaaaccatagttttgtatttgcatagagaacagatatcttagctgataaatatttttcttattatcctgaaggtacatacatataggtacctaatggtactatttgccatttacagttacattgattagggaaggtttttcgttagatagttgagacgtttgttattgtatcgtgagtgaaatgtratgactggcaaatgtgtattccttatttgtgaaaagggaatcttatttttattgcttatttcctatagtcgtatataaagtttatctaaattagatgggtagtaaaattatataaaaatatcctactatatcagtgattggtaaaattgagacccctgaccattctgcattttcctaacccagcttggggatattggtggtcattaattcatcacagaatacctagtctagcatactactttttgctttaacttactgtggagggatattaaaatccatgttttaatgacaatacagcag

SEQ ID NO: 172120 - DNA, 601 bp, Human
cctgtgttgttgagggcccaggatgcctatggggtcctctggctgtctgagttgtgacgtatgagctgctttgtgatacagtgaactccctgtcattgtggatctggagaatgtgtcatagaacctagatagcagagggaagtacagttgtaatgaattcaccttcaagcttcctgagactcttggctggaacagaggcaggactcagacgtttctggcgagtggaatcaggcttcatatcctgaattctccacgtgaatgtaagctccacaaaaccagggactttcatcttagcctaccragaacaccaagcagaattagacaagaagaaatcacccccttcctgctcctttctccgtcctacatgacatttgtgcttttgctattatccttttgtctcttcctgggcctcaacatgtgactgagtcaacacacatcttcattctcatttctctgttggtggtcttctcagttatatttggctagaccatgctttctgcttctagaagcaacactgctgaattcacaccagagctttggtacaaggcaacttcctgattccttcactttccccagttcagacattccccttgtcttttct

SEQ ID NO: 172121 - DNA, 601 bp, Human
acagtagatgaatgctcaggacactactgttcccaggagggcactgcttgccaaggtttactgctctaagaatgttcttgggcttcagtctggttccatcaggcccagagaaaacagcagctgtaaaggcctggagacaagaatgacctcaggagttggagaaacagaaaagatggcagttttactggaatttagtgagtaaagaggcaagtggaaggacttagaattaaagaagtgatcagggggctagccagatcagacaggctagtagtttaaaccctgtcagaccaatacccccttkttataataaatattttgtagtgttcccttcagtatcttgaaatgaaattcctagataatattataaacctgcacacctaattaaaatagcatatcttaataatgtaaaggaacatattttataataaaataatagatatttaatatgtaaaaatttagaaacagcttcatgagcaaacaagtagtgatatatgcttgcagctatatgtaatactactttgaatacaagtgcagtgataactcatgttgtattagtgaatcacatcacaaatggtagtattgttattgacatgattttcca

SEQ ID NO: 172122 - DNA, 601 bp, Human
caggtgtgtgccactacacccagctaatttttgtatttttagtagagatgaggtttcaccatgttggccaggctagtctcaaactcctgacctcaagcgatccacccaccttggcctcccaaagtgctgggattacaggatgtgagccaccacaccctgtctcttctactgtttttaatatgatggatatcatctcagtaatataatcctgaaaaccttggagtagctttatccttatgctcttcttccagatgcaatagcccaggcccagtaacaccaagccagtaacacatcaggacasagccagtgggcacaaatgtatcagaccagcatgtgtcaagccaccccaagttaatcactcccagggaatagcttccagctgtaccaattaggcagtatattattgcaccgtgtgaggaggtccgtctttgtctccttctggaatcactgtgtcccctcttcccaggaggctttatattccagaaggcatcagacatatccaggtacttttggcctcttcatgacaccatttacacactaagtaccagctgctaggtcaaaggtttggcaatcacttctttggacaataatcactttatgt

SEQ ID NO: 172123 - DNA, 601 bp, Human
attgcaccgtgtgaggaggtccgtctttgtctccttctggaatcactgtgtcccctcttcccaggaggctttatattccagaaggcatcagacatatccaggtacttttggcctcttcatgacaccatttacacactaagtaccagctgctaggtcaaaggtttggcaatcacttctttggacaataatcactttatgtgctgtgctacagaaccagcaaagccactgagatcccatatatctagtaggcatatgtttggacactcacgtcaatacccagttcttatacttgtctgcattstgatttctcattaaaatgtatttctcaaaagagtctttttcccacccccatctccagcacccccccaccaccccgaccctcagaaatcagagattgtgatcctttgggagtgagagtcacagattgcatcatttagaagcccctcccagcagcatttcctacactggttcccagttccctgggccatagctaaatcctacaatgtcataaggaattgttttggtttgggatcatttaggtggtaactctactttggtccatacgtacacttttcaagatttatcttccaaaaatcttcaa

SEQ ID NO: 172124 - DNA, 601 bp, Human
agtttaagtgggaagaccaagagtcaattttggatacgttaagtttgagctgccttttagatatcgagagaatagtaggatatatgaatctgaagctcagggcccaaggtagttttggaagttaaagcatacatatgatatttaatacattaggtctgaatgggagatgagggagtaaggcagttataataagcatggacagctgtactgagaagttttgctgtggtgggaagcagagaattgggtaattgttgaaaggagttttgtggtcaatttagagatcttttaaaatgggagataytaaagcatgtttgtaagcagaaagtaatgaatcagaacagagggaaacattgctgcattaaataagtgggataattacaagaattgatttctggaattggcaagatgatatgataggctctacagcacagatggaaaagttggccatgtataggtgcagttccattgtgactggaaagtaggcctggaaaatggacacagattggccaggtgcagtggctcatgcctgtaatcccagtactttgaaaggccaaggctcttaaggtcctcaaggatcacttgagatcaggagttcaagacc

SEQ ID NO: 172125 - DNA, 601 bp, Human
aagttaaagcatacatatgatatttaatacattaggtctgaatgggagatgagggagtaaggcagttataataagcatggacagctgtactgagaagttttgctgtggtgggaagcagagaattgggtaattgttgaaaggagttttgtggtcaatttagagatcttttaaaatgggagatattaaagcatgtttgtaagcagaaagtaatgaatcagaacagagggaaacattgctgcattaaataagtgggataattacaagaattgatttctggaattggcaagatgatatgataggstctacagcacagatggaaaagttggccatgtataggtgcagttccattgtgactggaaagtaggcctggaaaatggacacagattggccaggtgcagtggctcatgcctgtaatcccagtactttgaaaggccaaggctcttaaggtcctcaaggatcacttgagatcaggagttcaagaccagcctggccaacatggtgaaaccctgtctctactaaaaatacaaaaattagctaggcatcatggcaagcacttgtagtcccagctactcaggaggctgatgcaggagaatcactcgaa

SEQ ID NO: 172126 - DNA, 601 bp, Human
atcccaggagattgaggctgctgtgaactgtgattgcgccacggcactccagcctgggcgacagagtgagaccctgtctctaaataaataaatgaaagaaaattaaaaataacattttggcagtaatgtaacattaaacttttttttccagtgttgcagatttggaccagacacttgatatattttactagtataatgtatacacatttatgtattgtcacaatttttttttaatttccatttttattttagattcagagggtatgtgtgaaggtttagttaaaagggtatgttgtgtagygctgaggtttggacttttgttgatcctatcacccagatagtgaacgtggtaccgaataagaagtgttcagcccttgtctccttccctccctacttttggagtcctcagtgtctgttgtttccatctttgtgtccatctttgatgcattaaataagtgggataattacaagaattgatttctgggattggcgagacaatatgatgggctccacagcacagatggaaaagttgtgaacgcaagatttagctctcatttataagtgagaacataacagtatttggttttttgtttctgcatta

SEQ ID NO: 172127 - DNA, 601 bp, Human
tcacaagtgtgagccaccacacccggcgcatagtcttcttttgaggagagtgtattcatgtcctttgctcactttttaatgggaatgtttgtttttttcttgttgattcgtttaagttccttatagattctggatgttagtcctttgtcaaatgcatagtttacaaataatttctcccattctataggttgtctgtttattctgttgagagttctttttgctgtgccaaagctctttagtttaattaagtctcctttgtctattttttattttgttgcatttgattttggggtattcatcmtgaattatttgcctaagacaatgtatagaagagtatgtcctatattttcttctagaatttttgtagtttgaggtcttacatttaagtctttaattcatcttgagttaatttttgtatatggtaagaggtaggggtctagttttattctgcatatggttagctagttttcccagcaccatttttcgaatagggtatcctttcccccattgtttatttttgtcaactttgtcaaagatatgttggttgtagatgtatggctttattttaggagtctctattctgttccatcagtctgtgtat

SEQ ID NO: 172128 - DNA, 601 bp, Human
cggcgcatagtcttcttttgaggagagtgtattcatgtcctttgctcactttttaatgggaatgtttgtttttttcttgttgattcgtttaagttccttatagattctggatgttagtcctttgtcaaatgcatagtttacaaataatttctcccattctataggttgtctgtttattctgttgagagttctttttgctgtgccaaagctctttagtttaattaagtctcctttgtctattttttattttgttgcatttgattttggggtattcatcctgaattatttgcctaagacaatstatagaagagtatgtcctatattttcttctagaatttttgtagtttgaggtcttacatttaagtctttaattcatcttgagttaatttttgtatatggtaagaggtaggggtctagttttattctgcatatggttagctagttttcccagcaccatttttcgaatagggtatcctttcccccattgtttatttttgtcaactttgtcaaagatatgttggttgtagatgtatggctttattttaggagtctctattctgttccatcagtctgtgtatctgtttttgtaccagtaccatgc

SEQ ID NO: 172129 - DNA, 601 bp, Human
atactgtcagtgaagagagataatttgactacctgttttcctatttgaatgccttttatttttgtcttacctgattgctctggctgagacttctagtactatgttgaataggagtggtgagagtgggcatccttgtcttgtctcagttcttaaggggaattgcccattcagaatgatgttggctattggtttgtcatagatggctcttattattttgagatatgttccttctgtgcctagtttgttgagatgtattgccataattattatgaaataattactgtgtataaagtcattttttgtaagccaaggaagagatggatttctagatgtgaaattaattataaaaataatccataattgaccacacttctttttattttaaaagacattagtgaataaccttgtttcatgagaaggccagaccacatacacataaaactatgatgtgaagaatattgagtttagtgaatggataacaaccactgacagcctaacctgtccaaccattcttttaggtcttaacatatttctcagacctttatatatttggccctatcttttgttttgtttgttttgtttttttgagacagtttcactc

SEQ ID NO: 172130 - DNA, 601 bp, Human
aattattatgaaataattactgtgtataaagtcattttttgtaagccaaggaagagatggatttctagatgtgaaattaattataaaaataatccataattgaccacacttctttttattttaaaagacattagtgaataaccttgtttcatgagaaggccagaccacatacacataaaactatgatgtgaagaatattgagtttagtgaatggataacaaccactgacagcctaacctgtccaaccattcttttaggtcttaacatatttctcagacctttatatatttggccctatctkttgttttgtttgttttgtttttttgagacagtttcactctgttgcccatgcaggagtgcggtggcctgatctcagctcactgcaacctgtacctgccaggttcaagcaattctcctgcctcagcctcccgaatagctgggattacaggcacccaccaccatgcccggctaatttttgtatttttagtaaagatgggtttcaccacgttgcccaggctggtcttgaactcctggcctcaagtgatctgccccccgccttggtctcccaaagtgctggcattacaggcatgagccaccgcac

SEQ ID NO: 172131 - DNA, 601 bp, Human
attacaggaaagccttctggtgcaatatctggagtacagaaagcagaaaatggaccaattgactggagtggagacatgcctgtttcttgcagtctttctcggtaagtatggtgtacctaattctcatcttttgcactttggtgtttgaaatctttgttgcctagaaccacagatactcaaatactgaagtgtagtttgattttattttaattagatattgtcaaagcatgtgctttgataaatgatttttgtcttcgtggtggtgaaaagatttattctctgctatatgaataatttcccmagatcttcattaggacacagggcatacatttttgagattggtaatcactggtcttggaattcttcccagtgtagggatcatgctcaggaccttagtatcttttgtaatgacctccatattgatggataacaaatagtggattagatatgagtaaatttctcaactggagttgtaaaaagcaaacaatgaagagatttagtattatcttcattttaaaaaattcaaattattcaaagggtgagaaataatagttttttgtactttttagcatttcaaatgttcatttgggtcttgtttaat

SEQ ID NO: 172132 - DNA, 601 bp, Human
taatgggtcttggcacggtggcatacacctataatcccacctgctcaggaagctgagacaggatacttgagccccagagtttgagactgcaatgcataaagcatctgtgaatagctgctgcacttcagcctgggcaacataacaagaccccatttctagaagaaaaaaagctataattccttattcattgatgagtggcattaaatgaaggttacctagctttctgaaaagttgacagattttaaattttttaaattaatctaatatagtaataatgacagttcctttgatttgctggtaratactatgattttttaacctagacagaatatgatatattcactcttcaagtaacttttcaatactattttaggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatatacatagctataatacgtaagtatctctattttcttcttgtatcaacatgttctgttatataat

SEQ ID NO: 172133 - DNA, 601 bp, Human
attttaaattttttaaattaatctaatatagtaataatgacagttcctttgatttgctggtaaatactatgattttttaacctagacagaatatgatatattcactcttcaagtaacttttcaatactattttaggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatatwcatagctataatacgtaagtatctctattttcttcttgtatcaacatgttctgttatataatattttcctaagttaggaaaagaaatagaaaagatgcctcagcttcaccaaaagtacccatttcccacatggaaaattatatttaagtgcttagtaaattccttttcacttatttttggagtaaaaggattgataattctaaaatttatagttaaattagcttgtttctcaaactgtaagttttacaaaagtactttcattgctgtgccttctttcaagttacataatcacataaccac

SEQ ID NO: 172134 - DNA, 601 bp, Human
aatataatttgattttctgtaacacaaaagataaatgcttgactggatggataccccattctccatggtgtgattattatgtattgcatgtctgtaacaaaacatctcatgtacctcataaatatattcatttcctatgtacacacaaaaattaaaaacaaaaaattttcaaaaggtgacacagtggaggcttgtagagccaaattacaatattgctgctgaaacatttcttttgatgtcattgatctattcatggggaagctgtcttttcccccgaagcatcattttgaaaatacctagwtttattaatgtatttaacaaacatatagtcacataacaagtgctgttcttggttctttacatatttaagccatttaatcctcacaacaattctgtgaagtgggtactgttattatttccattttactgatgaggaaacagtgcagaggagttaagtcacttacggttttataggaagttagtggaagagctgagatttgaacccatgtatctgattcaagtcagtgctctaaaccgctctgctatgttggttctctatttgaaaatattaataatcttggccaggcacagtggctcacac

SEQ ID NO: 172135 - DNA, 601 bp, Human
acatgcagttgaatgtaaagtgcttgagcttgtttagaaatagatttaaattaggctgggcgcggtggctcatgcctgtaattccagcactttgggaagccaaggcaggtggatcacctgaggtcgggagtttgagaccagcctggccaacatggtgaaaccccgtgtcattagctgcgtgtggtggtgggcacctgtaatcccagctacttgggaggctgaggcaggagaattgcttgaacccaggaagcggaggttgtagtgagtcgagatcacaccattgcattccatcctgggtgaagagtgaaactccatctcaaaaaaaaaaaagatttaaattagaaaaatattatcagatttttttctaaaataaaaaaggaaagaaagatttgaggtcttcaaggcagtaattacttctatagctagaaaaagaaattaggacacaagtctctactctgctgaaaaatacaatagaacttctgggagtctctgaatctcttattaacatgtattatagaagtgcgcaggtttatatattagtaatcagtgagagctgattactactcccagacctgccccatttacctgcctactcatgact

SEQ ID NO: 172136 - DNA, 601 bp, Human
tatttttagtagagaagtggtttctccatgttggtcaggctggtctggaactcccaacctcaggtgatccgcccgccttggcctcccaaagtgctgggattacaggcatgagccaccttgcctagccaagattaagatttcttatgagaaagcatagatgactaaatagcttgaggtaatggagtcttatgacatcaggacttctcacttcaagccaattacttttccgtagatatcattttttctctttttcttttttttttgagatggagtctcactctttcgccaggttggagtgcartggcgtaatctcggctcactgctacctccacctcctgggttcaagtgattctcctgcctcagcctcctgagagctgggacttcaggcgcccgccaccacgtccagctaattttgtttgtttttttttttttttttggagacgaagttgctcttttgcccaggctggagtgcagtggtacagtctcggctcaccacaagctccgcctcctgggttcacgccattctcctgcctcagcctcccgagtagctgggactacaggcttccaccaccaggcccggctaatttttgcatttttagta

SEQ ID NO: 172137 - DNA, 601 bp, Human
ttatcgctgactaatcagtgttttgatattgaagaagaagtatcaaaatatcaagaatatactaatgaggtaggtacagctgtcaaggaaaaattaaaattcttctcagtttataactgatagtgattgacaagggagaaatgggatagaatgtgcctacattcagttccacccaccaatttttaatatgtattttgagccaagttttaagaatgtagatgttttacaactaaaaacagctgataaaccatccttttatcaactgtatgaaaagtttctttcttaaaagggtgttgatttragtattgtatcatcgatagttttgaaatcaaaatttaaagtttttttaaaggacttattaaaagctgtaacacttgatgtcagatctgtagtaagtacttttgttctgtgattaatgtggggtttttttctttttttttttttttttgatgtttcagttacaagaaactctgcctcagaaaatgtttacagcttccagtggaatcaaacataccatgaccccaatttatccaagttctaacacattagtagaaatgactcttgggtaagaaactcatcatttggaaactgtagtgtttcc

SEQ ID NO: 172138 - DNA, 601 bp, Human
tgactaatcagtgttttgatattgaagaagaagtatcaaaatatcaagaatatactaatgaggtaggtacagctgtcaaggaaaaattaaaattcttctcagtttataactgatagtgattgacaagggagaaatgggatagaatgtgcctacattcagttccacccaccaatttttaatatgtattttgagccaagttttaagaatgtagatgttttacaactaaaaacagctgataaaccatccttttatcaactgtatgaaaagtttctttcttaaaagggtgttgatttaagtattrtatcatcgatagttttgaaatcaaaatttaaagtttttttaaaggacttattaaaagctgtaacacttgatgtcagatctgtagtaagtacttttgttctgtgattaatgtggggtttttttctttttttttttttttttgatgtttcagttacaagaaactctgcctcagaaaatgtttacagcttccagtggaatcaaacataccatgaccccaatttatccaagttctaacacattagtagaaatgactcttgggtaagaaactcatcatttggaaactgtagtgtttccatttgct

SEQ ID NO: 172139 - DNA, 601 bp, Human
agaatgtgcctacattcagttccacccaccaatttttaatatgtattttgagccaagttttaagaatgtagatgttttacaactaaaaacagctgataaaccatccttttatcaactgtatgaaaagtttctttcttaaaagggtgttgatttaagtattgtatcatcgatagttttgaaatcaaaatttaaagtttttttaaaggacttattaaaagctgtaacacttgatgtcagatctgtagtaagtacttttgttctgtgattaatgtggggtttttttctttttttttttttttttgatgtttcagttacaagaaactctgcctcagaaaatgtttacagcttccagtggaatcaaacataccatgaccccaatttatccaagttctaacacattagtagaaatgactcttgggtaagaaactcatcatttggaaactgtagtgtttccatttgctttcattgcagtttgtgcttttgctcttacattttgaaattttttatgtttgttgtaatacaatgtttaataaggttatctattgaccagttaaaagaaaataaaacataaacatcattctaaaacatttgcatactgttt

SEQ ID NO: 172140 - DNA, 601 bp, Human
attaactgtgtggtcaagatcctaaaagaaccaacccatgaaattctttcagcagtgagtttagaactattggaggataagttaggatattttatctctccttgggagaactagcatccatttagatagaagataagctgaattttttgtgtgttgttttagaaaaggagaaccaaataaaagagagtttaaatctacattacaacccttgaagaaatgtgaggtaagccttaacaacatttgaataatttaaatggttactattagagaaggcttttttagtaacacaattggagtgccrgggccaatgtgaatagagaaatgtgtgagcctaataattttctatttccttaagaatgggaaattcgagtcataataatcaatgatatgtaatatgatacaagacacattagcaaggtagcagaattaccatatatgacattagatctatttacatgagccaaatcctaacatacctggtctcaacttaaggatcaagctttgaggcgcaatctgaacaatgtcagaactatttttctgtctgcctacactgagaggcttatttttaagtatttctacttgggagacagggttttcgatg

SEQ ID NO: 172141 - DNA, 601 bp, Human
tagcatatgagaatggagtcattgcctatggagtgatttactactgaatttaatagcagtgaaggctgcattggccttctccaagcaataagagaaaccaatatttcccaaagtatgtcagagaaagttgcaaaaattattattttgccagaagtcattgtcatggagaaagactctgggaaagtgaaggttattctcaaataacctcagaaagtggtggccactgaggctagaaagtgtctgagaggctggggctgggcaccatccagtggagcctatggtgaaagtcttggttccctcrcctgcataacacgcattctggtttgccacatcctgccctatactgggaggcaaatgcagaggcctcaaggacccacggctagaaccatgtagttcagatgacctcacctccactctaagcaacctaggcctctgagagaactgctgagatccaaccagacaaggcagaaatgccagggagttagcaagctcctggcaagtgcagctcagagcgggagtatctccacagaaaatcagcgcacaaagatgccaagagaatcatttacttacctgcaagggttggcaatttcttctggtgttg

SEQ ID NO: 172142 - DNA, 601 bp, Human
aatcattgataaatttcctttatggttaaattattttttattatgttagattgtagttgggaagtacactgagatgttttttaaatggtataataaaagctgtttatcttttatagagattgatgcctttggtgtataaaagtattataaattaataaatatttggaacattatttcatatatactagatatatagcagtaatgggcttgcttttgggacaaatcaaatcttggtacagatcatggattagtcatgtggccctgggcaaatagctaatctctcagagcctcttacttcctstgagtatagggctgatgttattaagctagctttaacctgctgtttaacctgctgttattatgaaggctgaatgaggtcatgtatgtaaaaccttccacacgagatctggcacagagcatatggtagctcattttcaataggagaatatttgattctgaacatgtcattcactgcacaggtaagccgtcacaaagcaatctgtcctccaccatcacctgcataatgtgtggttttaatagcttattatagcatatgagaatggagtcattgcctatggagtgatttactactgaatttaat

SEQ ID NO: 172143 - DNA, 601 bp, Human
cagaatagtgtccagaattagactcacacatatatggtcaattgcttgtcaacaaagacattaagataactcaatgtggaaaagaaattcttgtgtaacaaatagtgcttgaacaactagatatctctgtggaaacaaaagatgaacctagaccttccttctcattccaaatacaaaaactaatctgagatcagaagcctaaatgtaagcatgttaagcataaagcttctagaagaaaatataggaagagtctttgtgatctttacagtaagcaaaaatttcttaggacatacaacacacyaaccataaaattaaaaattaataagctggacttcatcaaaattacaaacttttgcttgaccaaaggtatcgccagaaaaattaaaacacaagctataaactgggagagaatatttttgactaaaatatctattttttggcaaaatatatttgacaaaaaacttgtatccagcatatataaagtactcttaccacacaatattggaaagacagtctaatcttaaaaaaatgggcaaaagatttgaaaagaaaccacaaaataagaaataagaatggcaaataaacacaggaaaaggagctc

SEQ ID NO: 172144 - DNA, 601 bp, Human
tcctgatttcaagactttttataaagctctgtaaggggggtagtgaggcattagtggttacatgggtatatgcaatggatcaatgaaacagaatagtgtccagaattagactcacacatatatggtcaattgcttgtcaacaaagacattaagataactcaatgtggaaaagaaattcttgtgtaacaaatagtgcttgaacaactagatatctctgtggaaacaaaagatgaacctagaccttccttctcattccaaatacaaaaactaatctgagatcagaagcctaaatgtaagcatrttaagcataaagcttctagaagaaaatataggaagagtctttgtgatctttacagtaagcaaaaatttcttaggacatacaacacaccaaccataaaattaaaaattaataagctggacttcatcaaaattacaaacttttgcttgaccaaaggtatcgccagaaaaattaaaacacaagctataaactgggagagaatatttttgactaaaatatctattttttggcaaaatatatttgacaaaaaacttgtatccagcatatataaagtactcttaccacacaatattggaaagacag

SEQ ID NO: 172145 - DNA, 601 bp, Human
gtccctagaaataaataaaacaaaacatgtgcaagatatctaccctgaaaatgacaaaacattgctctgagaaattaaacaagatatgaataaatgaagatatatgtcatgtaaaatgattggaaaattcaatatgtgtaagatgttcaatatccccacaaattgatctatggtttcaatgttgtctcaataaaaatctcagcatattttttgaagaaattgacaagttgattctaaaatttatatggaaatgcaaaggatctaggataaacaaaatgaaagaacaaagttggaggatttmtgctcctgatttcaagactttttataaagctctgtaaggggggtagtgaggcattagtggttacatgggtatatgcaatggatcaatgaaacagaatagtgtccagaattagactcacacatatatggtcaattgcttgtcaacaaagacattaagataactcaatgtggaaaagaaattcttgtgtaacaaatagtgcttgaacaactagatatctctgtggaaacaaaagatgaacctagaccttccttctcattccaaatacaaaaactaatctgagatcagaagcctaaatgtaag

SEQ ID NO: 172146 - DNA, 601 bp, Human
tggggccaaaagcattagcaatacttttatgttagatagttaagaggttgttagcaccaagcttatttcccttcacaagtgaatcaagcaattaataacaataatcataccttactttttattatacagaatttttgagggtataagtctttataactctttatagaaatctatgtattcagtgtcacaggaactactcgcagatgccaccttgtatccatctttctttcttccctaataacagaatgctgattttggaggggcagctagcaatgtgcttcctttgtagttaactgtggtyatgtaactaagtgccagccaatgagatgcaagtctaaggtgatgagtatttctgtcaaaacctcttaagttggggcaataaaatttaacaaccatttataatttttttaaaaaaacttaccaagcaaggaatagaagatcatttctttgatctgatggaaggaaatgaaaaaccactagctaacaacatacttaatggtaaaacactgatcctttctccctaagatcatgaacatgactagattgtcctcacctactacatcaacttaaaagggtactggagacccaagtcggtgcaata

SEQ ID NO: 172147 - DNA, 601 bp, Human
cttccaaatatactcatgcctggcacattgcttggtacatagttggaactcagtaaatttttgttgaacaaatgaatgaataaataaatgcatgaataaagtacagtcaagaggtaaataaagagccaaactgctttcatttacttgaagcccgattaaggacagggtctcattgttagttcaagatgctgggatactagtttagctgagccatgcaaccttgttaattttagttattttctctggtaacattccacactcattggttcccatggttattattgtactacatgttgctacrtcgtacctgatctgtgacatgaggaatgattttaaatataccctctggggcagaggtggcactttggagttctagttggaattgccctactaatctctctatggaagcttattgtaggggaaacacacaatataccaaagaactaaatacaaattttattcaggtataatattctctgattttaaaaatggggccaaaagcattagcaatacttttatgttagatagttaagaggttgttagcaccaagcttatttcccttcacaagtgaatcaagcaattaataacaataatcatacct

SEQ ID NO: 172148 - DNA, 601 bp, Human
tacaggcatgtgcccccatgcctggctaatttttttgtatttttagtagagacagggttttaccacattggccaggctggtctcaaactcctgaactcatgattcacccacctaagcctcccaaaacgctgggattgcaggcgtgagccatcacacctggccaactcatcaattcttagctagaggcatcacgctaccggacttcaaactatactacaaggctacagtaaccaaaacagcatggtactggtaccaaaacagagatatagaccaatggaacagaacagagccctcagaaatratgccacatatctacaactatctgatctttgacaaacctgacaaaaataagaaatggggaaaggattccctatttaataaatggtgctgggaaaactggctagccatatgtaaaaagctgaaactggatcccttccttacaccttatacaaaaattaattcaagatggattaaagacttacatgttagacctaaaaccataaaaactctagaagaaaacctaggcaataccattcaggacataggcatgggcaaggacttcatgactaaaacaccaaaagcaatggcaacaaaagccaaa

SEQ ID NO: 172149 - DNA, 601 bp, Human
ttctcacaattactctaggaggtcaatattattattcccgtttataggtaatgagactgagctcaaagagagtaatggtttatccaaagttatgattgtaacccaggtctgaaaaatcctacgctctttccttttacctctaattgccttcctactaagaacattttattctacaattataaggtttggtttgatcagaggattgactttttatcttgacatgtatatgtatgtatgtgtgtacaagggtatactatctggacagagaaactaagagagttagggctataatggaaatggraaacatataatcttgccacaaaaaagaacttgctatttaccaccttaatggtaaattttgcccataataataatcttcagaaaataggacatattgaaccttttaagagatcaaatagatgattctccttcaggtctccaatttttgcaccccctgcagtgctctggtctccccctaatcacaccctgtttttgttaatagtacctcttatttattgagaacatatcatggtcaggcccaatgccaaatgcttttaatcgttaactcattcaattcttttttttttttttgttagatgta

SEQ ID NO: 172150 - DNA, 601 bp, Human
taatcataaactaaagctcttggggctcttaattttcaagagtctaagggagtcctgagatctaaaagtttgaggaccactagattaaaataactagagattagtaagtgttaatgagagcgagaaaaaattaacatttgttttgaatgtctgttttgttatgagttcatttggttctcacaattactctaggaggtcaatattattattcccgtttataggtaatgagactgagctcaaagagagtaatggtttatccaaagttatgattgtaacccaggtctgaaaaatcctacgctcyttccttttacctctaattgccttcctactaagaacattttattctacaattataaggtttggtttgatcagaggattgactttttatcttgacatgtatatgtatgtatgtgtgtacaagggtatactatctggacagagaaactaagagagttagggctataatggaaatgggaaacatataatcttgccacaaaaaagaacttgctatttaccaccttaatggtaaattttgcccataataataatcttcagaaaataggacatattgaaccttttaagagatcaaatagatgattct

SEQ ID NO: 172151 - DNA, 601 bp, Human
attttaacaacatgaaacattcactgatgtttcagattcctcattgaaactactttcacctgttatctagttttacctgttatctactatcacctgttatctagtttgaaggtaatatcaaagaagaatgtccacagtcattgaaaaaagctattatatgcttcttcctttccaactatatgtttacatgaggtttgactttcttcatggaattcaatttttgaaaaaggcaaaagattaaatgcaggagcagatagagaatccagttgtcttccattaaaccagatgcttaaagagattkccgaatatgtaaaacagtgccactccattttagagcagaaggcctgttaatttttgttttgtttcagaaaatacagttatttttcataaaaacatattacagtaatatgcagtgggtttattattatagttattaaataaatcagtagataattattttaaaatgtttctgttttactttctagtatgatgattatgggtatatataaccataatcataaactaaagctcttggggctcttaattttcaagagtctaagggagtcctgagatctaaaagtttgaggaccactagattaaa

SEQ ID NO: 172152 - DNA, 601 bp, Human
aacaaactcctctaaactaaaggagcatgttctaacccaatgcaaggaagctaagaaccttgaaaaaaggttagaggaattgctaaccagaacaaccagtctagagaagaacataaatgacctgatggagctgagaaacacagcacgagaacttcatgaagcatacacaagcatcaatatctgaatcaatcaaggggaagaaaggatatcagagattgaagatcaacttaatgaaataaagcatgaagacaagattagagaaaaagaatgaaaaggaacaatcaaagcctccaagaaataygggactatgtgaaaagaccaaacctatgtttgattggtgtacctgaaagtgatggggagaatggatccaagttggagaacactcttcaggatattatccaggagaacttccccaacacagcaaggcagggcaacattcaaattcaggaaatacagagaaaaccacaaagatactccccaagaagagcaactccaagacatataatcatcagattcaccaaggttgaaatgaaggaaaaatgttaagggcaaccagagagaaaggttgggttacccacgaagagaagcccatcagactaac

SEQ ID NO: 172153 - DNA, 601 bp, Human
ctatatcaccagggccctgggtctcaagcacaaaactgggtggctgtttgggcagacagcgagctagctgccggagttttttttcataccccagtggcgcttggaattccagcgagacagaaccgttcactcccctgaaaagggggctgaagccagggagccaagtggtctagctcagcagatcccactctcatggagcccagcaagctaagatccactggcttgaaattctcgctgccagcacagcagtctgaagtcgacctgggacactggagcttggtagggggaggggcatctgccrttactgagggttgagtaggcaatttcccctcacagtgtaaacaaagccaccaggaagttcgaattcggcagagctcaccgcagctcggcaaagcctctgtagccagactgcctctctagattcctcctctctgggcaggaaatctttgaaagaaaggcagtagccccagtcaggggcttttagatgaaactcccatctccctgggacagagcacctggggaaaggggcgactgtgggcacagcttcagcagacttaaacgtccctgcctgccagctctgaacagagcagtgaatctccca

SEQ ID NO: 172154 - DNA, 601 bp, Human
agggaagctgtgagggactgtgccatgaggaatggtgcattccagcccagatacttcgcttttcccattgtcttcacaacccccagaccaggagattccctcgggtgcctatatcaccagggccctgggtctcaagcacaaaactgggtggctgtttgggcagacagcgagctagctgccggagttttttttcataccccagtggcgcttggaattccagcgagacagaaccgttcactcccctgaaaagggggctgaagccagggagccaagtggtctagctcagcagatcccactctcrtggagcccagcaagctaagatccactggcttgaaattctcgctgccagcacagcagtctgaagtcgacctgggacactggagcttggtagggggaggggcatctgccattactgagggttgagtaggcaatttcccctcacagtgtaaacaaagccaccaggaagttcgaattcggcagagctcaccgcagctcggcaaagcctctgtagccagactgcctctctagattcctcctctctgggcaggaaatctttgaaagaaaggcagtagccccagtcaggggcttttagatgaaactc

SEQ ID NO: 172155 - DNA, 601 bp, Human
aaattgtgtgtgatgggggtttggtgtggtttttgaagggtggtgcacagacccatgagggtccctgagaccttgcaggaggtccttcacgttaaactattttcacagtaattcagagatgtcatttgccttcttcactgtgttgacatttgcactgatgatatgaaagcagtagtgagaaggctggtaagatgatcaaataggaacagctccagtatgcagctcccagtgagatcaacgcagaaggcaggtgatttctgcatttccaactgaggtacccagctcatctcactgggactgrttagacaatgggtgcagcctacaaagggtgagccgaagcagggtggggcgtcacctcaccatggaagcgcaagtggtcaggaactccctcccctagccaagggaagctgtgagggactgtgccatgaggaatggtgcattccagcccagatacttcgcttttcccattgtcttcacaacccccagaccaggagattccctcgggtgcctatatcaccagggccctgggtctcaagcacaaaactgggtggctgtttgggcagacagcgagctagctgccggagttttttttcatacccca

SEQ ID NO: 172156 - DNA, 601 bp, Human
aaaacaaacaaaaaaaacaaccttcagaatgttgctgtatcttagacaacagcaaaagaaattcttttcaaaaatgtaaaccacttcagcatttttaacagggtgaaataaatttttagtgtctctccatccactgaaaataaatgagctactccagaaaacataaagattagattaaagaggtggattttctttctttttatagagccttggacactctctatgttgcccaggctggactcaaactccagggcttaagcaatcctccagctctgggactacaggcatgtgccactgcacstggaaaaagggtggcttttatttttatttgtatttaacttttattttatgtttagaggtacctgtgtgggtttgttatataggtaaattgtgtgtgatgggggtttggtgtggtttttgaagggtggtgcacagacccatgagggtccctgagaccttgcaggaggtccttcacgttaaactattttcacagtaattcagagatgtcatttgccttcttcactgtgttgacatttgcactgatgatatgaaagcagtagtgagaaggctggtaagatgatcaaataggaacagctccagt

SEQ ID NO: 172157 - DNA, 601 bp, Human
tatgctgggggtaggctcactggcgtgcattgtactaagccttctggatgcatgctaaagttttagaatcactggtgtagaagcgcaaagagacaaaaaggcatagcgcctggtgagggaatgatgtgctgcctggggatgaactggttgattcttaatatgggcacatgtggggcctgggccttggctctacaggtccagtagcttactttgtcagcacgagaaggtgcatttttcaatgttaggcttcagttcatcaagttcatctgcctgaggtatacagttgatcttcattattcamagattctatatttgtgaattcacctagttgctaagatttatttgttactccctaattaatacttgccgtgttttctgagtcattcgtggacatgtgtagacaggcaaaacaaaacaacaaaacaaaaaaacccaaaacaaagcatctccctatatgcacattcccaactggaatcaaacacggtggtgctctgccttcttatttcaggcctccaactctaagccagtgtctttttcacggtctacatagtaccacctttctttcatttttatgcttttcatggatggtttcactgtttaa

SEQ ID NO: 172158 - DNA, 601 bp, Human
ggatggcctgattcaaggactatcattcactgcaaatcctatgtggctactgttctggtctgggtccctcctttctgaggctgtggctgagaatagaatgagctgcctgtattgctttaccagcaccaggatttttgagaagttggggaggttctgggatcatgggattcatagcagatctaacttcccacatgtcccaccgtccacctatgctctggtgggaacctctgaggatggtgagaatcgagctggggcaacttgttaatcccacattagaaaatgtgcactgctttcaccaagygtatgttatttcacatgtattacactagttgttgcttcgttctcctacttatagccctgaaaacagtacagagtgcaggttacacaccaagacagttgacatggagtattcattcttgctgtccaagtgacagagcccgtcattaggaatgacgatgcctgctagtttgctgtccattccaaaatgagaatcagcatcactcacaaagaccaggaggtggagggagtcattccgccagccaattttttcctacagtgagaaagaaacatttgtgtgatattggagggaggcaggcattta

SEQ ID NO: 172159 - DNA, 601 bp, Human
cgcccggctaaatttttgtattttttagtagagatggggtttcactgtgttagccaggatggtctccatctcctgacctcgtgatccaccgcctcggcctcccaaaatgctgggattataggcgtgagccaacgtgcccggcctctatttcatacattagttggcacccactgtgttataggcaccgtgctatcaggaaacagagataataaaccaggtctggacctgaggattgtgcaagaaagacagacagatgtaagaaaacatatttctacatagagatgcacaagaacacatctgygtatgcaactgaagggaaagacaattgcttcagagcctggcagaggtcaaagaaggctctctgggggcagtaatgactgaactggcttttcaaggataatgaagagtttctcagcaggctaggaaggaaggatattccaggcagagggaataacatgtgcacaagcatagcagcctcatggtctgttcaggaaaagcagctggatacataggggtctattgaggagatcatgcatgtccaaagagctctgaaattttttcctggttttacaagagttagctgttttctttgaatgtcact

SEQ ID NO: 172160 - DNA, 601 bp, Human
ccaggctagagtgcagtggtgcgatcttggctcactgcaagctgcgcctcctgggttcacaccattctcctgcctcagcctcccgagtagttgggactacaggcgcccaccaccacgcccggctaaatttttgtattttttagtagagatggggtttcactgtgttagccaggatggtctccatctcctgacctcgtgatccaccgcctcggcctcccaaaatgctgggattataggcgtgagccaacgtgcccggcctctatttcatacattagttggcacccactgtgttataggcacygtgctatcaggaaacagagataataaaccaggtctggacctgaggattgtgcaagaaagacagacagatgtaagaaaacatatttctacatagagatgcacaagaacacatctgtgtatgcaactgaagggaaagacaattgcttcagagcctggcagaggtcaaagaaggctctctgggggcagtaatgactgaactggcttttcaaggataatgaagagtttctcagcaggctaggaaggaaggatattccaggcagagggaataacatgtgcacaagcatagcagcctcatggtctg

SEQ ID NO: 172161 - DNA, 601 bp, Human
tttccagtttcttgcccctcactgactaaaagacaacatgcggctatcctcactgatattgtaatatgaaaaggcagagtatgtgattaaagaatatacacatttggggaatactactgatcaaatgtttggggaaaacattcatgtcgaaatttagaaatttaggtcaaggaatagtagtgagtaatgaactgttaagagtttttagagaatagttttccaattgacattagaattctaggttcccgtctccctctttctctccccctgcacccccacctacaccaccacagcattgttytaagaagtcacttaaattctctgtaccatatttccccaagtgttaaatggggaaaatatgacaatctcagactgctgcttcagaaatcaaatctatttttttttttttttttttttttggagacggagtctcgctctgtcgcccaggctagagtgcagtggtgcgatcttggctcactgcaagctgcgcctcctgggttcacaccattctcctgcctcagcctcccgagtagttgggactacaggcgcccaccaccacgcccggctaaatttttgtattttttagtagagatggggtttc

SEQ ID NO: 172162 - DNA, 601 bp, Human
aaaaggggataaattttccagtttcttgcccctcactgactaaaagacaacatgcggctatcctcactgatattgtaatatgaaaaggcagagtatgtgattaaagaatatacacatttggggaatactactgatcaaatgtttggggaaaacattcatgtcgaaatttagaaatttaggtcaaggaatagtagtgagtaatgaactgttaagagtttttagagaatagttttccaattgacattagaattctaggttcccgtctccctctttctctccccctgcacccccacctacaccwccacagcattgttctaagaagtcacttaaattctctgtaccatatttccccaagtgttaaatggggaaaatatgacaatctcagactgctgcttcagaaatcaaatctatttttttttttttttttttttttggagacggagtctcgctctgtcgcccaggctagagtgcagtggtgcgatcttggctcactgcaagctgcgcctcctgggttcacaccattctcctgcctcagcctcccgagtagttgggactacaggcgcccaccaccacgcccggctaaatttttgtattttttagt

SEQ ID NO: 172163 - DNA, 601 bp, Human
atgtagttatttttcatctgcctctgtctttttaatagcggttttggggagacgtataaatgagttgtgagtcttaaagactattaccaaagtgagttatggtagtctatgttcacgatcatcaatcgcattccccagactcccctttgaagaaaagttctgtgcaactcctcctcccacttctaaactggagccttgctgtggagaaggtgttgtgacccccagggtcctctcacactagccttaaggatcaaaggcagaatagactcactattgtatttgggggtatttaaaaaaagtytcaactgcaactctactacttaaaaccactggaaacaaatatcacatactaaaaagcctgaagaaaatgcccatatcaggtgaacccacatgggctctgcgtagaacacaggtttcaagtatggagcttgattgcaaggaacttccttggtttgcagcagaaggcaatctcacctgggagtacaataccctcctctcattcaaaatgcaagatagcatctcctgctggatcctttctacagaacctgatgcaagttcatggggctgtaccgtccttagtagtgagtggcatttaatcaaa

SEQ ID NO: 172164 - DNA, 601 bp, Human
gccatgtagttatttttcatctgcctctgtctttttaatagcggttttggggagacgtataaatgagttgtgagtcttaaagactattaccaaagtgagttatggtagtctatgttcacgatcatcaatcgcattccccagactcccctttgaagaaaagttctgtgcaactcctcctcccacttctaaactggagccttgctgtggagaaggtgttgtgacccccagggtcctctcacactagccttaaggatcaaaggcagaatagactcactattgtatttgggggtatttaaaaaaagtttcaactgcaactctactacttaaaaccactggaaacaaatatcacatactaaaaagcctgaagaaaatgcccatatcaggtgaacccacatgggctctgcgtagaacacaggtttcaagtatggagcttgattgcaaggaacttccttggtttgcagcagaaggcaatctcacctgggagtacaataccctcctctcattcaaaatgcaagatagcatctcctgctggatcctttctacagaacctgatgcaagttcatggggctgtaccgtccttagtagtgagtggcatttaatc

SEQ ID NO: 172165 - DNA, 601 bp, Human
ttccctattacactattattatcatagtcatagttgcatatcatcaccagccctcacccctataaagtgaagggcttggtccaacaccatgatattgttagcatcaaaagcagttttatgattgccgattaatttgctgctccttataggaaagatagtgaatagaaaagagtaaaaacattgacagacatgaaaactctgacccctcagctggagtctctttccagaacacaactctaaaatgccctcattctgtttttataggcaaaatattagtttacaagtctgctgatgctctctsagacttcttaaggcaggcactacgtcttattcttctctatagtcacaaactttggcatagttcacaggaggtactcatgatatgtttgagaaatgaaggaatgaatgactatgcagtctatagcgtcttagtttcaatgatatgctagatatcctgtgcgttgtaaatctgtaaatctcaaagcatttagatctcgcattattgaaatcccattttaggctgggcacagtggctcacacctgtaatcccagcactttgggaggccaaggtgggcagttcacatgaggccaggagtttgag

SEQ ID NO: 172166 - DNA, 601 bp, Human
gaaaggacaagtttgcttttattttaaagtagacacctataagtatggcaactataggctcagaattttgtaggatgatcttgatttcatatagttactctcatcaataaaaattttgatgtataactacatgcaatttaatttgtatgcctttataagattatacatgtataaacattcaaaaagtttgaacatacttaattgtacgattaaggcatgacgtcgactcactgcaacctccgcctcccaggttcaagagattctcctgcctcagcctcccaagtagctgggactacaggcrcatgccaccacacttggctgatttttgtatttttagtagagacgggatttcaccatgttggccaggctgttctcgaactcctgacctcgagtgaaccacccacctctgccttccaaagtgctgggatcacaggcatgaaccaccatgcccggccagaaaaacttattctaaaatgtcaacaatgttagctatgtctgagtggtgagtttatgagtgatctttgttttcttctttgggttttctgtattcctcctcacttttctttttgcaaatagtatatattagttttataatcagaaa

SEQ ID NO: 172167 - DNA, 601 bp, Human
tcccacgggccatatttggcctgttgcttgtttttgtaaataactatgctcatttatttatgtattgtccatggccgctttcatgctacaatgagagttgaataatcatgacagaaaccatgtggccacaatgcctaacttactatttgaccctttgtagataggcggccagataaaatacagaatgctcagataaattggaaagcagagaaacaatgaaaaatttttagtgtacatgtggtccaaatattgcatgggacatatttatactaataattatttgttgcttacttgacattcraatttaactggatctcctggatttttatgtgctgaatctgaaaactctatagaaaaaagtgtgccaacccttgaatttataaataattacctcaactgttcaagctcaacaaataatgattccaaaattttctgtttattttctgaagattcaataatgccaagacaacaaaatgttaaactatgttatcattaatactagtcccttggtaggatatttggggcttttctggataatcagacataaaatgaaaatagaaaatactcttaaactcttcttatgtcccgggggttgtcagtt

SEQ ID NO: 172168 - DNA, 601 bp, Human
tatactcctagggcctagtccagtgcttgacacacggaaaacacataaatatttgtagaatgaatgaacgaaggcagggattggctatgtcccacgggccatatttggcctgttgcttgtttttgtaaataactatgctcatttatttatgtattgtccatggccgctttcatgctacaatgagagttgaataatcatgacagaaaccatgtggccacaatgcctaacttactatttgaccctttgtagataggcggccagataaaatacagaatgctcagataaattggaaagcagagamacaatgaaaaatttttagtgtacatgtggtccaaatattgcatgggacatatttatactaataattatttgttgcttacttgacattcaaatttaactggatctcctggatttttatgtgctgaatctgaaaactctatagaaaaaagtgtgccaacccttgaatttataaataattacctcaactgttcaagctcaacaaataatgattccaaaattttctgtttattttctgaagattcaataatgccaagacaacaaaatgttaaactatgttatcattaatactagtcccttggta

SEQ ID NO: 172169 - DNA, 601 bp, Human
gcctttgcctcttgaaaactcctcagccttcagctcgcttcctcattatcacttctggaaaggcaccttccatgaaaattctatccaaggaaagtctcactttctcccccttaattatggtccatggctgcacactattcttttccatttcttcgataacactattaaaagttgtaattggttgttttttcattaattgtttctcgtctatttccccctactagattacaagtccatgaggacaaaacagtgtctttttttattctcctctatactcctagggcctagtccagtgcttgayacacggaaaacacataaatatttgtagaatgaatgaacgaaggcagggattggctatgtcccacgggccatatttggcctgttgcttgtttttgtaaataactatgctcatttatttatgtattgtccatggccgctttcatgctacaatgagagttgaataatcatgacagaaaccatgtggccacaatgcctaacttactatttgaccctttgtagataggcggccagataaaatacagaatgctcagataaattggaaagcagagaaacaatgaaaaatttttagtgtacatgtggt

SEQ ID NO: 172170 - DNA, 601 bp, Human
tgaatgacagtctgcattttaagaggtccctgtcccccaggttgattggatacaccagttaaaaaagaaaataaaaagaaaaaaaccactggtgtctgggtctcagccccagagatactaactcaattggatcagggtgtagcctacacattgggtttgttagtaaagctccctacctgattctaatgagcacctaagtttgagaactgctggtgtagaacagtctatcagagggcttgtagtgatttggaaaataaaggcattaggtttttaaatctatatacccacagtttatccaggrttttcagcctgtcatatacctgtgacatctatacccagcaacaaaagtatttttggatgcctgctacccatagaatagcaccctgcttacttcccactgccttcaagattgaagggtctggtttctgcctacctctcccgctccatctccttctacccctactcactccaggccaactggccttttttccttttctcaagcacactgggaactgagtcctttgctgcctcagggcctttgcacacgcctttgcctcttgaaaactcctcagccttcagctcgcttcctcattatcacttc

SEQ ID NO: 172171 - DNA, 601 bp, Human
tagttttaactggacaggtaagtaccttgcccagtcacagatgtaatacatggtagaaataggtgttgactgtatagccacggttcactcttctccaccaggcctctgccagagaaactagtgcaaatgccagcagcaagtgagggtgggaatcttattagaaatttaagataataatgctgtatatatacacatgcctatgtctatatatgaacttacagattatagaacacttattataaggatttagagattatagagcacttttctacccagagcaaaaagaaaaggagaaaaagcrttgtggctgtaatgactttcaaactcaaaggctacattttgaaagaaatgtaggaagtagcaaaagcacagaggcaaaaaaaaaaaaaaaaaaaaaatcctaggggaatgtattgtgctatttatctggtcaaagaaaaacagctctttgctggcaaaacctcgcttttatggagccatgtgcttcttccagagctaggggcggactgggtttgctgaaatgagtccttcttcagaaggctttcttcccgtgaggtctttcattcttgtggggttttattctgctggttctcacgttcat

SEQ ID NO: 172172 - DNA, 601 bp, Human
aaaggattagaaatcatgctgctataaagacacatgcacatgtatgtttattgtggcactattcacaatagcaaagacttggacccaagccaaatgtccatcaatgatagactggattaagaaaatgtggcacatatacaccatggaatactatgcagccataaaaaaggatgagttcatgtcctttttagggacatggatgaagctggaacccatcattctcagcaaactatcacaaggacagaaaaccaaacactgaatgttatcactcataggtgggaattgaacaatgagaactctyggacccaggaaggggaacatcacacagcagggcctgttatggggtggggggctgggggagggatagcattaggagaaatacctaatgtaaatgatgagttgatgggtgcagcacaccaacatggcacatgtatacctatgtatcaaacctgcactttgtgcttatgtaccctagaacttaaagtataaaaagaaagagttgaacacttatgtccacacaaaaacgtgtacatagatgtttatacctgctttattcataattggcaaaagccagaagcaaccaagatgtcctttagtaggt

SEQ ID NO: 172173 - DNA, 601 bp, Human
caccacagctcaacagggcctgctgcctctagactccaccactgtaggcagggcatagctgaacaaaaggcagcagacaacttctgcagacttaaacgtccctgtctgacagctctgaagagagcagtggttctctcagcactgcgtttgagctctgagaacagacagactgcctcctcaagtgggtccctgatccccatgtagcctaactgggagacacctcccagtaggggccgacagacacctcatataggtggctgcccctctgggacagagcttccagaagaaggatgagacagcratatttgctgttctgcagcctctgctggtgatacccagacaaacagggtctggagtggaactccagcaaactccaacacacctgcagctgagggacatgactgttagaaggaaaactaacaaacagaaaggaatagcatcaacataacaaaaaggacatctacaccaaaaccccatctgtaggacaccaacatcaaagaccaaaggtagattaaatcacaaagatggggagaaaccagagcataaaagctgaaaattctaaaaatcagagtgcctcttctcctccaaagaattgcagctc

SEQ ID NO: 172174 - DNA, 601 bp, Human
gagagcccagaaatagacctacataaatatagtcaattgatccttgacaaaggagcaaaggcaacacaatggagcaagggtagtcttttcaacaaacggtgcttgaacaactggacattcacatgaaaaaaaaatctagacacattattacacccttcacaaacattagctcaaaatgatcacagacctaaatgtaaaatgcaaaaccataaaactccaaaaagataatggtagaaaaatctagattatcttgagtatgttgatgactttttagatataacaccaaaggcacaatccatgraagaaaaaattggtaagctggacttaaaattaaaatcttctactctgtgaaagatgatgtcaaaagaacaagaaaacaagtcatggactggaagaaaatatttgcaaaatacacatctactacaagactattaccaaaatatacaaagaactcttaacaagaaaacaaacatttcaattaaaaaatgatccaaagaccctaacagacatattaccaaagaagatacagagatggcaaataggcatatgaaaagatgctccacattaaatgtcagcaggtaaaggcaaattaaacaacaat

SEQ ID NO: 172175 - DNA, 601 bp, Human
aataaataagacttaaaattaataatttcatttatagatttaatgcaatgccaatcaaaatgccatcaaattattttgtggatatgaacaaactgattctaaagtttctatggaaaggcaaatgatccagaatagccaactcaacactgaagatgaacaaagttggaggattgacactatctgacttcagacttactataaagctgaagcaatccaaagagtgtggtattgacaaaagaatagtcagacaaatgtaacagaatagagagcccagaaatagacctacataaatatagtcaaytgatccttgacaaaggagcaaaggcaacacaatggagcaagggtagtcttttcaacaaacggtgcttgaacaactggacattcacatgaaaaaaaaatctagacacattattacacccttcacaaacattagctcaaaatgatcacagacctaaatgtaaaatgcaaaaccataaaactccaaaaagataatggtagaaaaatctagattatcttgagtatgttgatgactttttagatataacaccaaaggcacaatccatgaaagaaaaaattggtaagctggacttaaaattaaaat

SEQ ID NO: 172176 - DNA, 601 bp, Human
cctgatcatagcacactgtagctcaaactcctaggctgaagcaacactctcacctcagccttccaaagtgttgggattacaggtgtgagccactgagcctggtaaaatctgaactcttaacagtgtgagatgctgctctgccttgacactgttttattattgagggggctgtgggcagtaatccaggtaacagtccttaccttactttgtgtcccacattgctgcctgatgatggaggacccccttttgtttccctgagtcaggggaaacttgtaaaatacaaggaaggcactggtttacrgacttaccttttcaaataaacatatgtcacaaagggctgtgaagcatgtgacatgtggttaacagcgaatacctacacaggaacttgaattccacttaagtgaagctggaacgtgtgtaaatttgactgatcccagaagagacggcagagggaacctttcgcgcttgacaaagaaaagttttggtctcttaggaaaaggatttcaaggctcttagctttttatgaaactgctatccttgaaaaacatcctgagaaccccaggactgaggtgtcacagatatattctgcaagcactagttc

SEQ ID NO: 172177 - DNA, 601 bp, Human
atctaattatttttgttgttgttgttaatttttatttttagagacaaggtctcactctgttgcccaggctggagtgcagtggcctgatcatagcacactgtagctcaaactcctaggctgaagcaacactctcacctcagccttccaaagtgttgggattacaggtgtgagccactgagcctggtaaaatctgaactcttaacagtgtgagatgctgctctgccttgacactgttttattattgagggggctgtgggcagtaatccaggtaacagtccttaccttactttgtgtcccacaytgctgcctgatgatggaggacccccttttgtttccctgagtcaggggaaacttgtaaaatacaaggaaggcactggtttacggacttaccttttcaaataaacatatgtcacaaagggctgtgaagcatgtgacatgtggttaacagcgaatacctacacaggaacttgaattccacttaagtgaagctggaacgtgtgtaaatttgactgatcccagaagagacggcagagggaacctttcgcgcttgacaaagaaaagttttggtctcttaggaaaaggatttcaaggctcttagctt

SEQ ID NO: 172178 - DNA, 601 bp, Human
agaacacagaatgcatgcagggtgccccgggcacttgctagaagtgggtccctgggtgagtccaagctttctacacctgtgtggaaaaatgggttttggttttgatttgagggtttctaatgttcctcttatttcagtggtcacgattgtgttgaagtttgaagtcagtagaaatctaattatttttgttgttgttgttaatttttatttttagagacaaggtctcactctgttgcccaggctggagtgcagtggcctgatcatagcacactgtagctcaaactcctaggctgaagcaacrctctcacctcagccttccaaagtgttgggattacaggtgtgagccactgagcctggtaaaatctgaactcttaacagtgtgagatgctgctctgccttgacactgttttattattgagggggctgtgggcagtaatccaggtaacagtccttaccttactttgtgtcccacattgctgcctgatgatggaggacccccttttgtttccctgagtcaggggaaacttgtaaaatacaaggaaggcactggtttacggacttaccttttcaaataaacatatgtcacaaagggctgtgaagc

SEQ ID NO: 172179 - DNA, 601 bp, Human
ttatcaatattaactacagttttgccaggaatgctggctcacatctgtaatcccagcactttgagaggtcaaggcaggcagatcatttgggctcaggagttcgagaccagcctggccaacatggtgaaaccccgtctctactaaaaatacaaaaagtagcttggtgtggtggcacgcctgtagtcccagctacttggaggctgaggcaggaggatcgcttaagcccaggaggttgaggctgcagtgagctgataggttgccactgcactccagcctgggtgacaaagtgagaccctgtctmaaaaaaaatcataataataaattaaataaactatggttctgtaatcatcaaaggcttttgaaatctccggagaggtcacacccataccaagtgtgctctgactgttacattgttgcttcttatatgtgtttttaaatgatttctaccttctccttggtgagctctaaggtattactcacctactaatttactcatttatctatttactattgcatttgacatctactaagtaggttttctatactgtactatgtcaacaaccactctttctttcagctgtggtcttctgagttgctgtgt

SEQ ID NO: 172180 - DNA, 601 bp, Human
ccctgaagtccttcaaagacgtctgtgagaggataggcctatttttaaaaactttccgtgttgattctgatacgtcgttttagttaaggaatgctggttcagtacatgctaaatgttggcgtatattacagatgggcctttttttttgtaattttaaaacatcaaaaatcaggagaattgttattcacttgttcttacatagttgctgtttacagtaaatagtagagctttactccttactaaaaaatttactttttttcattcctatcctaatttagggcttcttctttctctctctgtrtgtgtatttctttgtaagtaaaggcaaaaaaaaagggggggtgatatttaggaaccaaaattaaaaataattgacaatgggccatccattgttgactaatggagttatgaaatggagacaaagaatgagaacataacaacaccgtaggtatatattctaattttaagggaggaattctgtcctcaggtactaattcccaaagtcaaaagcaaaaatttacacacctactcataaaccagtggaaaatgtccctagttctccaaagtatagaaattaaaaagtggcattccttgtgtactg

SEQ ID NO: 172181 - DNA, 601 bp, Human
catgtatatatacgtaacaaacctgcacattgtgcacatgtaccctaaaacttaaagtataaataaaaaaaaaaagaaaaaaaaaaagaaaaggtcagtcagacacagctgcttggtccagaaaaacctggaaggtaatggagttcatataacaggcacttttgtagagtctgggtgtcaaccagagagaaggcacttgtatctttcatctacgcttagggaaacaataatagacataagttcagttggcagaaatctcaccccaagtgaatgttagagccagaaaacctacaagagaagwttcagttaccctaggtctaaggctgatcagcaaatatttattgagcacctactgtgcccaggaaactggaaggtgcagaggatgccaagccccttgctgatacttgagcagccacagggtaagatggatttcaacatagcctacctccgcagagcagccctttgtgtctcacgcaggagaaattgtcacactggcaataaggcccataaatgtttccatagggagacaagtggcagatacactgcccacagtagcagtcaccccttccgctgcaggagggatgatctggggcctccttgc

SEQ ID NO: 172182 - DNA, 601 bp, Human
agccttaaaaaatgatgagttcatgtcatttgtagggacatggatgaagctggaaaccatcattctcagcaaactatcacaaggacaaaaaaccaaacaccacatgttctcactcataggttggaattgaacaatgagaacacatggacacaggaaggggaacatcacacactggggcctgttgtggggtggggggaagggggagggatagcattaggagatatacctaatgttaaatgatgagttaatgggtgcagcacaccaacatggcacatgtatatatacgtaacaaacctgcacrttgtgcacatgtaccctaaaacttaaagtataaataaaaaaaaaaagaaaaaaaaaaagaaaaggtcagtcagacacagctgcttggtccagaaaaacctggaaggtaatggagttcatataacaggcacttttgtagagtctgggtgtcaaccagagagaaggcacttgtatctttcatctacgcttagggaaacaataatagacataagttcagttggcagaaatctcaccccaagtgaatgttagagccagaaaacctacaagagaagattcagttaccctaggtctaaggctgatc

SEQ ID NO: 172183 - DNA, 601 bp, Human
tccaacaatgatagattggattaagaaaatgtggcacatatacgccatggaatactatgcagccttaaaaaatgatgagttcatgtcatttgtagggacatggatgaagctggaaaccatcattctcagcaaactatcacaaggacaaaaaaccaaacaccacatgttctcactcataggttggaattgaacaatgagaacacatggacacaggaaggggaacatcacacactggggcctgttgtggggtggggggaagggggagggatagcattaggagatatacctaatgttaaatgaygagttaatgggtgcagcacaccaacatggcacatgtatatatacgtaacaaacctgcacattgtgcacatgtaccctaaaacttaaagtataaataaaaaaaaaaagaaaaaaaaaaagaaaaggtcagtcagacacagctgcttggtccagaaaaacctggaaggtaatggagttcatataacaggcacttttgtagagtctgggtgtcaaccagagagaaggcacttgtatctttcatctacgcttagggaaacaataatagacataagttcagttggcagaaatctcaccccaagtg

SEQ ID NO: 172184 - DNA, 601 bp, Human
gagtgaaggccctgaaagcccatttaatatatttttgtgctccttatccttggtagcatgcttatttagcagtctacctagtttttacttttccaaagtcatatacatttaaaaggtcagtcagtggcaaattggataaagagtcaagacccatcagtgtgctgtattcaggaaacccatctcactgcaaagacacacataggctcaaaataaagggatggaggaagatctacaaagcaaacggaaaacaaaaaaaggcaggggttgcaatcctagtctctgataaaacagactttaaacmaacaaagatcaaaagagaaaaggccattacataatggtaaagggatcaattcaacaagaagagctaactatcctaaatttatacgcacccagtacaggagcacctagattcataaagaaagtccttagagacctacaaagagacttagactcccacacaataataatgggagactttaacaccccactgtcaacattagacagatgagacagaaagttagcaaggatatccaggaattgaactcagctctgcaccaagcagacctaatagacatctacagaactctccaccccaaatcaa

SEQ ID NO: 172185 - DNA, 601 bp, Human
gaacattgcgataatagctcttcagaaaagtggcacattgcttagtatattagttacaaactggagatccacacaagttgtgagctgtagcatgtttgatcctctgttgcaaataaaacaacagcagcagcagagtgtctattccaatgccaggcacaatttttgtccctgcactaagcacaatgccaggcacatagtaggtactccatgaccatttgttaaccatttgttataaatgcatttactttcattataccatttgaaagaaaagttactaattatagagcaacatcctttgtgmtgttactaaaaaccaaaatagcttttgagaaacagtaatggttgaaggaaatcggcattggtgaagttttctgagtctagctaaataaatcgtattttctaaatagaatttctgtagcaatcactgtacctgattcaaaagagacgcactgttgtcagaacttcctagctacaatccacagatcaagtcttttttagtttatttctgttcctcatgcatggtaaaaaataaagcgaaagaccatcaagcaaagctctgttgctaaacagagttcagcattttatactgccttagatctct

SEQ ID NO: 172186 - DNA, 601 bp, Human
atccttcctggagcagtagaaaaggaccatcatggcaaaaacacggagctcctctcagaatttagaagccctcctctctcctggccttccagagccactgacctggtttccaaagttgctaattgatatcctcaaacaaccagttatctagagtactggttcatacaataacaacaacaacaacaacaaaactttcatattggtttcatggagggacaagatgataaccaaagatcaagaaaaaattaccatgctatttcagagggatagatctttctggaatgccattgacaataactgtaagtgcataatggcaggaagtgtttctctaatatcatttgcctgatagtttccatctcttagaatcaaaatacaggagactaatggaatttgggcaaggaaaaaatcaatggagctctgtatctttgagtgcttacagatggatgaaagaagctgtatgaaaaagaacattgcgataatagctcttcagaaaagtggcacattgcttagtatattagttacaaactggagatccacacaagttgtgagctgtagcatgtttgatcctctgttgcaaataaaacaacagcagcagcagagt

SEQ ID NO: 172187 - DNA, 601 bp, Human
ttaatatgatttacaaatattattaaatgaaagatgcatttccaaatgctttgagaatgctcaagtatattattgcatgtaggaagtacttggcagaaatttagaaaatccttcctggagcagtagaaaaggaccatcatggcaaaaacacggagctcctctcagaatttagaagccctcctctctcctggccttccagagccactgacctggtttccaaagttgctaattgatatcctcaaacaaccagttatctagagtactggttcatacaataacaacaacaacaacaacaaaactktcatattggtttcatggagggacaagatgataaccaaagatcaagaaaaaattaccatgctatttcagagggatagatctttctggaatgccattgacaataactgtaagtgcataatggcaggaagtgtttctctaatatcatttgcctgatagtttccatctcttagaatcaaaatacaggagactaatggaatttgggcaaggaaaaaatcaatggagctctgtatctttgagtgcttacagatggatgaaagaagctgtatgaaaaagaacattgcgataatagctcttcagaaaa

SEQ ID NO: 172188 - DNA, 601 bp, Human
ctcctaggctacaaacctatacaatatgttactgtgctgggtactggaggcaattgtaacaccacggtgagcatttgtgtatctagacatagaaaaggtacagtaaaaatacagtattataaaattatgggacaactgttgtatatgtactgtgttgttgacaaaatcgtcattatgtggtggatgattatatgtatatacatatatattctctctctatatatattctctatatactctatatatacacatacacacacgtatgtatagatgcttctggacttatgataggattatgtckggataaactcattgtaaaatgtaaaataatggatttatccagacataacattactgtaagtcgagcaacacactaaatttatatgagtttcacaccatcttaaagtgtgtgtttgtgtgcattatttgtctaatgaaagatgagttgaaatttacctggattcatgatattaagatatatttcaactgtgtttcataacctatacaatttataattgacataattaattcaaagaaaagaataattaaatgatttgggccaaagccattaatttcatttttacatgtaaatgatcttcta

SEQ ID NO: 172189 - DNA, 601 bp, Human
attgtataaacaccatagagtatacgtacacaaacttagatggtaaacctgctgcacacctaggttatatggtatagcctattgctcctaggctacaaacctatacaatatgttactgtgctgggtactggaggcaattgtaacaccacggtgagcatttgtgtatctagacatagaaaaggtacagtaaaaatacagtattataaaattatgggacaactgttgtatatgtactgtgttgttgacaaaatcgtcattatgtggtggatgattatatgtatatacatatatattctctctmtatatatattctctatatactctatatatacacatacacacacgtatgtatagatgcttctggacttatgataggattatgtctggataaactcattgtaaaatgtaaaataatggatttatccagacataacattactgtaagtcgagcaacacactaaatttatatgagtttcacaccatcttaaagtgtgtgtttgtgtgcattatttgtctaatgaaagatgagttgaaatttacctggattcatgatattaagatatatttcaactgtgtttcataacctatacaatttataatt

SEQ ID NO: 172190 - DNA, 601 bp, Human
tggcttacttttctatcttgatgactgggctctaaggaaattggagtaggagagtcctgggcttaattctttggtcaaaaatcaccaaacaaagatgatagacacaaagattttgaaattggattctgatttctgcaggtatgtgtgtgcatatatgtatatatatatgtgtgtgtgtatatatatatgtatatgtgtgtatacacacacacacagtcatgtgtcttttaacaatgggaatatgtaccgagaaatgcatcattaggtgatttcatcattgtataaacaccatagagtataygtacacaaacttagatggtaaacctgctgcacacctaggttatatggtatagcctattgctcctaggctacaaacctatacaatatgttactgtgctgggtactggaggcaattgtaacaccacggtgagcatttgtgtatctagacatagaaaaggtacagtaaaaatacagtattataaaattatgggacaactgttgtatatgtactgtgttgttgacaaaatcgtcattatgtggtggatgattatatgtatatacatatatattctctctctatatatattctctatatactcta

SEQ ID NO: 172191 - DNA, 601 bp, Human
taaactttggtctagtaagtggcttacttttctatcttgatgactgggctctaaggaaattggagtaggagagtcctgggcttaattctttggtcaaaaatcaccaaacaaagatgatagacacaaagattttgaaattggattctgatttctgcaggtatgtgtgtgcatatatgtatatatatatgtgtgtgtgtatatatatatgtatatgtgtgtatacacacacacacagtcatgtgtcttttaacaatgggaatatgtaccgagaaatgcatcattaggtgatttcatcattgtrtaaacaccatagagtatacgtacacaaacttagatggtaaacctgctgcacacctaggttatatggtatagcctattgctcctaggctacaaacctatacaatatgttactgtgctgggtactggaggcaattgtaacaccacggtgagcatttgtgtatctagacatagaaaaggtacagtaaaaatacagtattataaaattatgggacaactgttgtatatgtactgtgttgttgacaaaatcgtcattatgtggtggatgattatatgtatatacatatatattctctctctatat

SEQ ID NO: 172192 - DNA, 601 bp, Human
actgtagaaggaagaattctggactttctcttgtaaactttggtctagtaagtggcttacttttctatcttgatgactgggctctaaggaaattggagtaggagagtcctgggcttaattctttggtcaaaaatcaccaaacaaagatgatagacacaaagattttgaaattggattctgatttctgcaggtatgtgtgtgcatatatgtatatatatatgtgtgtgtgtatatatatatgtatatgtgtgtatacacacacacacagtcatgtgtcttttaacaatgggaatatgtaccragaaatgcatcattaggtgatttcatcattgtataaacaccatagagtatacgtacacaaacttagatggtaaacctgctgcacacctaggttatatggtatagcctattgctcctaggctacaaacctatacaatatgttactgtgctgggtactggaggcaattgtaacaccacggtgagcatttgtgtatctagacatagaaaaggtacagtaaaaatacagtattataaaattatgggacaactgttgtatatgtactgtgttgttgacaaaatcgtcattatgtggtggatgatt

SEQ ID NO: 172193 - DNA, 601 bp, Human
acaaaattatctatcaatattaaaattcctatacttttactgaaaacaaagtagatgtagaaaaaaatcacaagtgaaacaggattctacttgcaggagacactgccaagttcactgtagaaggaagaattctggactttctcttgtaaactttggtctagtaagtggcttacttttctatcttgatgactgggctctaaggaaattggagtaggagagtcctgggcttaattctttggtcaaaaatcaccaaacaaagatgatagacacaaagattttgaaattggattctgatttctgyaggtatgtgtgtgcatatatgtatatatatatgtgtgtgtgtatatatatatgtatatgtgtgtatacacacacacacagtcatgtgtcttttaacaatgggaatatgtaccgagaaatgcatcattaggtgatttcatcattgtataaacaccatagagtatacgtacacaaacttagatggtaaacctgctgcacacctaggttatatggtatagcctattgctcctaggctacaaacctatacaatatgttactgtgctgggtactggaggcaattgtaacaccacggtgagcattt

SEQ ID NO: 172194 - DNA, 601 bp, Human
gcggagggttgagggaagagacagagggatggaattctcccccaggtgactagactgagcagccagatggatgatgtggcttttcactgaactggaatggaagctagctcatggtcactgccgtgtcaccaatgcctggcacagagtaggacctgattattgaaacagaggaggagaagcagctttgggtggggaagatgatgagttcacttttggccctgaggagctcaaggggcctgtgggacatcctagtaggaggctgaatatatatatgggcctgaagtttggggtttgggatccrttagggaaaggtggtacttgaagctgtcatggatcaggtcatctagggcaagcaggtagagtgagaaaaactctggagagcttcaggacttaaaatgtgatcagaaaaaaggatccttatagaagagactgagaggtaggaagggaacagaagtgatattgcagaggcctgaggcagacactgttaaagagggaggcacctggacacttttgctgtagacaagtagcccatctaatcctaaagagcccctttgatatggccacttaatgacgtatgaaatacttcaaaaatgattttaaa

SEQ ID NO: 172195 - DNA, 601 bp, Human
tggaatcatgtgacctgcttaatacccatagaactttcctatggatacagccaaagttgcatatggagtgtggcaggtggggaaatggaaaggataacaaaaagtcagaaatcagaccatgaaaagccttattggctgaaggaagagcttctatcctgaaagttttgtctagacattttttagcatcagtagacagggtcaagctacagacagaaaaatcaggagtagaggcaagaagatatgagaccatgaaccaaggcggtgcccatgggagcagcaaggaaagaatatatattcgggmatggaatgctcagggtgtgggtgcgattggtgccaggcggagggttgagggaagagacagagggatggaattctcccccaggtgactagactgagcagccagatggatgatgtggcttttcactgaactggaatggaagctagctcatggtcactgccgtgtcaccaatgcctggcacagagtaggacctgattattgaaacagaggaggagaagcagctttgggtggggaagatgatgagttcacttttggccctgaggagctcaaggggcctgtgggacatcctagtaggaggctgaa

SEQ ID NO: 172196 - DNA, 601 bp, Human
gaaagcacgtaaaagatatttgatgtgaatgtgtgtctctgtgcatatttatttagttatttttatattttgcttttagttaagatgccatatgataatgatgcaagacagacctggattaaagcccacccctctatatcactcaagctgtgtgatcatgagagcctcatctataaaacagagggaataaagtctacttccaatgcttgtgactggatgacataatgtatatatctcctaattttacattcaccagttagatgtcccataagcatacactgagtgctcaaaaaattcactrcttaacacactttaattgagcatatactatgtgccaaagattgtattaggtatgaggatataaaattaaataagacaaggtcattgaacttataatttagtataggaggcaggctaatgaatactactactaataaatatacataggggaatagtttccaaattaaactggagatttgagggtttccaaaggaagtaatgcttgagctaaatttgaaagatacgggtagacaatacaaaaaaaaaaaaaggttctatgcatttcaggaatacatgtggaatcatgtgacctgcttaatac

SEQ ID NO: 172197 - DNA, 601 bp, Human
cttctaggaaacatttgcaatctgttctctctgaagcctgctacctggacgcttcatctgcataataagaaccctgttctccacaaccccttatcttaacacaggtactcccttctattgattccaggtctttagatagactctttcaaccaatcaccaaccactatgacctgaaagtcctgcccatcccctttgagttgtcacacctttctgaacagaaccaatgtgcatcttacatgtattgattgatgtcttatgtctccctaaaatgcataaaaccaagctgtggcctgactgcctyaggcacaggttctcaggatctcctggggctgtgtcacgggccatggtcactcatatttggctcagaataaatctcttcgaatattttacagagtttggctcttttcatccacatattatatgaaatagaatttgtaatcagaccaaatgagataatccagaaagcacgtaaaagatatttgatgtgaatgtgtgtctctgtgcatatttatttagttatttttatattttgcttttagttaagatgccatatgataatgatgcaagacagacctggattaaagcccacccctctatatca

SEQ ID NO: 172198 - DNA, 601 bp, Human
gataccaacatgatagatagcaggtcctgaaagtaaagtattttaccccaaaatatatttctttgatatattttgaaatggcttgaccaagctgtctcttgtggggaatatctacattctgcagagaatccccttttctttccagatcttcttcctgatccaagagagcattaactaagaatctggaaccttttttaagtcttctaggaaacatttgcaatctgttctctctgaagcctgctacctggacgcttcatctgcataataagaaccctgttctccacaaccccttatcttaacrcaggtactcccttctattgattccaggtctttagatagactctttcaaccaatcaccaaccactatgacctgaaagtcctgcccatcccctttgagttgtcacacctttctgaacagaaccaatgtgcatcttacatgtattgattgatgtcttatgtctccctaaaatgcataaaaccaagctgtggcctgactgccttaggcacaggttctcaggatctcctggggctgtgtcacgggccatggtcactcatatttggctcagaataaatctcttcgaatattttacagagtttggct

SEQ ID NO: 172199 - DNA, 601 bp, Human
tccctttggaattcaggcacagctgaccaacattaacaagaagacagaaaccttaagactgacaaagcagactctttgtagcaataagataccaacatgatagatagcaggtcctgaaagtaaagtattttaccccaaaatatatttctttgatatattttgaaatggcttgaccaagctgtctcttgtggggaatatctacattctgcagagaatccccttttctttccagatcttcttcctgatccaagagagcattaactaagaatctggaaccttttttaagtcttctaggaaacayttgcaatctgttctctctgaagcctgctacctggacgcttcatctgcataataagaaccctgttctccacaaccccttatcttaacacaggtactcccttctattgattccaggtctttagatagactctttcaaccaatcaccaaccactatgacctgaaagtcctgcccatcccctttgagttgtcacacctttctgaacagaaccaatgtgcatcttacatgtattgattgatgtcttatgtctccctaaaatgcataaaaccaagctgtggcctgactgccttaggcacaggttct

SEQ ID NO: 172200 - DNA, 601 bp, Human
aaatgtcaccattttgggcatcagagttcatgaaaatctgaaatgctgaagcatatttgctgcataatacattatccactgcaatatcataagagccactttggaggctcgcttcacttgacctacaaatgtggccccaatttcattaagaaattgtgaggtttcattgttgttattgtgcatatgatataaaacacaatacacaatagctgtgtataatggcaaccaaagaaaggcgccaaagagcatgggtggtaaagaagcaggagagaattgaaagctaagatcgtctttctgcctytttgcctctgtgagcctatagataggaatgaatcagtaaggtcaggctataaacttctagataagaaagaagcttgtctgtttcccctgaaaagctactgactgcatgtgggtgtcatccgtctacctccagggcattccttctgtgtggctggtattgtaatggagaggcgatctgatgttatcagtgtgggacatcagctctacttccccacactagtctctagcagaaacgtgacattgtgattctggataatcaggactgagaaagaggtaagcgagagattgatgttccaggctg

SEQ ID NO: 172201 - DNA, 601 bp, Human
tctttgtctttgtgcatctcaatgatggctgccctagctagtctggtagccttatcccctgctgtagagttccatagcactctctatttcccctattaaaactgtcagcctagacagcattgcaatgactttaaaagatgtctatctttcccactagactccagcacctgtgaaggcagaggctgtagctgtttcagtcatcattgctttgcccatggcataacatgattcttggcatatagtaggcacttaatacctcattgataaatgaatacatgcatgaataaatggaaaaatggastcatctcaaaactaacataaatcccaaggaggtcactacctgattccccaaattcaaatggctttgattgttaatttcctatcttgaaattcagatttaagattgaatcatatttatagagaagataaaacagaaaagtaatagaagaaacaccttgaagggacattttccattagatcctattcaaatcatcctaatcatgtcctcatgcttctcctggcatgcgtcttgtcttagtttgccagtgacagtggcagagaagttttgacacctgaatggtgagtaaccactgagtgaaaa

SEQ ID NO: 172202 - DNA, 601 bp, Human
aagggcaacctatcaggcagtggggaaggttttactgtgaagttgccttggcattgcaaatacattgcatttttctagattgtatatttatttggagtggttttgaaggggtctggtgattgtggaagctcttaatatctctttgtctttgtgcatctcaatgatggctgccctagctagtctggtagccttatcccctgctgtagagttccatagcactctctatttcccctattaaaactgtcagcctagacagcattgcaatgactttaaaagatgtctatctttcccactagactccagcacctgtgaaggcagaggctgtagctgtttcagtcatcattgctttgcccatggcataacatgattcttggcatatagtaggcacttaatacctcattgataaatgaatacatgcatgaataaatggaaaaatggactcatctcaaaactaacataaatcccaaggaggtcactacctgattccccaaattcaaatggctttgattgttaatttcctatcttgaaattcagatttaagattgaatcatatttatagagaagataaaacagaaaagtaatagaagaaacaccttgaagg

SEQ ID NO: 172203 - DNA, 601 bp, Human
taggagtatgtcatagatgtcattatcttttgttactttcaaaaggatagtagggtaatgtccaagtgaacactgaattattctgagttccactcagtaatcaatgttccctgggccagtcttgataatagctactattttcatttacctgtaatgattgctcctgattggttaagtaaacaaacaaataatcaaagaaaataaattgatttagctgttttcatttactttttcctacagagagcgtatgttcctaaaatatgattagagactgggagaagttttgaatttcttgacagawatggtctataccttaaccagaattccaagaatgattagtggactttgtatatgtcttatatgattattttcacaattcacttttctgtaactcttttgaataagtctaagtcttaatgaaggtgtggattagagcctggatctcaaaagctgtggattagagcatggatcctcattaatacaggcttttaaataaaagatcactatttatagaaaagtacatttccaagaacatcatccaagaattaaggtactctaaagacatctatagagcaaagtaaaatttagaccctgaattaat

SEQ ID NO: 172204 - DNA, 601 bp, Human
caaaaaaacctgtgtacttaaatatagtaagtaccttgttcatgccattatgatttgcatgtatgtaaggtttactcctttttttcctcaacacattagatttcccatgttgctagtgaattgaggcttagcaatttgcagagcattttctgcaatttttacgcgtttctcagaaacacttggtaactatccccagtgcttgctgtgaaatgagcccagaaggtgatgctaggactttgcaccaggtactaatgtgggaagtccacagaggctgcctgctcagtgctttcatgtatctcgyctttggtagtaatgtaaggcgcacaccattttgtccaatttactgctatttggcatgtttatctttggtcacaagaaaagcattggtgaggggttttatgagcacatatcatgaccctccatatagggtaatccaattgtgcatagttagaactctaaattttcagacaatgtaagtagtcttcaaaacaatataaagttcattaactcaatccatgctggaaatggattaatttccgtattctaattccatctattcaagagacacatcctggagggtcatacattattggcttaatta

SEQ ID NO: 172205 - DNA, 601 bp, Human
aatctcagcatttatgataatctactcaaaaaaacctgtgtacttaaatatagtaagtaccttgttcatgccattatgatttgcatgtatgtaaggtttactcctttttttcctcaacacattagatttcccatgttgctagtgaattgaggcttagcaatttgcagagcattttctgcaatttttacgcgtttctcagaaacacttggtaactatccccagtgcttgctgtgaaatgagcccagaaggtgatgctaggactttgcaccaggtactaatgtgggaagtccacagaggctgyctgctcagtgctttcatgtatctcgtctttggtagtaatgtaaggcgcacaccattttgtccaatttactgctatttggcatgtttatctttggtcacaagaaaagcattggtgaggggttttatgagcacatatcatgaccctccatatagggtaatccaattgtgcatagttagaactctaaattttcagacaatgtaagtagtcttcaaaacaatataaagttcattaactcaatccatgctggaaatggattaatttccgtattctaattccatctattcaagagacacatcctgg

SEQ ID NO: 172206 - DNA, 601 bp, Human
attgctgagttacaaataattgtatctccctattttgaaataatttagtcaaatacacaaaaagaataatgtaagtattttaaatgccactggagccctagtcttcctctccaatctcagcatttatgataatctactcaaaaaaacctgtgtacttaaatatagtaagtaccttgttcatgccattatgatttgcatgtatgtaaggtttactcctttttttcctcaacacattagatttcccatgttgctagtgaattgaggcttagcaatttgcagagcattttctgcaatttttacrcgtttctcagaaacacttggtaactatccccagtgcttgctgtgaaatgagcccagaaggtgatgctaggactttgcaccaggtactaatgtgggaagtccacagaggctgcctgctcagtgctttcatgtatctcgtctttggtagtaatgtaaggcgcacaccattttgtccaatttactgctatttggcatgtttatctttggtcacaagaaaagcattggtgaggggttttatgagcacatatcatgaccctccatatagggtaatccaattgtgcatagttagaactctaaattt

SEQ ID NO: 172207 - DNA, 601 bp, Human
ttttaaacacagtctgaattaaaaacatttttttctctcaaattcatccagattagtgctttaaatggtattagtaatccaatttttattttcaattgctgagttacaaataattgtatctccctattttgaaataatttagtcaaatacacaaaaagaataatgtaagtattttaaatgccactggagccctagtcttcctctccaatctcagcatttatgataatctactcaaaaaaacctgtgtacttaaatatagtaagtaccttgttcatgccattatgatttgcatgtatgtaargtttactcctttttttcctcaacacattagatttcccatgttgctagtgaattgaggcttagcaatttgcagagcattttctgcaatttttacgcgtttctcagaaacacttggtaactatccccagtgcttgctgtgaaatgagcccagaaggtgatgctaggactttgcaccaggtactaatgtgggaagtccacagaggctgcctgctcagtgctttcatgtatctcgtctttggtagtaatgtaaggcgcacaccattttgtccaatttactgctatttggcatgtttatctttgg

SEQ ID NO: 172208 - DNA, 601 bp, Human
cgggcagatgccttgagctcagagttcgaggccagcctggccaacatggcaaaaccccatttctacaaaaactacaaaaaattacactgtgtagggtggcatgtgcctgtagtcccaggtactcatgaggctgagcctggaaggtctagaatgcagtgagccttgatcacgccactacactccagccggggagacagggtaaggccttgtctcaaaaaaaaagaaaaaaaaaaagactctcagtaaaatgggatgaataaggttaataacatgtttttgatatgcccactcacagcataaytgaggaacaattcatacagattataaagttatgctttttttttttactcctggggagtaaaatactccccaggagtaaaataaaattcctcttgttgggggaagggtaggttgttaaaagacaaatattatgcgatcatttcaaggtagtatgatcagtaacataactggatgagtaacttgaaataaagcttataaaaaggctcattagaaaagtggcttttaaacacagtctgaattaaaaacatttttttctctcaaattcatccagattagtgctttaaatggtattagtaatcca

SEQ ID NO: 172209 - DNA, 601 bp, Human
aaaatatgactctcaagctgggcactgtggtgcatgcctgtaatcccagcaatttgggaggctgaggcgggcagatgccttgagctcagagttcgaggccagcctggccaacatggcaaaaccccatttctacaaaaactacaaaaaattacactgtgtagggtggcatgtgcctgtagtcccaggtactcatgaggctgagcctggaaggtctagaatgcagtgagccttgatcacgccactacactccagccggggagacagggtaaggccttgtctcaaaaaaaaagaaaaaaaaaaagactctcagtaaaatgggatgaataaggttaataacatgtttttgatatgcccactcacagcataactgaggaacaattcatacagattataaagttatgctttttttttttactcctggggagtaaaatactccccaggagtaaaataaaattcctcttgttgggggaagggtaggttgttaaaagacaaatattatgcgatcatttcaaggtagtatgatcagtaacataactggatgagtaacttgaaataaagcttataaaaaggctcattagaaaagtggcttttaaacacagtc

SEQ ID NO: 172210 - DNA, 601 bp, Human
ttaaggtaaataaaaatatgactctcaagctgggcactgtggtgcatgcctgtaatcccagcaatttgggaggctgaggcgggcagatgccttgagctcagagttcgaggccagcctggccaacatggcaaaaccccatttctacaaaaactacaaaaaattacactgtgtagggtggcatgtgcctgtagtcccaggtactcatgaggctgagcctggaaggtctagaatgcagtgagccttgatcacgccactacactccagccggggagacagggtaaggccttgtctcaaaaaaaaagaaaaaaaaaaagactctcagtaaaatgggatgaataaggttaataacatgtttttgatatgcccactcacagcataactgaggaacaattcatacagattataaagttatgctttttttttttactcctggggagtaaaatactccccaggagtaaaataaaattcctcttgttgggggaagggtaggttgttaaaagacaaatattatgcgatcatttcaaggtagtatgatcagtaacataactggatgagtaacttgaaataaagcttataaaaaggctcattagaaaagtggctt

SEQ ID NO: 172211 - DNA, 601 bp, Human
tactttgagaaacaattctctgagtacatgtatgttaaggtaaataaaaatatgactctcaagctgggcactgtggtgcatgcctgtaatcccagcaatttgggaggctgaggcgggcagatgccttgagctcagagttcgaggccagcctggccaacatggcaaaaccccatttctacaaaaactacaaaaaattacactgtgtagggtggcatgtgcctgtagtcccaggtactcatgaggctgagcctggaaggtctagaatgcagtgagccttgatcacgccactacactccagccrgggagacagggtaaggccttgtctcaaaaaaaaagaaaaaaaaaaagactctcagtaaaatgggatgaataaggttaataacatgtttttgatatgcccactcacagcataactgaggaacaattcatacagattataaagttatgctttttttttttactcctggggagtaaaatactccccaggagtaaaataaaattcctcttgttgggggaagggtaggttgttaaaagacaaatattatgcgatcatttcaaggtagtatgatcagtaacataactggatgagtaacttgaaata

SEQ ID NO: 172212 - DNA, 601 bp, Human
aaaacaagaaacctagtttcctatttctaagatttacattaccaggggcgcctttttctatgtaatgttttcatatctagggttacatggaatatactttgagaaacaattctctgagtacatgtatgttaaggtaaataaaaatatgactctcaagctgggcactgtggtgcatgcctgtaatcccagcaatttgggaggctgaggcgggcagatgccttgagctcagagttcgaggccagcctggccaacatggcaaaaccccatttctacaaaaactacaaaaaattacactgtgtakggtggcatgtgcctgtagtcccaggtactcatgaggctgagcctggaaggtctagaatgcagtgagccttgatcacgccactacactccagccggggagacagggtaaggccttgtctcaaaaaaaaagaaaaaaaaaaagactctcagtaaaatgggatgaataaggttaataacatgtttttgatatgcccactcacagcataactgaggaacaattcatacagattataaagttatgctttttttttttactcctggggagtaaaatactccccaggagtaaaataaaattcctctt

SEQ ID NO: 172213 - DNA, 601 bp, Human
tttaagacctcagctctaggattagttagcagttttcaaaaaaacaaaaacgaaaacaaacaaacaacaatgtttcccaaggaaaaaagtaaggggtttatggtcagataagtttgggaatcctctatttattccaattcctccccttgccattcctgatgattcacaatgcacatttaatttaaatgtataacaactctcagaagtcctgcaaagaaaacaagaaacctagtttcctatttctaagatttacattaccaggggcgcctttttctatgtaatgttttcatatctagggttrcatggaatatactttgagaaacaattctctgagtacatgtatgttaaggtaaataaaaatatgactctcaagctgggcactgtggtgcatgcctgtaatcccagcaatttgggaggctgaggcgggcagatgccttgagctcagagttcgaggccagcctggccaacatggcaaaaccccatttctacaaaaactacaaaaaattacactgtgtagggtggcatgtgcctgtagtcccaggtactcatgaggctgagcctggaaggtctagaatgcagtgagccttgatcacgccactac

SEQ ID NO: 172214 - DNA, 601 bp, Human
cgcaacctactcatctgacaaagggctaatatccagaatctacaatgaactcaaacaaatttacaagaaaaaaacaaacaaccccatcaaaaagtgggccaaggatatgaacagacacttgtcaaaagaagacatttatgcagccaaaagacacatgaaaaaatgctcatcatcacgggccatcagagaaatgcaaatcaaaaccacaatgagataccatctcacaccagttagaatggcaatcattaaaaagtcaggaaacaacaggtgctagagaggatgtggagaaataggaacactkttacactgttggtgggactgtaaactagttcaaccattgtggaagtcagtgtggcgattcctcagggatctagaactagaaatactatttgacccagccatcccattactggatatatacccaaaggattagaaaccatgttgctataaagacacatgcacacgtatgtttattgtggcactatttacaatagcaaagacttggaaccaacccaaatgtccaacaatgatagactggattaagaaaatgtggcacatatacaccatggaatactatgcagccataaaaaatgatgagttc

SEQ ID NO: 172215 - DNA, 601 bp, Human
ttcgcaacctactcatctgacaaagggctaatatccagaatctacaatgaactcaaacaaatttacaagaaaaaaacaaacaaccccatcaaaaagtgggccaaggatatgaacagacacttgtcaaaagaagacatttatgcagccaaaagacacatgaaaaaatgctcatcatcacgggccatcagagaaatgcaaatcaaaaccacaatgagataccatctcacaccagttagaatggcaatcattaaaaagtcaggaaacaacaggtgctagagaggatgtggagaaataggaacamttttacactgttggtgggactgtaaactagttcaaccattgtggaagtcagtgtggcgattcctcagggatctagaactagaaatactatttgacccagccatcccattactggatatatacccaaaggattagaaaccatgttgctataaagacacatgcacacgtatgtttattgtggcactatttacaatagcaaagacttggaaccaacccaaatgtccaacaatgatagactggattaagaaaatgtggcacatatacaccatggaatactatgcagccataaaaaatgatgagt

SEQ ID NO: 172216 - DNA, 601 bp, Human
ctaaagagcttctgcacagcaaaagaaaccaccatcagaatgaacaggcaacctacagaatgggagaaaattttcgcaacctactcatctgacaaagggctaatatccagaatctacaatgaactcaaacaaatttacaagaaaaaaacaaacaaccccatcaaaaagtgggccaaggatatgaacagacacttgtcaaaagaagacatttatgcagccaaaagacacatgaaaaaatgctcatcatcacgggccatcagagaaatgcaaatcaaaaccacaatgagataccatctcacascagttagaatggcaatcattaaaaagtcaggaaacaacaggtgctagagaggatgtggagaaataggaacacttttacactgttggtgggactgtaaactagttcaaccattgtggaagtcagtgtggcgattcctcagggatctagaactagaaatactatttgacccagccatcccattactggatatatacccaaaggattagaaaccatgttgctataaagacacatgcacacgtatgtttattgtggcactatttacaatagcaaagacttggaaccaacccaaatgtccaacaa

SEQ ID NO: 172217 - DNA, 509 bp, Human
gccaaggctcgagaactacgtgaagaatgcagaagcctcaggaactgatgagatcaactggaagaaagggtatcagtgatggaagatgaaatgaatgaaatgaatcgagaagggaagtttagagaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacrttcagattcaggaaatacagagaacgccacaaagatactcctcgagaagagcaactccaagacacacaattatcagattcaccaaagttgaaatgaaggaaaaaatgctaagggcagccagagagaaaggttgggttacccacaaagggaagcccatcagactaacagctgatctctcggcagaaactctacaagccagaagagagtg

SEQ ID NO: 172218 - DNA, 601 bp, Human
ctcctcctccaaaggaatgcagctcctcaccagcagtggaacaaagctggagggagaatgactttgatgaattgagagaagaaggctccagacgatcaaactactccgagctacaggaggaaattcaaatcaatggcaaagaagttaaaaactgtgaaaaaaaattagacgaatggataactagaataatcaacgcagagaagtccttaaaggagctgatggagctgaaagccaaggctcgagaactacgtgaagaatgcagaagcctcaggaactgatgagatcaactggaagaaagggyatcagtgatggaagatgaaatgaatgaaatgaatcgagaagggaagtttagagaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacacaat

SEQ ID NO: 172219 - DNA, 601 bp, Human
ctctaaaaagcagagtgcctctcctcctccaaaggaatgcagctcctcaccagcagtggaacaaagctggagggagaatgactttgatgaattgagagaagaaggctccagacgatcaaactactccgagctacaggaggaaattcaaatcaatggcaaagaagttaaaaactgtgaaaaaaaattagacgaatggataactagaataatcaacgcagagaagtccttaaaggagctgatggagctgaaagccaaggctcgagaactacgtgaagaatgcagaagcctcaggaactgatgmgatcaactggaagaaagggtatcagtgatggaagatgaaatgaatgaaatgaatcgagaagggaagtttagagaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaaga

SEQ ID NO: 172220 - DNA, 601 bp, Human
gtcagggttatttaagtgttaatggaatggcagaatatgatctttgagtcacaactcccatgttgctttaattacttcaccactccttttcatgactgttacggctctagatgtagcctgtttcatggtgtttgggtattgaaatagtattctcaaatgtgcaacgacagatttgcataattcgctgcataatttcttctgttgttcatagaaaatggatctctcttttttcccttcctttgtgaatgtctacagtgctgctctagaataatacaatgaaaataagatgccaggcagtccrtggaaccatactcagagaaggaagaaatgtgaaaacaggggtgaggatgtgggcctgggaaggtccagggagggtgtgaaaaatacaaagcaggggggtggagccaagatggccgaataggaacagctccagtctacagcacccagcgtgagcaacgcagaagatgggtgatttctgcatttccatctgaggtaccgggttcatctcactagggagtgccagacagtgggtgcaggtcagtgggtgcgcgcaccgtgcgcgagccaaagcagggcgaggcattgcctcactcgggaagca

SEQ ID NO: 172221 - DNA, 601 bp, Human
cacctgggagttttgaaaatgtagattctggggacccaccttgggtattctgatttgagaagttggttgtgtgcacaggagcttgtacacttagtgagttgtttaataagtatttttaaaaaggagattctgattaagagatttggtgagatgtgtgttatttcatatgtttgattgcaaatggtattgcatatataattcatacgttggccattttatttggcctttaccacatctcctgttcacttgcccctccaattagctagggttcatgaagtcttggggactatgcgttttcttmttggactgttttcttgcttctttccccctctctgtgggaacagcccaggctcactctgctcgccttgaacatatttaatgaaacattttattctgtggtaggaaatatgtgagtggcttatcatactcctttcagtaatattaaccatgtttttaaaaattttctttcaaatagctgcactgaagcctagagaggcttacttgacctggtcagggttatttaagtgttaatggaatggcagaatatgatctttgagtcacaactcccatgttgctttaattacttcaccactccttttca

SEQ ID NO: 172222 - DNA, 601 bp, Human
ttcggatgatagatttaagtgtacaaactgtttttgaacccattagaaacatctattacatgggaatattaagaaatctaattacaaatcatcctagtctagtcattgccaaatgattatggtcatctaagtcacctgggagttttgaaaatgtagattctggggacccaccttgggtattctgatttgagaagttggttgtgtgcacaggagcttgtacacttagtgagttgtttaataagtatttttaaaaaggagattctgattaagagatttggtgagatgtgtgttatttcatatrtttgattgcaaatggtattgcatatataattcatacgttggccattttatttggcctttaccacatctcctgttcacttgcccctccaattagctagggttcatgaagtcttggggactatgcgttttcttattggactgttttcttgcttctttccccctctctgtgggaacagcccaggctcactctgctcgccttgaacatatttaatgaaacattttattctgtggtaggaaatatgtgagtggcttatcatactcctttcagtaatattaaccatgtttttaaaaattttctttc

SEQ ID NO: 172223 - DNA, 601 bp, Human
gagatgaaaaacccaacagtgtctgtgagaagtatgctttgtattatctatgaaaacaggaaccagcaagacatttagcattgtaaataaaatttcggatgatagatttaagtgtacaaactgtttttgaacccattagaaacatctattacatgggaatattaagaaatctaattacaaatcatcctagtctagtcattgccaaatgattatggtcatctaagtcacctgggagttttgaaaatgtagattctggggacccaccttgggtattctgatttgagaagttggttgtgtgcasaggagcttgtacacttagtgagttgtttaataagtatttttaaaaaggagattctgattaagagatttggtgagatgtgtgttatttcatatgtttgattgcaaatggtattgcatatataattcatacgttggccattttatttggcctttaccacatctcctgttcacttgcccctccaattagctagggttcatgaagtcttggggactatgcgttttcttattggactgttttcttgcttctttccccctctctgtgggaacagcccaggctcactctgctcgccttgaacatatt

SEQ ID NO: 172224 - DNA, 601 bp, Human
cctactagacttataacctctcccattagcttaaaaataaaaacattaataaagcagaatctaatgtgttttctgaatctaacaaaaattaaataatagtctgtttttggtcaaaaatgccatagccatagatagaaatattaagttgctgtttgctgtctttacattttgtttgagatgaaaaacccaacagtgtctgtgagaagtatgctttgtattatctatgaaaacaggaaccagcaagacatttagcattgtaaataaaatttcggatgatagatttaagtgtacaaactgtttytgaacccattagaaacatctattacatgggaatattaagaaatctaattacaaatcatcctagtctagtcattgccaaatgattatggtcatctaagtcacctgggagttttgaaaatgtagattctggggacccaccttgggtattctgatttgagaagttggttgtgtgcacaggagcttgtacacttagtgagttgtttaataagtatttttaaaaaggagattctgattaagagatttggtgagatgtgtgttatttcatatgtttgattgcaaatggtattgcatatataattca

SEQ ID NO: 172225 - DNA, 601 bp, Human
agaaacctgtaagtagaagacgtttttctcctaatctaaacttttaggacataggtccaaaattagtgtgttatgctacaatggatcagaacattaaaactggggctgcccctgataatcttggacatactcctactagacttataacctctcccattagcttaaaaataaaaacattaataaagcagaatctaatgtgttttctgaatctaacaaaaattaaataatagtctgtttttggtcaaaaatgccatagccatagatagaaatattaagttgctgtttgctgtctttacatttygtttgagatgaaaaacccaacagtgtctgtgagaagtatgctttgtattatctatgaaaacaggaaccagcaagacatttagcattgtaaataaaatttcggatgatagatttaagtgtacaaactgtttttgaacccattagaaacatctattacatgggaatattaagaaatctaattacaaatcatcctagtctagtcattgccaaatgattatggtcatctaagtcacctgggagttttgaaaatgtagattctggggacccaccttgggtattctgatttgagaagttggttgtg

SEQ ID NO: 172226 - DNA, 601 bp, Human
tttttttttttctcatgaagtgaggttttcgttttcactcacgttccagaagaacagttccagttgtggtcaatcaggactgaccatcaaatgtgcctatcaaacggatacgggcaggattgcaacaggctgaacgtacttcaaggcaggtacccacagctgccttgggaatagaatggccctgattatggtaatgagggggctataggttctttgctgagagcatgaaggatgtctagattacatttctgcacagttcaaactgatactgatacttttaaaggggcctttctcacaacgrcatagtcaagattgctggccatgtattgtggtaacagtaacataaattaatatcaggaaactgagactgaagcattatgtagctcagggaccagcaggataaaggtaaataaatccacagtgacagtttgtctatcattcagtagagctcctttcttaatttgaaaaaaaaaaaaaatccagtttaccttaaatcttttccaagtgggaatttttccttattgagctcattcaagaggcagaaaatgaatgtcatgacagaaattaaaagtaaagtaaaatggccaatctgagatgccag

SEQ ID NO: 172227 - DNA, 601 bp, Human
cccctggaagtgccaggcctacccaaccatgcggacatttgttgaggaagagggagcctggaggctgtcaggtgactcttgttaagcctccgggaggttatgtttcccctcacttttccctactacaaaagcatggggataataacacgccataataaaaagcatcagggcatctgtgcgtgctctgcagaatggcatgttgtggtgccactcttattgtgtggaagaataaaagaacagacaacagctcagtaatgaggaggcatttagcccaaggcatgtttcactgaaaaaaaaaaaatcaccaactagatacaaaagtctctgaattaaaagcaggacttattctggaaattcgtttttgtttttgaaactcgtttttttcaatagaatcaatactgtaagggatggctttgatttcaagataacttgctaaagtcactgccacagtcacagagggttgggagtgtagttggagaattttattttgtaagacagataatgagcaggcaggcttttttggtattataaagtaatttctccttatacagcaggattctccttatgtttccctaatgaacggccacaagactcattttat

SEQ ID NO: 172228 - DNA, 601 bp, Human
ccccaggcccttcctctgtaaaacaaagttcagtgttcccttaccttttctgatgataccaataagctgaactgttcttgcttactaacacagcttcctggaccccttccccaatattctgattcagtgggtcttggataagccaccgattctgtgttattaaatattctaaattattcttatcctcaagcaagtctgggaaattagatgttctgtagggtactttcaacttgaatattctatgaaatgttattttgactgtattgaagatattaatgtaattttgcaattatacagtacstttcctaattcacagcagaatgactaatagtccttgcaatatgcctaggagatgatacatttcttaatgaaacattataattatgttctcctcttactttcatggaaaaaaaatcccacataaaattatcattagatatctgcatctctctgcaagaaatgaggcaaaatccatgggatctggggaggaaatgaatgatgtttagtttatcctaagtcttactgcttttagatatttaataaggagagttatacacatatgactagtcatgctgtctttaaggtaaggatctggagttga

SEQ ID NO: 172229 - DNA, 601 bp, Human
gacctctctgagccccaggcccttcctctgtaaaacaaagttcagtgttcccttaccttttctgatgataccaataagctgaactgttcttgcttactaacacagcttcctggaccccttccccaatattctgattcagtgggtcttggataagccaccgattctgtgttattaaatattctaaattattcttatcctcaagcaagtctgggaaattagatgttctgtagggtactttcaacttgaatattctatgaaatgttattttgactgtattgaagatattaatgtaattttgcarttatacagtacctttcctaattcacagcagaatgactaatagtccttgcaatatgcctaggagatgatacatttcttaatgaaacattataattatgttctcctcttactttcatggaaaaaaaatcccacataaaattatcattagatatctgcatctctctgcaagaaatgaggcaaaatccatgggatctggggaggaaatgaatgatgtttagtttatcctaagtcttactgcttttagatatttaataaggagagttatacacatatgactagtcatgctgtctttaaggtaagg

SEQ ID NO: 172230 - DNA, 601 bp, Human
agattcaggagaggtagattcaattcccatctgatgtacagtagctgtgtgaatgtgatccagtcccttgacctctctgagccccaggcccttcctctgtaaaacaaagttcagtgttcccttaccttttctgatgataccaataagctgaactgttcttgcttactaacacagcttcctggaccccttccccaatattctgattcagtgggtcttggataagccaccgattctgtgttattaaatattctaaattattcttatcctcaagcaagtctgggaaattagatgttctgtaggrtactttcaacttgaatattctatgaaatgttattttgactgtattgaagatattaatgtaattttgcaattatacagtacctttcctaattcacagcagaatgactaatagtccttgcaatatgcctaggagatgatacatttcttaatgaaacattataattatgttctcctcttactttcatggaaaaaaaatcccacataaaattatcattagatatctgcatctctctgcaagaaatgaggcaaaatccatgggatctggggaggaaatgaatgatgtttagtttatcctaagtct

SEQ ID NO: 172231 - DNA, 601 bp, Human
tatcccttggaaaaaattactatttccttctttctttatagacagaagacaatgatgggtttcagttctgttttgttgaaccctaatgcagtagtctggttttggggaagttcctagactagattcaggagaggtagattcaattcccatctgatgtacagtagctgtgtgaatgtgatccagtcccttgacctctctgagccccaggcccttcctctgtaaaacaaagttcagtgttcccttaccttttctgatgataccaataagctgaactgttcttgcttactaacacagcttcctrgaccccttccccaatattctgattcagtgggtcttggataagccaccgattctgtgttattaaatattctaaattattcttatcctcaagcaagtctgggaaattagatgttctgtagggtactttcaacttgaatattctatgaaatgttattttgactgtattgaagatattaatgtaattttgcaattatacagtacctttcctaattcacagcagaatgactaatagtccttgcaatatgcctaggagatgatacatttcttaatgaaacattataattatgttctcctcttactt

SEQ ID NO: 172232 - DNA, 601 bp, Human
ctagacaaggagtagccctaagtttccacataccgtttgccacttggcttttgatcgttctgcttcaaatttggcaacttctttacgatcatgaaatgacaccagtagcttccagatgcacagtaggacaaccccgatgagaagaatagccagggaaacccctaacatgatcatgggaatgtttggaggcttcggacaatctgcagaaataaagaaaattataagaaggtggtaaaatcaacattttgacatcggaaaggcatttcttgttggattttcatctacattttctgcagcagargataaatattgacaccattttcgccttgcttaaattttaaaaatgagttacttgttgaagaatagccctgcattcctcaaagtagaacaaaagataaaggaagaatttagatatttgaagtaaatggatatagacttgatggttgactctaaaagagaatccaaaagagtgataattaatgcacatggaatatttaaaggattaagaaaaagactagtttaatcactaaacatggtctcttctgagttcacgataaagcagaaatggagtgtgtgtgtgtgtgtgtgtgtgtgtgtgctg

SEQ ID NO: 172233 - DNA, 601 bp, Human
ggggcctgagggatactcctagtggtgaggaagcgctgggtaaaaatatacttccccaatgtccctaagcagctgtctcaggagcctcatgagacccttcatcgtggtggaaatccccaccgcactaagacaaatataagctatgagggtcatctggacctttgcccctgaagcagaacagaaatcaaagctgtttgggtcatggcgagagtgggagagaaaaaatgtgacatttgaactcccagagcagaagaaagctgagcccctcaatctcttccaccagcctctttctcccctagayaaggagtagccctaagtttccacataccgtttgccacttggcttttgatcgttctgcttcaaatttggcaacttctttacgatcatgaaatgacaccagtagcttccagatgcacagtaggacaaccccgatgagaagaatagccagggaaacccctaacatgatcatgggaatgtttggaggcttcggacaatctgcagaaataaagaaaattataagaaggtggtaaaatcaacattttgacatcggaaaggcatttcttgttggattttcatctacattttctgcagcagaagataa

SEQ ID NO: 172234 - DNA, 601 bp, Human
aaattggcatgaattatcgtactatttatgaacactattccattcattataacataaccaatttatggaaatgtttagatatagcacccgtgctttatcaaatggggcctgagggatactcctagtggtgaggaagcgctgggtaaaaatatacttccccaatgtccctaagcagctgtctcaggagcctcatgagacccttcatcgtggtggaaatccccaccgcactaagacaaatataagctatgagggtcatctggacctttgcccctgaagcagaacagaaatcaaagctgtttgrgtcatggcgagagtgggagagaaaaaatgtgacatttgaactcccagagcagaagaaagctgagcccctcaatctcttccaccagcctctttctcccctagacaaggagtagccctaagtttccacataccgtttgccacttggcttttgatcgttctgcttcaaatttggcaacttctttacgatcatgaaatgacaccagtagcttccagatgcacagtaggacaaccccgatgagaagaatagccagggaaacccctaacatgatcatgggaatgtttggaggcttcggacaatctg

SEQ ID NO: 172235 - DNA, 601 bp, Human
agaaattggcatgaattatcgtactatttatgaacactattccattcattataacataaccaatttatggaaatgtttagatatagcacccgtgctttatcaaatggggcctgagggatactcctagtggtgaggaagcgctgggtaaaaatatacttccccaatgtccctaagcagctgtctcaggagcctcatgagacccttcatcgtggtggaaatccccaccgcactaagacaaatataagctatgagggtcatctggacctttgcccctgaagcagaacagaaatcaaagctgttkgggtcatggcgagagtgggagagaaaaaatgtgacatttgaactcccagagcagaagaaagctgagcccctcaatctcttccaccagcctctttctcccctagacaaggagtagccctaagtttccacataccgtttgccacttggcttttgatcgttctgcttcaaatttggcaacttctttacgatcatgaaatgacaccagtagcttccagatgcacagtaggacaaccccgatgagaagaatagccagggaaacccctaacatgatcatgggaatgtttggaggcttcggacaatc

SEQ ID NO: 172236 - DNA, 601 bp, Human
gaaggcattgctataaaaattgttaacatcaaattatttgggcggacaaatccaaaggagcattgcgtctacctgtattttctccagtgatatcattgttgttagaatcagcaatgtaagataattgctgttagatacctggacacaccattagagatagagagatgaaattaaaactatggaattgtttctatgggtctctagaaatgtaattatctctcctgtggaaaagaaacacagaaaactatagtcctgccttctgattgcctcttgtgaagagaaggcagttaaattatttctrttgagtttatgtatttaaaggttaatacttttggggtttttttcaggtctctgtttaaaatttatgttattcagaaaaaataactgcatggcattttaaaaatcatctcaattttgctttgtaacctattatatcagaaacaagtatttccaaagaaattggcatgaattatcgtactatttatgaacactattccattcattataacataaccaatttatggaaatgtttagatatagcacccgtgctttatcaaatggggcctgagggatactcctagtggtgaggaagcgctgggta

SEQ ID NO: 172237 - DNA, 601 bp, Human
tcaccaagctaacctgtttaccttttacattgttagggatgagtaaattatatcttctcctgaggaattttgcttaattatggaaaatacacacattcgcaaaaagaggaaagctatataaccaacctccaaagacccatcgctcagattccacagttatcacagttctgccacacctgcttcaactatccctccatcccactctcttggctgaattatttcaaagtgaaccccagctttcatttcctttcactccttcagtatgcatctctaaaaaatatggatattttctagcaatgtsaccatgccattatcatacctaatcaaattaaccatacttatttgctatcattctaatacccagcatgtattaatcttttttcagtctttttatgtatttatttattatttattttggagactggggctcactctgtcacctaggctggaatgcaatggcatgatcatggctcactgcagccttgacctcctggctcaagtgatcctcctgccttagcctcccaagtagctgggactacaggtgtgaaccaccatgcctggctaatttttgtatttctttttgtagggatgggttttgcca

SEQ ID NO: 172238 - DNA, 601 bp, Human
aactgaattatttgagttaaaccttttttgcatccaagtgaataattactacccagtcattatctagtcaggaacatcaaacatttgttattcaaagaaactcaatttaataagggaataatattttccatttatgcttttttttctgtttaatgcatgttcgggtcgcatgttagatgaagaaacagcaaaaattcagcatttgaatttcagtcatgttctacatcctgagggagaacaattcatgtttttggggaaattaactgttaattaaaatgttattttaaagatattaatcacktgtcagtatttatgcctctgtatgagaacattgaaatgtgctggttagtagatacacatcacataattgcccaagtgcgtgtttgtggaacacctgcttattatttccaggagggtcaaccaaaggctgtgcttagaagaacaatgaacaattaggcttcagcttaaccatgcaccaaaagttagggaagtcccttaacttctctgagccttagtttagctcttcaaaatggaaataccaggattatatcatggggcttgctgctattgtcctttgtggcaacttaaccatattctttta

SEQ ID NO: 172239 - DNA, 601 bp, Human
tgaattgcagttgacaagataacacaatgttatttagtagatatttagttgaatgtttaattttgatggcagagttttcattccgtattttaaagcaacttcattcattcaggtttgcaatattttgggagtcccttgcaatactggtttagggccaagacattgcttatagggagtgatgggtaaagcagacttcactagagtaagagggtaaggtggaagtgtaaaagtggacgaagagcaagtacatattgctgttgtgtgtaatagggtatttcctggcctcagctgaagatcagakgtcaggataatgcactcacattgggttttgttccaggaggaggtgtggaaatgtccacactgcctcctctagtgctctgctgattgtaacctctctacacagactttccagctgaaatgcaggcttgagtcctactctatttcgggtgagtgtgcaatccactgctcagaaaaggtcagttttcccctaaccatttggggttaccaggctgattcccccaggtgtctgggagtgctaatttaggctgtggattctgcaaatgcaatgacacatttttcaagattgaaaaagtggtaatag

SEQ ID NO: 172240 - DNA, 601 bp, Human
taaaatcggaaacactccccggtctttcccactcactggcctcagtgccctcattgtgagtgggaatcacacctgcacccatttctatgttgtccagagccagtggcctgacctctgactaagtgacatgctacttttgttatgtgcctttaaagagatatgctatttctataataaagccaaacagaaaaatgttccttggctggtggtggatgatgggtgaaagctaagttggtatattgcttctattcctgagagcagcctggttaattctgagggacctccagatcttatctagtcytgctgctctaagaatttgagattttgaaggcaaagggcagactgatgtgaatttagatgtagatggagtctcatttgcaaacaaaaatcatgcatggaattctattaaatttgagactagaatctagttggttacaggagaatgagagactccattgaagaaacaagatggaaaaaagtaagaggttcaggccagcaatgacagggtaagcctgtcctggaggaatttcccacttcctccaggaagctcccacctttgtgaacagaaaagacacttggaaagaggacacaggctgtgagc

SEQ ID NO: 172241 - DNA, 601 bp, Human
tgctatcccaggccttgcgtccccattaggcgcgtctcgccctgtctgttaagcaccctccaaagtcatctcagtgagtgctttgttttaggtacacacacgcacacacacacacacacacacacacacacacagacacgcacgcactcaagcatggacagtgtggggatccgcgggtgtcctggagaccgcgagtcctgcagcccaacttcccctggctcagacaggtgccgcgcctgccagagaccagggaaatccggaatccattgctgatggcggcctgcagctccccagcgcggtscttgctggctttgcagaagcctgcgagccccaaaatgcttatttttcaacccaaggatgtgaataatgcctctatttcttacttgaggacgaagcgctgtgtttcttcccggggggacttggaataaaccaagcgccacttaaatacttggcagaggggaattcttccttcctttctgccttcctcttattgttgtaacattgtctattcgacgaatgtaaacttaggctaggaaaagttcttttcacttctggatcctagatgccgcaatgagagaataagccggagcagccgctctaa

SEQ ID NO: 172242 - DNA, 601 bp, Human
atcttattttaacacttacattcaaatttgctttccagaaaccttttcacaggtgcttaagaagaaaatgtactcatagtttagtcctatgtttatcacctttcagtgctcatttctaagtgcttaataccatgaaaatggtaaatgggcagtctgaggatgaaaaagagagaacataagaggcctagataatctataaactaaatataggccattagcagaaggcaaatgtaattttgaaatgaaggccatcacgtattttctccagtatgttcacaggtcaaggatagtccttccacccaggttctagaccacatcttttcttactatccctgaaaccctgccccagcactcatccctcttcagtgcacgtcttcaaattctctccctaatgtaacttcccctcagtctgtaaatattctaatttttcttattgtaaaaaaaatatttcttttgatatttaatttcctcctgaaacatcctgtacttctggcttctgttctcttcctgtttttctcctcctttcctcgctgctctcccgtcatctccttcacaggctctttccttgttggtgtttgcagagtttcatcctgaatcctcc

SEQ ID NO: 172243 - DNA, 601 bp, Human
cctgccccagcactcatccctcttcagtgcacgtcttcaaattctctccctaatgtaacttcccctcagtctgtaaatattctaatttttcttattgtaaaaaaaatatttcttttgatatttaatttcctcctgaaacatcctgtacttctggcttctgttctcttcctgtttttctcctcctttcctcgctgctctcccgtcatctccttcacaggctctttccttgttggtgtttgcagagtttcatcctgaatcctcctcttcattctgcagattgtctctgggcccattccctgcrcaggtccctatctccagccagcctccccttctgagttccagatcagtatttccatcagccaccaaatttctccagctagacagtctgtaagtaagccagattcaacatttccaaaactgaatttaatacgtgtcctccagaattttctcctctattggctaccattgtttaatggcagtattattatcacacaaacatgaaagccaggaatttgtccccatgttttcaacctcacagccactctccaaattctcttggctctcctcccatccatgcaactcctgccacccagtcagtccc

SEQ ID NO: 172244 - DNA, 601 bp, Human
ctctcccgtcatctccttcacaggctctttccttgttggtgtttgcagagtttcatcctgaatcctcctcttcattctgcagattgtctctgggcccattccctgcgcaggtccctatctccagccagcctccccttctgagttccagatcagtatttccatcagccaccaaatttctccagctagacagtctgtaagtaagccagattcaacatttccaaaactgaatttaatacgtgtcctccagaattttctcctctattggctaccattgtttaatggcagtattattatcacacaracatgaaagccaggaatttgtccccatgttttcaacctcacagccactctccaaattctcttggctctcctcccatccatgcaactcctgccacccagtcagtccctcatcttatgtctgtatgtaacttttaaactggattttcttttcttatctctccaacccattctcttcattttcactaatgatatctttctaagacacttatatgtttccaattactgctttgtttcaaatgttagtggctccccatctcaggtagggtaaagtgccaatttcttggcatgtcataaaaaggta

SEQ ID NO: 172245 - DNA, 601 bp, Human
aaagtagagaacttttacttttgcaacaaaaaggaaagcttgaggtaacctacctttgctgggtcccaccctaaaccacctctctggtctcatcctcagccccttaatgggacttaggccgccctctgataaagtaactttgctcccctatggcttagcagttatacctgcccaacctcagctaagctttgctctcttaatactaggtcctgagccactgtttgacttaaatttatggactggggtttaggattcagtatttacaatggctcatatatttctgatgtatggtctggtttgsaagtgattgcttaaatatcatcactgcctccccactttcctaagattaaaattccagtgttacctaccccttaccaccttgtgggatgatcaccaagacaggtagatttcaacatcaagagttagcggctgtgagcggctgtgtcagttaaattccttccgaagtggatgatgactactccctgtcttcatgtgctgacagccctggagatattaaaaggtagaagcttgttaatgtaaagagatgagcttctcatgatgtaattttagacattcagcaaaataaagacacatgttcagt

SEQ ID NO: 172246 - DNA, 601 bp, Human
aaaaggtagaagcttgttaatgtaaagagatgagcttctcatgatgtaattttagacattcagcaaaataaagacacatgttcagtcaatgtgtataaagtcaagaatttcaggaagaatggggaaaatatttggggccaaaagtgtccaggcatcacataaattctaccactaaagccataagtcttgactaccaacactgctcagcttgggatattagtaaaagatttagcacagcataaaacaagagaaaccatgaaagatcaccgctctgattggcaagtgaaagaaatggaaggtkggtggagttctttttttccagttgttcagtgaccaatcatttaccagcagaacatacagaagagtggctccctacaggggagaatcctagcactgcaaatcatgagacaatagactctgtgtatgacagtgattcctatgccccttcaggtgatccatagaggctttattgatctggctacagtgaatttcataaaactaatacttgataatattcttataaggtatctactttatgtaaggctgtgtgttaggctcaaggtggaatcagagaaaacttaaaacatggctgagagaggtt

SEQ ID NO: 172247 - DNA, 601 bp, Human
agttcctggggcagatgtttaggttcttgaatagaatactgacgcaatgaaaacagaaggtccttatgcccacaatgtggtattcaagttgttcccagagagtgaaagctgagttgcagccaccagaccttgaagggccttgtaagtcatgatatagagcaggggttttatcctgagaacagtagaaaggtcttgaagggccttgagcaggggagtgacatgatcagatgaggagagtgggttggatggaggccaggtggaaagcaccaagatcatttaagaaagaatatgtttgggtttyagttttagtttaggagaccagttgtgagatgatggtggtaaaaactcagatagtggcagtagggaaagagactggaggatttattggaaaggcattaaagaagaagagtgaacaggatttgatgattgatttactatggaggtggagagagagggagaagataaggctgatgcttaggtttctgacatggacaagtcagttgattttgtgccattcactgagataagcagtgctgaaggagagcaagttggaggaaaaagatgatcagttcaggtcaacagattgagtttgagacatctg

SEQ ID NO: 172248 - DNA, 601 bp, Human
tcccagagagtgaaagctgagttgcagccaccagaccttgaagggccttgtaagtcatgatatagagcaggggttttatcctgagaacagtagaaaggtcttgaagggccttgagcaggggagtgacatgatcagatgaggagagtgggttggatggaggccaggtggaaagcaccaagatcatttaagaaagaatatgtttgggttttagttttagtttaggagaccagttgtgagatgatggtggtaaaaactcagatagtggcagtagggaaagagactggaggatttattggaaagkcattaaagaagaagagtgaacaggatttgatgattgatttactatggaggtggagagagagggagaagataaggctgatgcttaggtttctgacatggacaagtcagttgattttgtgccattcactgagataagcagtgctgaaggagagcaagttggaggaaaaagatgatcagttcaggtcaacagattgagtttgagacatctggatgtacacctggatgtatatgtctaattagcaaatagttatatgtagtggcgttaggaacaggcaggaaagtaagatggggatagagattt

SEQ ID NO: 172249 - DNA, 601 bp, Human
agaaagtttggtatgatagtaaaagggaggagagagtagcaagagaggtaaaatgggagcagctgcctttaagcaaacatgggaaaggcttgcataaaaattattataaggagattttttatttctgttacttatggtgctgcatggtacacttgtaatgttttaaaattgcattgaggtatatgtatgtggcagagattcattgcacaagagaaactgagggaaggggaggagctttgatgactatacaaaggatattatcagagagaaaggagaggaagagagttaggtgtccagcacyagtaacagctctggcagaaaggagcccctgcttagaagctgcaggttatcatgggaaggtaggcaaagcagaccctgggctatgaaatagagaggatattaactaatcagggaaaggtgtgaagttgatccaggtatgcaaagagggaaagaaagcagaggtatggaaaaaggtacctcccatcctccagagtggctgcttagattgatgagcccatgtatacattttggtttcaaacatcttttcacactaatgcagttatgattaataagctgtttttagggcatgtaatatataaca

SEQ ID NO: 172250 - DNA, 601 bp, Human
ttgcattgaggtatatgtatgtggcagagattcattgcacaagagaaactgagggaaggggaggagctttgatgactatacaaaggatattatcagagagaaaggagaggaagagagttaggtgtccagcaccagtaacagctctggcagaaaggagcccctgcttagaagctgcaggttatcatgggaaggtaggcaaagcagaccctgggctatgaaatagagaggatattaactaatcagggaaaggtgtgaagttgatccaggtatgcaaagagggaaagaaagcagaggtatggawaaaggtacctcccatcctccagagtggctgcttagattgatgagcccatgtatacattttggtttcaaacatcttttcacactaatgcagttatgattaataagctgtttttagggcatgtaatatataacactccaattccagtggcagaattaatatcagtgcgttagtcagatttcctaaaaaccaaacaagttcttttagaaatatagatttatgtttctccagttaagccttcaattccccttatttctatctagtttaataaagatccccaaaataatcttgttagaaataaca

SEQ ID NO: 172251 - DNA, 601 bp, Human
gtgttgttttcaaagcatttcaaaacattttcattgaatcataaattagaaaagaagttgatgtctattcttaattttgttagtcataattaaagtgcttatattcaagtgttttatccagtctatgcctgctaactcttgaacacgtaatttacattttagaaccagtataaacttgaactgcatatttggctaatgttttcagctccatagactgttgggacagttaatgattttcaaatatattttacttcctttgagagacttgtctgttctgttgcccaaataggtaacagaaacyttgcaattctgtcagcaaagattcctgcattattatcttgttctgaaaaggtgactgaaattcttccatttattaaagtgtctagagacagtttttgctacagaagccatatataactcctgaccactgaaaggctttctgtataaaaatgaagttaatgtttaaacagagcaatggaaataaaagagtgttcaaaaaatggaaataaaacacagcaatggaaataaaagaatcactgtattgtcagtgcaagagattacttcattgtgttttgaaaggcgagcaaagctattgcaccga

SEQ ID NO: 172252 - DNA, 601 bp, Human
ccttggaaattggggcacttttatgtaatctttattattttttcagtataaaaatttaataaatagccctaatgagaaaatctaatgccacattgaaaaatgattaaaaatttatggaagtagtcatggtaattaagaaatgcctttattattacacagtatttaatttttgcccctcaaataatctgcctttaatatattagtgtcattttattattttttttgctatggttcaagtgagctatcaccttaactctttttaaaagtgaagtcccagaccgagtgcagtggctcatgcctrtaatcccagcactttgggaggctgaggtcaggagttcaagaccagcttggccaacatggtgaaaccctgtctctactaaaaatacaaaaaaattagccaggtgtggtggcaggttcctgtaatcccagctactcgagaggctgaggcaggagaattgcttgaacctgggaggcggaggttgcagtgagccaagattggtgccactgcacttcagcctaggtgacagagccagacgctgtctcaaaaaagaaacccaaaaaacaaacaaacaaaaaaggcagagtcccatgagctcctgcc

SEQ ID NO: 172253 - DNA, 601 bp, Human
ctgactgcaagctgagaagacaggcccatatcatcttcacttgtatcaagggttcttggcaccattttattcaatgagtgatgaatctatgagccatgtatgacagctactgtaaggggattaaagacacactttctgaatgaaggccaagctgaaaaatttctacttctttccaattagtatatgcaaaaataattctatttgtaagtgtatctgaatttgctaaaatattcctttagttgataaatttgttttcacttctttgacagagtttgtttgcttttaaaatgtttttcctttytcataacatgtctaactaggatagctctgttgacaagtaacaagatgaatgaaagtattaggacagtacagatatcattttttccccaaacccttttctgttccccttttctgttctcataaagcaacaccataatttatcttcagcttgactctctctcccaccgaatacattctttaagattaccttctgtcctatttatcattgtatttcaggagcctggctcatagtaagcactcagaaaatgatgtattaaaaaagaaaaaaaatcaaaattcaaatacagtaaattttaaaact

SEQ ID NO: 172254 - DNA, 601 bp, Human
tcttttctaaatttctttgctaagatgtttaagtttagcttgtccccttcacaacttttgtaaagttagtgctggttcccatttatgttgctttctttcccctggtgcctgcttatcttagctagacgttatattagaaaaaattatttgacaaaattgtttgaggcttgggtgatatttttctacataaagcattttcttttttttctttttctttttgtttttttttttttttttttttcttgatgaagtccagctctgttgtccaggctggagtgcagtgatgcaatcttggctcacygcaacttccaactcccgggttcaagcgattctcctgcctcagattcctgagtagctggtaatacaggtgtgtaccaccatgctgggctaatttttgtagttttagtagagatggggcttcaccatgttggccaggctggtctcgaactcctgatctcaagtggtccacccacctcagcctcccaaagtgctggaattacaggtgtgagccaccacacccagcaataaagcattttcatttgcttctattgagacaataccctagaagttttgcagtggcagtgtgatgaccaatgaggtt

SEQ ID NO: 172255 - DNA, 601 bp, Human
aaaaaaaaaaagatgaaagtgggataataaattgctatgccttattaaatttctcaagaagtgtgcccccctcagtagtgtataatgatactaatcgtaaaaacaaaaaaaatctactaagtacttaccatttgttagacactgggttgagagttttatatgcattgtctgaccacaatgaggtaaacatatacatgatatctattttacagatgggaaaggaatggcttatacaaaacaaggaacttgctcaaggtcacagtactattcaaacctcagaggccaagctcttaggcactgygatatactactggctttgctcagtaaatggacctttcagcttaaaaaatgctgtacatcacaaactaacacagaaacagaaaaccaaacacagcatgttctcactcgtaagtggaagctgaacaatgacaagacatggaccccgggaggggaacaacacacactggggcctgtcggtgggggcgaggggagagagagcatcaggataagtagctaatgcatgctgggcttaatacctaggtgatggattgataggtgcagcaaaccaccatggcacacgtttacctatggaacacaaacc

SEQ ID NO: 172256 - DNA, 601 bp, Human
caattcagaggttctggattaatcactataaaacaaagcatgaggtgccttgaaatgctgtagctcctatgcagacttagaaaacagtcctaaacatgtgcatggcatcacaaacagggaggtgtgaaagtgaaaggagcttttcctaactacgaataatgataattttaaaaattcaatgtagcatgctagaagaaaaaatgaattctcttgttctctttagagaataggacttaataaaattgctgtcatgtgaagaggtgatatagagcagagccccaaactaggaaaaaacgagttrcataagtgtgtcaggcaatcagttggatttccaggaagtacactacagtaagagctgccaatagtgagcatcaaagaagttggaagaaaggtatgcacaggctaggatggtcagaaaagaccctaaccaaaatttatagagaagtggcttgtgaacagggtataataaaagaaatactaacttcagttatgtctgttttttccatatattgcctcaagatatgtgagacatatcctgctaatgagcaagttaggtgacaggcactgacttgctaaatacacacaaaatatgctattttga

SEQ ID NO: 172257 - DNA, 601 bp, Human
ttaggacctcatttgaccttaaccacttcattaaaggctctgtctccaaatacaatcacattgagggttagggtttgaatacaggaattttgagagacacaattcagtttgtaacaccccctttggcttaatggtttaaggggtttatttctggtcatggaagtgacgctcatgtatttctttgatatgaacacaaagtaagtgtcaaacatatgatatatggacacactgtaaaaaacaaatagccgcaaatcatgaagcaggatattatcgccagatgtcagctagagtctctctctccgcctcttaaaattgagataagatttattcaaatccctattccattcttataagaaaatgcagtgccctctcaagatttccgtgaactcccaggagatgtgcattttcattgacttgggccctcacttcctgactgcagagtgtttattctccactctgccaggtctggtatttgattttgaccctaggtacagtcaatacattagcctgatactgtctcatggatgctacaagatgccatgacatgcatgagtcagagaaggactttattactcacagcacagcaggcagcacgagtatg

SEQ ID NO: 172258 - DNA, 601 bp, Human
tactgtctcatggatgctacaagatgccatgacatgcatgagtcagagaaggactttattactcacagcacagcaggcagcacgagtatgagcatgtgtctatcagttcccctttccccactctagtctcatagtgttacatgaaggggcccagacagacacctgcacacagtggggtgcaagacaggaaagaaacaatgagcttggtggacctgctgctttatagcaagcagtcagcaagccttctctttgacctgggggaagagattatctcacccctcaatattattcatcataaacrcaatgctaagaaatggcccaggtaaatagtagtcagggccttgcattcttgatatacccattgtattaagttgaatggtagtctcccccaaatatgtctctattctaatccccaacacctatgagtattaccttatctggaaagagggtttctgtagattgccttgaggagactgatggtaaaaacatgaaggctcaagctacttctggtgagggctcagaaggaaaccaggaatatgctgttggaaactgcagaaaatgtcctcattatacagcggcagaatatttgacctaattgggt

SEQ ID NO: 172259 - DNA, 601 bp, Human
tgcacaatgattttagacttccatctccagaactgttaagaaataaacttctgttgttggccacccagtctatggtactttgttataacaggcggaatgaagacactcatattaggagtttcactgttagaaaagcatcctctgaaagcaaagggtgtggctagacatccttttgtggaaaagattaggtatgtggttgccagatcctctcaaccatctcagcaacaatcaaaatagtgatgaggttatccaggaaagatttcctgtggagagctcttttgtttagtggcatgaatcctgmattacctacataagaaacctgcaaatttttaaaaaaatgttatctcagcagaagcattgccatctttgactgaaggtgatagagaggcagaggccagaggagctgttgagagcccagaggcctatggttgacagcccagagaacagaggctcgaacaacagaggattattctcaggccttgaaatctaattgaaaatttcctgctaggtattaaatttgtttaaggttggtgacccttttactccttccaattgctgccttttgaaatgggagtgtctatcagatgcctgccccaccatt

SEQ ID NO: 172260 - DNA, 601 bp, Human
actgttaagaaataaacttctgttgttggccacccagtctatggtactttgttataacaggcggaatgaagacactcatattaggagtttcactgttagaaaagcatcctctgaaagcaaagggtgtggctagacatccttttgtggaaaagattaggtatgtggttgccagatcctctcaaccatctcagcaacaatcaaaatagtgatgaggttatccaggaaagatttcctgtggagagctcttttgtttagtggcatgaatcctgcattacctacataagaaacctgcaaatttttwaaaaaatgttatctcagcagaagcattgccatctttgactgaaggtgatagagaggcagaggccagaggagctgttgagagcccagaggcctatggttgacagcccagagaacagaggctcgaacaacagaggattattctcaggccttgaaatctaattgaaaatttcctgctaggtattaaatttgtttaaggttggtgacccttttactccttccaattgctgccttttgaaatgggagtgtctatcagatgcctgccccaccattatattttggaagcaaataacctattttctag

SEQ ID NO: 172261 - DNA, 601 bp, Human
ctatcagatgcctgccccaccattatattttggaagcaaataacctattttctaggctcacaggcttagagatggagaggaattttgccccaggacagatcatgcctggcatctcactcacaccaaatttagatgatgagatttgggacttttgagctgacaatatttagatgagatttcgagctcagagttaattctgtaatgggttgagccatttggaaatgttgagataccttaaagaatgtattttgcatgtggcatgaatgtgaattttggggggccaggtgacagagtatagtgrctcccaaaaagatatgtccatgtcttaatcactggaaccagtaattggaaaaggggtctttacagatgtggtggttaaggatcttgagatgaaaacatcctggattatctgggtgagagctaaatccaatgacaaatgtttttgtaagagtggggcagagggagatttgacacatgtaaaggggaggaggagatgtgaccacagacatagagattggagtgatgcagacacaagttaaggaatgctcacagccccaagaagatagaagaaacaagaaatggattcttctctggagcctgc

SEQ ID NO: 172262 - DNA, 601 bp, Human
tttggatttatttggataaaaaaggatgagtttgttcctaatacacatgagatagatttggttttctgttcctggcaccagatagcaacattatatccaaatggtggcttggattgactggaaagtttcaaataacattaaaaaaattaatttctatttttatttttggagaaggaagaaatgattctgtcttaagcatcagcatttattgctttctattatttttatttttaaacaataccattgttgggctacctttggtgggcatttaggttgactccatgtctttgctattgtgaayagcactgcaatgaacataggcatgcatgtgtctttatggtaaaacaatttatagtcctttgggtgtatacctaataatgggattgctgggtcaaatgataattgtgttttaagttctttgagaagtcaccaaactgctttccacaatggtagaactaatttacgttcccaccagcagtttataagtgatcccttttctctacaacctcaccagcatgttatttttttactttttattaatagccttgctgactggtatgagatgatatctcactgtggctttgacttgtatttctctaaa

SEQ ID NO: 172263 - DNA, 601 bp, Human
acatgtatttcttcttttgaaagcattggttaatttcctttgcccactttttaatggggttgtttggttttttgctggtaaatttgcttaagttccataccgattctggacatttaatctttttcagatgcatagttttcgaatattctctcccactccataggttgtctgtttactctgttgatagtttattttgctgtacagaagctttttagtttaattaggtctcacttgtcaattttgttttgttataactgcttttggcatctttatcatgaaatccttgccagagccaatgttyggaatggtatttccttgattattttccaggttttatactttcaggttttgcatttaagtccttaaatctatcttgagttgatttttgtgtatggtgtaaggaaggggtccattatcaatcttctgcctgtgactagccagttatcccaacaccatttagtaaatgggcagtcctttccctatttctttcttttttttttttttgtcaactttgtcgaagatcagatggttgtcagtgtaaaactttatttctggggctctctattctgtgccattcatctatgtgtccatttttgtacca

SEQ ID NO: 172264 - DNA, 601 bp, Human
gcatctatgttcatcagggatgttggcctgaagttttcttttttattgtgtctctaccaggatttggtattagaataatgctggcttcatagaatgagttaggaaggagtccctcctcctcaattttttggaataattttagtaggaatggtaccagctcttctttatacatctggtaaaattcagctatgaattcgtctggtcctgggctttttctggttggtaagctttttattactcattcaatttcaaaatgcattattggtttatccagtttcagtttctttgtggttcaatattmagaggttgtatgtttccaggaatttatctatttcttctaggttttctaatttgtgtgcatagaggtgttcataatggactctaagggtttttagtatttctatgaggttgctgacaatatcccctttgtcatttctgattgtgtctattttaattgcctctctttttctttattagtctagctagcagtctatctatcttgtctattcttcaaaaaaaaagaactcctgaatttgttgatcttttttatgggtttttgtacctcaatttcattcagttcttctctgattttggttatatg

SEQ ID NO: 172265 - DNA, 601 bp, Human
tttatctatttcttctaggttttctaatttgtgtgcatagaggtgttcataatggactctaagggtttttagtatttctatgaggttgctgacaatatcccctttgtcatttctgattgtgtctattttaattgcctctctttttctttattagtctagctagcagtctatctatcttgtctattcttcaaaaaaaaagaactcctgaatttgttgatcttttttatgggtttttgtacctcaatttcattcagttcttctctgattttggttatatgttgctttctgctagctttggagytggtttgttcttgttgttctagctcccattggtgtgatattaggttgttaatttgagatctttctaactttttcatgtgtatgtttagcactatcaactttcctcttaacattgcttttgctgtgtcccagagattctcatgttgtatctttgctttcattagtttcaaagaatttcttgacttctgccttaatttcgttgtttacccaaaagtcattcaggagcaggatgtttactttagatgcaattatttggttttgagcaatcttctcagtattgatttctatttttattgtgctg

SEQ ID NO: 172266 - DNA, 601 bp, Human
caggtcctaaatatctttgttagttttctgcctcaatgatctgtctaatactgtcagtggggtgttgaagttgcccattattattgtgtggttatctaagtctttgtaggtctctaaggacttgttttatgaatctgggtgcccctattttgggtgcatacgtatttagggtagttaggtcttctgttgaattgaactctttacatgatataatgcccttctttgtcctttctgattgttgttggtttaaagtcaattttgtctgaaattagaatagcagcctctgcttttttcacttcttgtttgcttgatagatttttctccaactctttgcctttgagcctatgggtgtcatcacatgtgagaaggttctcttgaagacagcatacactcgggtcttgcttctttctccaacttgccactctgtgccttttaattagggcattcaggccatttatactcaaggttaacattgatttgtgcggatttgatcctatcatcaagttagctgattgttatacagacttgattgtgtagttgctttatagtgtcaatggtctatgtacttaagtgtgtttttgtggtagctgctaacagtctt

SEQ ID NO: 172267 - DNA, 601 bp, Human
gaaaagatcttatttctccttcacttatgaagcttaatttggctggaaatgaaattcttggttggaattgcttttgcttaagaattctgaatataggcctcaaatctcttctggcttgtagtatttctgcttataaggttcgttgttagcctgatggggttccctttataggtgacctagcccttctttctggctgcctttaacatttgttctctattttcgactttggagaatccgatgactatgtgttttggggatgatcatcttgtctggtatcctgcaggggttctctgcatttccygaatttaaatgttggcgtctgcaatgaggttggggaaattttcacggatgatatcctcaaatatgttttccaagttgctttctttctttccctttctttcagggataccaatgaatcataaatttggtctctttacataatcccatatttcttggaggttttgttcattcttttttattcttttttctttatttttgactgagttaatttggagaactggtctttgagctctgacattttttcatcagcttggtctattctgctgttaatacttgtgattgtattatgaaattcttgaag

SEQ ID NO: 172268 - DNA, 601 bp, Human
caaggttaggcatctgctgcactggaggggccaaagtgttcatgctctatattgtccacaacactccgatgggggaatgccagccaaagctctttgttggggtggtggcagcaggatccatcgtcacttttatgtgacagcagctgtggcagcatggccgtgtgcccatgtgtcagctggggtggggctccagaaggagcagggtggcagcaacctgctggcggtgcatggtagcagtacagcaggggcagggcaccagtggggatgaggttgccagtattcctgtgtgcattcatgccarcatagcaggctgcccacacatcagctgggggtatggtaggatgagcatgcactggcaggggaggagagacaaggtcttctggcatgtgtgggccagcaaagcagtgttggggggatgtggaggggtgtgaggcatgggtaagcgcatgctggcaaaatgctggggagaggctgcggttggggaggctgtggctgggggaggctgcaggtaaaccattatgcatcggtaggggctgttctgctggagccctctgatggccaggcatggtctgtcagtgcaggagctctgatgaggtgccct

SEQ ID NO: 172269 - DNA, 601 bp, Human
cagctgtctttgtgtcagctcaggtgtccgtgggggtcgtgagttccgctgctaggatgctggaggtccatggcaggagcaggccactcctcacctgttcaactgaccccagaagttgctggggaccaggaaggattcctggtgctgggcagcctcgtgtagggctcctagctttctcccccttcagcccagcatccgtgtcctccctcatccactctcaatgccttccctgcaaagacctgttcagagtgtgtgccagccttcccaatgtcctggtttctcggtcggagaggtttcttcsggctgcctctagtcagccatcttggctcccgtcttggtatagtttttgagtaacacaaagaggattatagaaagcatataaaatatttgtagaaattacatttattcttgaagaggtcatgtctaaaattagtgaaatactctttaaaacattttgttttttaggctgggcacggtggctcacgcctgtaaattccagcactttgggaggccgaggcacgtgggtctcctgaggtcaggaattcgagaccagcttgaccaatatgatgaaaccctatctctactaaaaatacaaaaatta

SEQ ID NO: 172270 - DNA, 601 bp, Human
cccgggaggcggaggttgcagtgagcggagatcgtgccattgctctccagcctgggtaacagagcgagactccagtctcaaaataaataaataaataaataaataaataaacgtcaaataaataaataaaacattttgttttttaaatgaaaataaagggtactttaaaaaaataattttaaaataagttgaattatttaaaaatgattcaatgatttattgaaccacaaaggataaaagaagtaattcatataaataagcaaactcattaattttttatcttgagcaaaatatataaatyagttacccacggtcacctgtgacctaaaaatattaaatggaaaatttcaaaagtaaataagtcataagtttaaaattgtgtatcgttccgagtagtgtgacaaaatctcactccatcctgcccaggatgtgaatcgtccctttgtccagcaggctgtctgaggcccctgcccattagtcatgtaggagccatcttggttatcagatcaacagtcatggtattgcagggcttgtgtctgagtcacccttatttatttatttagagatggaatcttgctctgtggtccaggctgcagtgcag

SEQ ID NO: 172271 - DNA, 601 bp, Human
gagggatgggaggatcttagaacacattccctgaggataagagagaattaatgtaattctcattcctgcactaagaacaatgtttaccacatcataaatactcaataagtttattgagtgaacaaaaaataaataggaaaataaaatctgtttattaactgtgtgtataaattcattagttttgtattatggacagttttgaatagagagagaaaaaacatagaatcatggagaaaatatcacaagttatcatacagatatgaacaagtttatacaagacttattacaaacatagagttcyatggaattgaagtgttattatgtgaccatttgagttactgagatgaaagacatttataaccattgcacttttaagtctataggcataaatgtagggatcccattcttaggacatgcctagcaaatgaaagtaagagtcaaatgcaacccaatgggccagagtttcctttatatattgtaaattatatatttgtgcatgtgacaataagattacacactgcaaatgatgttgaaataaaatagctcatgcttatagtccttctagtccagggtaggagaagcaattttctttcttcattat

SEQ ID NO: 172272 - DNA, 601 bp, Human
atgttgaaataaaatagctcatgcttatagtccttctagtccagggtaggagaagcaattttctttcttcattattttatcctgattcttatttttattttattttattattattattattttttttttggtgaggtggagtttcactctgtcacccaggctggagtgcagtggctcgatcttggctcactgcaacctccgccttccgggctcaagtgattaacctgcctcagcctcccgagtagctgggactacaggtatgtgccaccatgtccggctaattttttttttttttttttgkatttttagtagagacggggtttcactatgttggccaggctggtctcaaacttctgacctcaggtgatccacccaccttggcctcccaaagtggtgggattataggcatgagccaccgtgccggcctttttatcttgattcttatacactaaaggaaaatttaaaagcagctacattacactcacaattgtactgtttgttgtgttactattcacatatattttacctttttcttctattctgaatattatttttgttattttattttcgttaagcactgtcatcttcttcacaattgctg

SEQ ID NO: 172273 - DNA, 601 bp, Human
ctgggcacgttttgcaaatgagtcccttctatgaaaaacccatccctgcccctggcccttcagtatatatagatatgctcaaatttgcattgaccacaaaagttagacccttttattttgccaccctttactacaaaatgcatcctttagttctgacactgatatcatagacatcaataaacttcccttgccaaatttttgtggttgaatataaaatgacatgttttgttttatacattatttacgctcttgttgttaaaagactttttcctttctgagtttcactgcatttttttttttkgggggacagggtcttactttgttgcccaggctgaagtacagtggcacaatcacagttcactgcagccttgaactcctgggctcaaatgatcctcctgtcttagacggccattgagattacacgtgtgagctgccatgctcaggctttgctacatttttagaacaaaagtaggttaactatatcaaatccccaatcatatgtttctcttttgaattataacttaaaattatgctccagaagaaagtaggagaataaatttcatatttactaaaattaattcttaaattattgtttccaaaa

SEQ ID NO: 172274 - DNA, 601 bp, Human
gcactcctggattcaagctatcctcctgcctcagactctaagaaaaataagaaatctacatgagttaacttatgcttgactatctggtttacttatggatattaaaatggcaaccagcctgttataatctaggatgaaacagtatcccctttttattgtgaaaatagaggaaactagttagccctgcatgagataaaatgtatttggtgtaagctttcgtgagatttactggaatactttggcctggttactgtcaacacgtgtctgacaaggtcacctttgttaaatatgttgagtttgygatgctattattgcctttccaggcattcacatgaggacaaagaaggaagatttatactctgggtgataataggctcctggcaaagcccaagtcagttgaagactcactgcatctaatagagaactggaaatgtatagattaatgaagcaacctatgactttctgtgccagacttttcaccattgccgtactcttctctttcacaccctatgcctacgtttaacatgatgttcccggtgcctgggatgaactttgccttcctctttatgtagtgaattccaacttgtcctccaagatccag

SEQ ID NO: 172275 - DNA, 601 bp, Human
agtatagagaattgagattgtccagatttatcaaaagaggcaggatataaagggaaagatttaagtagctgaaaagagatttagtatcaatggaatgaagggatggtgataaagaaggtcatgctttgtgaggaaaaatgagcagatcatttatgaatagaaattctggacaataaagttgagagatgagccaaacctagactcagagtgggtgacattgcgcaagaaagacatttagccttcatgagtttcagtttccttatttgtaatttgttaataatagcttggttttgctgttccrcaggattgttgtggcactcaaatgagtcaggatgattctgacataggcagacataagcattaagaaacagtaagatgcgagttggaataaacattataatttaaatagaggaaaaatactggaaggaaatacatctgaattaactgaacttacagtagaaagaaaagattatgaatgatttttcccttgagttttctctatattccaaatcattattgaagaacatatagtaattaaaatgcattttattaaaaaaaaatcctaggtgctgagaaagtaagagtgaataaaagaaacaag

SEQ ID NO: 172276 - DNA, 601 bp, Human
acacagagggccaagggagagcagagacctatttgagcaaagtcctacatgccgtattaggtgaggatgttataggcagtggaacaggcagctgcaaagcgcataagcagaatgagctgcatgtgttcaaaaaacagaaggaaagtgagtgtggctggaacacagggagggaggacgagagtggtcggaagtgaagtcagaaagatacaccagggctcaatcatgaaggacctttgaatttacagtgaggacattggattttattctcagttcaatggcaagacataagttaataatatayatctatgcatatatagtaacacatatatgcctatatatgtgaattgctgtataattgaactgctaaatgataaaatgaactccatcataatttcctgccattaaatgatctgcccaggtctaattaatgggggaaaatgaggtcgttttatgtacagtcacgtgtcctttccagaattaggtattttaaaagtgaaagcagtttggcatcatctctccacgctaatatgttagatgattgataacatattcaaatagcatttattgagctctccacaatggggtgaagataaatgttggt

SEQ ID NO: 172277 - DNA, 601 bp, Human
tgaagtcagaaagatacaccagggctcaatcatgaaggacctttgaatttacagtgaggacattggattttattctcagttcaatggcaagacataagttaataatatatatctatgcatatatagtaacacatatatgcctatatatgtgaattgctgtataattgaactgctaaatgataaaatgaactccatcataatttcctgccattaaatgatctgcccaggtctaattaatgggggaaaatgaggtcgttttatgtacagtcacgtgtcctttccagaattaggtattttaaargtgaaagcagtttggcatcatctctccacgctaatatgttagatgattgataacatattcaaatagcatttattgagctctccacaatggggtgaagataaatgttggttgaaaacaccaggtattttgcatgccaattctggatctctgcttaatttgctgttattttcttttgcatttttttattattcaaaaataaaaaggagcaatggagcatatgaaaaatagatgttaaggagaaaatttgcagatgttaagctttgcagattttgctatagagtatttcagaatgagtatttg

SEQ ID NO: 172278 - DNA, 601 bp, Human
agtacttaaaaagcagtagttattttttctgggtaaacgttgataagtaataattattaggtcaagcaagttttcttaaaaatggcctttgagaattatacgacacacttatattcatgaattgtaaatatgtgctatttcatatttttcttaataggcattttaaattgttgtttggcctacaatgttggtctcccagaagcaaaaatattttccggtccttcaagtgaacagtttggctatgcagtgcagcagtttataaatccaaaaggcaactggtaagaatattctcttctttatkatttcagtaaaaatacaaaataaatttcatatttgacttcaattgctttttcaaattggtgcctgactgtactataaatgggtggccctcaaatatccttaaatgaacaatctttctttgagagttgacaactgcagactgatcattaatgggatggtataatggttcatttttaaaaacctggatagaaagttttctctaaatattcaaaagcaaatttataataccagttttgaccattaatacataggtaggtagattgatagaatgatagatttgtcttcatttctgatcatgtaa

SEQ ID NO: 172279 - DNA, 601 bp, Human
atccacagatgtgcctataggagaactttaaataaaaaaaaaagtttaattctataacagacatcaaagattatgtcacgtgatactttgataataacaccacctggtatttattgagtactctttccttgccaaacatgtaatacccataattactctaggagctttgcaaaattattaccccctttacaaatgagaggagtgtgactcagaaatgttaagtaattaacctaagattacagagctgataattaataaagataggggaagctaatgcaaaatgagacaaaatgttccaaaygtacatatttttgtaagtatccaagaaggagagtgacaggatgtagttggcatttataaataatatttaaattttattttaacataaactttatgaagtaagagaaactttcagaatcttgaatgaaaaattctgttagagaatttccaatgttagcatcattggctttaccatcagctgtttcctgggcaaagatgatagttaccatccatcttttcatcctatcatagacaggaatttcttgtatgaatatactcaggagccggagcacaagggttttaccctcagcttccccaccac

SEQ ID NO: 172280 - DNA, 601 bp, Human
gtgagctgagatcataccactgcagtctagccttggcaacagagggagattccatctcaaaaaaaaaactgggtcctccctacctcttcctatcccctcaaccaattctcatctgtcatggatgagcttccatgcatattggattagcttcatgaagtccatttcttcttcttggccaagaatgctattctattccaatcctctttccaaaataatcatgtctttgtcttttatgatatagccttttaaatattagccaattatcatcctttatatctctttcaaagataaaagtctcttrccattaggttgtcctggcagtgccatttaacatgccaacttcatttattcacagagtttgcttatatcttatttaattaaattaattaattaattaattaatttgagacagagtctcagtctgtcaccaaggctggaatgcagtggctcaattttggctcactgcaacctctgcctcctgggttcaagtgattctcatgcctcagcctcctgaatagctggaattataggcatgtgccaccatactaggctaatttttttttttttttttgagacggagtctcactcttttgcccaggat

SEQ ID NO: 172281 - DNA, 601 bp, Human
accaattctcatctgtcatggatgagcttccatgcatattggattagcttcatgaagtccatttcttcttcttggccaagaatgctattctattccaatcctctttccaaaataatcatgtctttgtcttttatgatatagccttttaaatattagccaattatcatcctttatatctctttcaaagataaaagtctcttaccattaggttgtcctggcagtgccatttaacatgccaacttcatttattcacagagtttgcttatatcttatttaattaaattaattaattaattaattwatttgagacagagtctcagtctgtcaccaaggctggaatgcagtggctcaattttggctcactgcaacctctgcctcctgggttcaagtgattctcatgcctcagcctcctgaatagctggaattataggcatgtgccaccatactaggctaatttttttttttttttttgagacggagtctcactcttttgcccaggatggagtgcagtagggcaatctcggctcactgcaagctccgcctcctgggttcatgccattctcctccctcagcctcccaagtagctgaaactacaagcgcc

SEQ ID NO: 172282 - DNA, 601 bp, Human
agctgaaactacaagcgcccaccaccatgcctggctaattttttatatttttagtagacacgaggtttcaccgtgttggccaggctgatctcgaactcctggcctcaagtgatcccatctcagcctcccaaagtgctgggattacaggcgtgagccaccgagcctggccctccttttattttaaattcataacataaatattccttttcttcttccattcaattttattttttactcataacttagtccagtgtttgattctataaagacattagaaatccaactgtaatatattcttacrcttttattttaactttaaatacttactgttaaaaattttataaatacttattatgctattgctgtacaattaagccatcctcagcactattaatacaggtatccaaagtggcatgtctcatctcaacaatgacaaccccccaagaggcggaggttgcagtgagccaagatcacgtcactgcactccagccggggcaacagtgagactccaactcaaaaaaaaaaaaaatctatagtaggaaggacactttaaatatctcctgatttgcttcttcgttccttcactctggatacaagtttg

SEQ ID NO: 172283 - DNA, 601 bp, Human
tcctgatttgcttcttcgttccttcactctggatacaagtttgtgtgtgcacctacaaacacatgaatacatacacacccattgtttgtgacttgcacgtgggagagatatgttgctccagaatgtctgctgtgctttaatgatctataaaaatcctccatgcctcaccaacaagtcttataattttaagctttcctctgtggtaatgtgtgaatatctgtttctggaataaagttcatttacaaaggtgactgggacttacacacacaccttcctagtatctagttgtctaagacatttrcatccatctaactccatctaaagaaggatctggggaatgctaagtggcacaagtggcaactatttattaacttgctgtgccccatatgatgggaaagcaaacagtgcttctctagaagagttctaagggaacttaatatggtaaaaagaaccagcaattttgagcaaaagggcaggggtgcagatatataggttttgctttcacttagacccttgaagtcagtttctttaaatgaaaacataaatagttatacacttgacctcacagagtgtttataaggatcaaaggagataatgcaca

SEQ ID NO: 172284 - DNA, 601 bp, Human
tcaccaacaagtcttataattttaagctttcctctgtggtaatgtgtgaatatctgtttctggaataaagttcatttacaaaggtgactgggacttacacacacaccttcctagtatctagttgtctaagacatttacatccatctaactccatctaaagaaggatctggggaatgctaagtggcacaagtggcaactatttattaacttgctgtgccccatatgatgggaaagcaaacagtgcttctctagaagagttctaagggaacttaatatggtaaaaagaaccagcaattttgarcaaaagggcaggggtgcagatatataggttttgctttcacttagacccttgaagtcagtttctttaaatgaaaacataaatagttatacacttgacctcacagagtgtttataaggatcaaaggagataatgcacataaaaaatgctttatgagctataaagcagtttacaaatgttgctattccagtttttatcattgatgaaacaaccatctgccaaagcacctagttgaaaggtactagctcatgagctttgatttgcaaaatgtgatggtcttaaaattatccccctctctccctc

SEQ ID NO: 172285 - DNA, 601 bp, Human
aaaagaaccagcaattttgagcaaaagggcaggggtgcagatatataggttttgctttcacttagacccttgaagtcagtttctttaaatgaaaacataaatagttatacacttgacctcacagagtgtttataaggatcaaaggagataatgcacataaaaaatgctttatgagctataaagcagtttacaaatgttgctattccagtttttatcattgatgaaacaaccatctgccaaagcacctagttgaaaggtactagctcatgagctttgatttgcaaaatgtgatggtcttaamattatccccctctctccctccaatagccaagaacaggaatttgtatcatcacaaggctttagggttagtattttagcttttgattttaaattcaagaaaactgcatgtcggatgagaggaagtaacataattagtttttattgattatatttcttctagtgccaaagccaatttctggaatttttatgagacagaacagtaagcttaagatgttttagcaatagtgaagtcagtggactctttatcgtgaaacggaaagatgctgaggatctagccatcccgctaactgaggagacaatg

SEQ ID NO: 172286 - DNA, 601 bp, Human
aagccaatttctggaatttttatgagacagaacagtaagcttaagatgttttagcaatagtgaagtcagtggactctttatcgtgaaacggaaagatgctgaggatctagccatcccgctaactgaggagacaatgtggaagcctaagaagtctgaggcagcataatgaggcctaaatactaaaattgcctttcaatatatgccaaagaatttaactattaaatttatgatagcagtatttccaaataaaacctaaaaaatgaaatgactctttttacctgtcttccttcttcccagagaygggcagccttcacgggtgaattctttccatcacaaattcattttatgtttaccagcagaaagcaggtaccatttagagctcaccaagcaccttgtgttgtccgtggcctggaactaaacaatataagaaacaatatttatatttatatactatagacttggaaaatttttacgtgcatgtagatacaataagtttctaatccaaagtaaaatatccccttggatggctcatagacctctcaaacttaaaatatctcacagtgaactcttgagctccccctatcgcaaaatcttgctctac

SEQ ID NO: 172287 - DNA, 601 bp, Human
tcacatcatgctgtactcaaaaccctccaatggcattctcatttccctcagctggaaagctgaggccttctattaatcattacgtacaagtcactacatgatctatcattaccagtaggactaccatctccttccactatccccctcactcattctgttccagccacagggcttttgcatttgctgttcccgcagcctagactattctgccactagagtcttaaggtttactctttaaccttcttcaagtttttacttaaatattaccttctcagtgaggccttccctgaccattccgatraagattatactgctctccaccccacactcctaactccagcctgcttatttttctcccaaagcactgatcactaccactatatggtttacttacttattacatttactgtctattttctcccactagaatgtaagctcctcaggctagaaacttttttactgatttattcactagtatatcctcagtacctagaatgaggtctggtacataataggtctggccaccacgtatagactcacagattgtatactgcacaaggcctggacacaccattcaaggaatggtgtcccctggggttgt

SEQ ID NO: 172288 - DNA, 601 bp, Human
ttgtcaggaactaggatttcaccgaggccttagggtgtgaatgaggaggagagtctgctggaaatgtttctaataaagaaggtaagcaaaggtcagtgacttctctgtagtcaccaacatgacctgtagcctacttattaatgtggttcacaatatttaagaaatgagtcatatatgatgaggaaacccttgttcttcaagagttaccaaagtggtctggttttccactattttctattgccttgtgttaagagtttaagatagcataatactgtcagagatgtatttgcatgtatctttyagggaatttcaagtgcttccacatccttcttgttaagtgccacacaactgcacagatgcttacttttctcttctttctgattaaattagaagagctgcagttttcacagaggtggtcatgatgttatgacccctcctgtgctgcaaggttatcaaatcctgaattcttagaaaaggtggtaggaggtgacagggagagtgtccagggagtgcttagttgagagaaaaaaaccaaacagtcttctcaggaagaaaatagctagttgttgcagctttgctaccagaggctctgataaaaaaa

SEQ ID NO: 172289 - DNA, 601 bp, Human
ttcaagagttaccaaagtggtctggttttccactattttctattgccttgtgttaagagtttaagatagcataatactgtcagagatgtatttgcatgtatcttttagggaatttcaagtgcttccacatccttcttgttaagtgccacacaactgcacagatgcttacttttctcttctttctgattaaattagaagagctgcagttttcacagaggtggtcatgatgttatgacccctcctgtgctgcaaggttatcaaatcctgaattcttagaaaaggtggtaggaggtgacagggrgagtgtccagggagtgcttagttgagagaaaaaaaccaaacagtcttctcaggaagaaaatagctagttgttgcagctttgctaccagaggctctgataaaaaaaaaaaaaaacagttaaattttagatcagacacacttctctgttgtttctcagcaagcctctctcgggctgtggtgaggatggttggaaatgtgcataatagaatcacctgaatttggtatttgcatttggtattgtctgaacataccctgttcctacctgtcattgggtttgtatttggtgttgtctgaacatgcc

SEQ ID NO: 172290 - DNA, 601 bp, Human
tgggtttgtatttggtgttgtctgaacatgccttgttcctacctgccattgagaacagtgtagcctaggccccacagtatggatgtaccctcccaggacagctgtgcttcgtgtccagtctgcagccccttcatatatcacacagccacacaccccttcacataagtgtggcctgactccctgtgtctggtttctaatccatgctagttctagaacccacctcatctgctaagatcattttcccaatctgggccctctgccaggacttcctgcagctaagaggaaggacactagcctaagsgttaagaacctgggcttccgcacttggttttcactagccatgggaacatgagcaagtcactcatcaatctgtgtctcagtgattccatctgtaaaatgaagtgtaaaatggggataagatcatccccggtggccaggcacagtggctcacaccagtaatcccagtgttttaggaggccaaggagggtggatcacttgaagtcaggagttccagaccagcctggccaacatgatgaaatgccatctctattaaaaaagtgcaaaagatagctgggcatagtggtacatgtctataatccca

SEQ ID NO: 172291 - DNA, 601 bp, Human
ccttcacataagtgtggcctgactccctgtgtctggtttctaatccatgctagttctagaacccacctcatctgctaagatcattttcccaatctgggccctctgccaggacttcctgcagctaagaggaaggacactagcctaagcgttaagaacctgggcttccgcacttggttttcactagccatgggaacatgagcaagtcactcatcaatctgtgtctcagtgattccatctgtaaaatgaagtgtaaaatggggataagatcatccccggtggccaggcacagtggctcacaccwgtaatcccagtgttttaggaggccaaggagggtggatcacttgaagtcaggagttccagaccagcctggccaacatgatgaaatgccatctctattaaaaaagtgcaaaagatagctgggcatagtggtacatgtctataatcccagctattcaggaggctgaggcaggagaattacttgaacccaggaagtggaggttacagtgagccaagatcatgccactgcactccagcctgagtgacaaaagacgagaccatctcaaaaataataataataatttctggcttcttctgcagatga

SEQ ID NO: 172292 - DNA, 601 bp, Human
ttcctgcagctaagaggaaggacactagcctaagcgttaagaacctgggcttccgcacttggttttcactagccatgggaacatgagcaagtcactcatcaatctgtgtctcagtgattccatctgtaaaatgaagtgtaaaatggggataagatcatccccggtggccaggcacagtggctcacaccagtaatcccagtgttttaggaggccaaggagggtggatcacttgaagtcaggagttccagaccagcctggccaacatgatgaaatgccatctctattaaaaaagtgcaaaagrtagctgggcatagtggtacatgtctataatcccagctattcaggaggctgaggcaggagaattacttgaacccaggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactataattaataggaattaattaatgaatgccaaggggcagagccacacttcctatga

SEQ ID NO: 172293 - DNA, 601 bp, Human
caggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactataattaataggaattaattaatgaatgccaaggggcagagccacacttcctatgatagttccttgctataaggtgctattttgttctctacatttactccatagtaagcttttgtttgagaaaaaaaatgccagtttggtgcgtagtagatacgcagaggctgagaaaggaacagatgacacaataacacaatggtaacagaatgtataatgcttccctctcaacttggttgatttgttttttttacatttacttggaccaaacaagcaaaaatacatgctccccagaagaacagaaataaggattttctttgggaggtggaggcgggcggatcacctgacgttaggaggttgagaccagcctggcaaacatggcaaaatcccctactaaaaatacaaaaattagccaggtgtggtggcgcgggcctg

SEQ ID NO: 172294 - DNA, 601 bp, Human
gtcgcttaaacccgggaggtggaggttgcagtgaaccaagatggtgccactgcactctagcctaggcaacagagtgagactccatctcaaaaaaaaaaaaaaaaaaaaaaaaagtaaggattttctgcttaacttttccttaatcaggaaactcttttttaaatgatagcatagaatcatccattcatttgcttgttcatttgctgttgttttttttaactcatttgttcaacaagtggttattcattgctacaggcacagaattcctagccctcatgtacctttcctctctagtgagggmtttagtcagtaggaaggcagctatggggcaatatgattttttttaatgggatgtggaaaggtcagaggctatgtaggtacttagggttacctcgagttaaaagagccgggggacttcctagaggaagtggtgtcaaacaggagatcaaactaatgagtagacattgccaggcaagaaacagcatgtatgaaggtttagaagcaacagagactctaatttgaaggagaagctaaattcgatatgactgaaatgtgatttcaggaagacacatagaaaaagccagggttagagaagaaagag

SEQ ID NO: 172295 - DNA, 601 bp, Human
cctctctagtgagggatttagtcagtaggaaggcagctatggggcaatatgattttttttaatgggatgtggaaaggtcagaggctatgtaggtacttagggttacctcgagttaaaagagccgggggacttcctagaggaagtggtgtcaaacaggagatcaaactaatgagtagacattgccaggcaagaaacagcatgtatgaaggtttagaagcaacagagactctaatttgaaggagaagctaaattcgatatgactgaaatgtgatttcaggaagacacatagaaaaagccaggkttagagaagaaagagtcagattctttcctttttacactttaagatatgtccagcatgcaaaaatcagagttaatgctgtgtaatactactatgaaatgaagacctgtacagatggagaaaatcaaggctctggaagacaattttcttggtaccgactctataagattcctaatttcttctgagctatcatgaatttgaaagacatcagatatgctcaaacacgcgttccaattctgcactggttccctcccttcattaaagtggctattgggacttactaacatccaacattcagatttc

SEQ ID NO: 172296 - DNA, 601 bp, Human
cattttcctttttccctaagtgttcatgctattctgtctgctaatacttcaggttaaaaccttcatcctttggtgtccatttttgtaaccttggaccattttaatgttttttctactggtaaactagatcatatattccaggtcatttggatttttattttacttgtcacatatatctagttttactagatttagaagacagcagtctgctttaatccttttgtatctaccgtacctcaacatggggcatatgttgtttaaatgataattataaaatatatatacagaaggctcatgaaakaattttagtttctttgatattttaacccttcccaatactgacatgaaaaaaaatggaagcaaatatgcttccgtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggatgtaaacaccaatctcatcctgtattctagatatatgcactttgttacacataaa

SEQ ID NO: 172297 - DNA, 601 bp, Human
tgtccatttttgtaaccttggaccattttaatgttttttctactggtaaactagatcatatattccaggtcatttggatttttattttacttgtcacatatatctagttttactagatttagaagacagcagtctgctttaatccttttgtatctaccgtacctcaacatggggcatatgttgtttaaatgataattataaaatatatatacagaaggctcatgaaataattttagtttctttgatattttaacccttcccaatactgacatgaaaaaaaatggaagcaaatatgcttccrtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggatgtaaacaccaatctcatcctgtattctagatatatgcactttgttacacataaagatagcttgtaatgtatttgttctgtatttttgctaagtatcctctcataaagacagttagcataaagccact

SEQ ID NO: 172298 - DNA, 601 bp, Human
ctcaacatggggcatatgttgtttaaatgataattataaaatatatatacagaaggctcatgaaataattttagtttctttgatattttaacccttcccaatactgacatgaaaaaaaatggaagcaaatatgcttccgtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaacygaaggaaggatgtaaacaccaatctcatcctgtattctagatatatgcactttgttacacataaagatagcttgtaatgtatttgttctgtatttttgctaagtatcctctcataaagacagttagcataaagccactaagataagatatctgctctctaaatgagtcaacatatgaaaatgcttagggcatagaaagcactcagcaaaggctagttgttgttcttggtttaaatttggtttcattctttagagctgtgctgaacaatacgtagccacgagccacatgtgactactgagc

SEQ ID NO: 172299 - DNA, 601 bp, Human
gcatatgttgtttaaatgataattataaaatatatatacagaaggctcatgaaataattttagtttctttgatattttaacccttcccaatactgacatgaaaaaaaatggaagcaaatatgcttccgtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggaygtaaacaccaatctcatcctgtattctagatatatgcactttgttacacataaagatagcttgtaatgtatttgttctgtatttttgctaagtatcctctcataaagacagttagcataaagccactaagataagatatctgctctctaaatgagtcaacatatgaaaatgcttagggcatagaaagcactcagcaaaggctagttgttgttcttggtttaaatttggtttcattctttagagctgtgctgaacaatacgtagccacgagccacatgtgactactgagcacttgaaatgc

SEQ ID NO: 172300 - DNA, 601 bp, Human
aaaaaaatggaagcaaatatgcttccgtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggatgtaaacaccaatctcatcctgtattctagatatatgcactttgttacacataaagatagcttgtaatgtatttgttctgtatttttgctaagtatcctctyataaagacagttagcataaagccactaagataagatatctgctctctaaatgagtcaacatatgaaaatgcttagggcatagaaagcactcagcaaaggctagttgttgttcttggtttaaatttggtttcattctttagagctgtgctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatat

SEQ ID NO: 172301 - DNA, 601 bp, Human
atcaaactgatacctgggctctttctgtgcaatcttctgtggttctaagtgtcaggtgagtgcttctgcaagaaaacccatattctctaggtgaagttctgaaggaaatgaaactaaccgaaggaaggatgtaaacaccaatctcatcctgtattctagatatatgcactttgttacacataaagatagcttgtaatgtatttgttctgtatttttgctaagtatcctctcataaagacagttagcataaagccactaagataagatatctgctctctaaatgagtcaacatatgaaaatkcttagggcatagaaagcactcagcaaaggctagttgttgttcttggtttaaatttggtttcattctttagagctgtgctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatattgcatgctagtttggatatattgagttaaataaaatatatttttaaaattaatttcacctgttgcttttt

SEQ ID NO: 172302 - DNA, 601 bp, Human
ccatattctctaggtgaagttctgaaggaaatgaaactaaccgaaggaaggatgtaaacaccaatctcatcctgtattctagatatatgcactttgttacacataaagatagcttgtaatgtatttgttctgtatttttgctaagtatcctctcataaagacagttagcataaagccactaagataagatatctgctctctaaatgagtcaacatatgaaaatgcttagggcatagaaagcactcagcaaaggctagttgttgttcttggtttaaatttggtttcattctttagagctgtsctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatattgcatgctagtttggatatattgagttaaataaaatatatttttaaaattaatttcacctgttgctttttatgttcttaatgtagctggctactagaaaatttgaaattatatatgtggctaatattcgtagcttgcattatatttc

SEQ ID NO: 172303 - DNA, 601 bp, Human; identical to SEQ ID NO: 24286

SEQ ID NO: 172304 - DNA, 601 bp, Human; identical to SEQ ID NO: 24287

SEQ ID NO: 172305 - DNA, 601 bp, Human; identical to SEQ ID NO: 24288

SEQ ID NO: 172306 - DNA, 601 bp, Human; identical to SEQ ID NO: 24289

SEQ ID NO: 172307 - DNA, 601 bp, Human; identical to SEQ ID NO: 24290

SEQ ID NO: 172308 - DNA, 601 bp, Human; identical to SEQ ID NO: 24291

SEQ ID NO: 172309 - DNA, 601 bp, Human; identical to SEQ ID NO: 24292

SEQ ID NO: 172310 - DNA, 601 bp, Human; identical to SEQ ID NO: 24293

SEQ ID NO: 172311 - DNA, 601 bp, Human; identical to SEQ ID NO: 24294

SEQ ID NO: 172312 - DNA, 601 bp, Human; identical to SEQ ID NO: 24295

SEQ ID NO: 172313 - DNA, 601 bp, Human; identical to SEQ ID NO: 24296

SEQ ID NO: 172314 - DNA, 601 bp, Human; identical to SEQ ID NO: 24297

SEQ ID NO: 172315 - DNA, 601 bp, Human; identical to SEQ ID NO: 24298

SEQ ID NO: 172316 - DNA, 601 bp, Human; identical to SEQ ID NO: 24299

SEQ ID NO: 172317 - DNA, 601 bp, Human; identical to SEQ ID NO: 24300

SEQ ID NO: 172318 - DNA, 601 bp, Human; identical to SEQ ID NO: 24301

SEQ ID NO: 172319 - DNA, 601 bp, Human; identical to SEQ ID NO: 24302

SEQ ID NO: 172320 - DNA, 601 bp, Human; identical to SEQ ID NO: 24303

SEQ ID NO: 172321 - DNA, 601 bp, Human; identical to SEQ ID NO: 24304

SEQ ID NO: 172322 - DNA, 601 bp, Human; identical to SEQ ID NO: 24305

SEQ ID NO: 172323 - DNA, 601 bp, Human; identical to SEQ ID NO: 24306

SEQ ID NO: 172324 - DNA, 601 bp, Human; identical to SEQ ID NO: 24307

SEQ ID NO: 172325 - DNA, 601 bp, Human; identical to SEQ ID NO: 24308

SEQ ID NO: 172326 - DNA, 601 bp, Human; identical to SEQ ID NO: 24309

SEQ ID NO: 172327 - DNA, 601 bp, Human; identical to SEQ ID NO: 24310

SEQ ID NO: 172328 - DNA, 601 bp, Human; identical to SEQ ID NO: 24311

SEQ ID NO: 172329 - DNA, 601 bp, Human; identical to SEQ ID NO: 24312

SEQ ID NO: 172330 - DNA, 601 bp, Human; identical to SEQ ID NO: 24313

SEQ ID NO: 172331 - DNA, 601 bp, Human; identical to SEQ ID NO: 24314

SEQ ID NO: 172332 - DNA, 601 bp, Human; identical to SEQ ID NO: 24315

SEQ ID NO: 172333 - DNA, 601 bp, Human; identical to SEQ ID NO: 24316

SEQ ID NO: 172334 - DNA, 601 bp, Human; identical to SEQ ID NO: 24317

SEQ ID NO: 172335 - DNA, 601 bp, Human; identical to SEQ ID NO: 24318

SEQ ID NO: 172336 - DNA, 601 bp, Human; identical to SEQ ID NO: 24319

SEQ ID NO: 172337 - DNA, 601 bp, Human; identical to SEQ ID NO: 24320

SEQ ID NO: 172338 - DNA, 601 bp, Human; identical to SEQ ID NO: 24321

SEQ ID NO: 172339 - DNA, 601 bp, Human; identical to SEQ ID NO: 24322

SEQ ID NO: 172340 - DNA, 601 bp, Human; identical to SEQ ID NO: 24323

SEQ ID NO: 172341 - DNA, 601 bp, Human; identical to SEQ ID NO: 24324

SEQ ID NO: 172342 - DNA, 601 bp, Human; identical to SEQ ID NO: 24325

SEQ ID NO: 172343 - DNA, 601 bp, Human; identical to SEQ ID NO: 24326

SEQ ID NO: 172344 - DNA, 601 bp, Human; identical to SEQ ID NO: 24327

SEQ ID NO: 172345 - DNA, 601 bp, Human; identical to SEQ ID NO: 24328

SEQ ID NO: 172346 - DNA, 601 bp, Human; identical to SEQ ID NO: 24329

SEQ ID NO: 172347 - DNA, 601 bp, Human; identical to SEQ ID NO: 24330

SEQ ID NO: 172348 - DNA, 601 bp, Human
tccagcatatggactttatggtttcttagcttcagctagtctgcagccctcataataagtggcttcaagggaccagtggctcacacctgtaatcccaccactttgggaggccgaggcgggtggatcatttggggtcaggagtttgagaccagcctggccaacatggtgaaaccccgtctctactaaaaatacaaaaattagccaggcggtagtggcacacatctataatcccaactacttgggaggctgaggcaggagaattgcttgagcttgggaggtggaggttgcagtgagctgaaaytgatcatgccactgcactccagtctgggcgacaaagtgataccccatctcaaaaaaaaaaaaagaaaaaaaaggtaatgatgcagcttaatggggagtgacatgactgccatttcattccagtgcctttctgtgcctcttaatgttttatctgacgggctcacattcctcagataaaaagtttcttttctttttttccccaccattaaatgtgttaggaggcatgatttgatctgaatgataaaaataagcaagtgtaaaaattaacaaaactcaattatgtgtataaatattcataatg

SEQ ID NO: 172349 - DNA, 601 bp, Human
tacactgttgaactatagggtgggtacaagttagagtgtccagcatatggactttatggtttcttagcttcagctagtctgcagccctcataataagtggcttcaagggaccagtggctcacacctgtaatcccaccactttgggaggccgaggcgggtggatcatttggggtcaggagtttgagaccagcctggccaacatggtgaaaccccgtctctactaaaaatacaaaaattagccaggcggtagtggcacacatctataatcccaactacttgggaggctgaggcaggagaattrcttgagcttgggaggtggaggttgcagtgagctgaaattgatcatgccactgcactccagtctgggcgacaaagtgataccccatctcaaaaaaaaaaaaagaaaaaaaaggtaatgatgcagcttaatggggagtgacatgactgccatttcattccagtgcctttctgtgcctcttaatgttttatctgacgggctcacattcctcagataaaaagtttcttttctttttttccccaccattaaatgtgttaggaggcatgatttgatctgaatgataaaaataagcaagtgtaaaaa

SEQ ID NO: 172350 - DNA, 601 bp, Human
cttcatattctaagctaatgacttttttcccttcaaagttatttcttgtagtccctttaaaaatgaaaaaaaagaaaaagaaaacaattaaaataaggtttttccctacaaaagaaatagcacgttaataaaaaaggaatatttttaatagtaaattaatagtaaacaagcagcataccaattcttctaaaactactttgaaatcttctaaaaacaaaatttgattaggaaaataaaacagatcttcacaaagatgagcactgattaagcaagcttactaaaaacactcacctggcaaacygggcaatattcctcttctgactaatagatacttaaaaggaaaatatttatgttcccaggactatcaagtacatttttaccttcaattttggaaaatctagaattctctctcctaacaatgacttttatcctacttttcaaaatgccttgtaatttaatataggttaatttgaaggttactaaaacaaaacaagaactaaaaaaaagtctacccaccatcatcggtaatcttggtttaaagttcagtatttcaaactcctccgttaacactgaacatggaaagcacatgctaatttctatt

SEQ ID NO: 172351 - DNA, 601 bp, Human
tcagtaaaaagtccataaatatggggggatttatctaaaaattcctgagaaaaatcaggtccacatgctaaaatgtgttattttcttaacttacctttttccatatgggcaccttggcttttaaagtatcaatggcatagctcacagcttcaagagatgcagctctgtgggctgaggacacagcaatgattatgcttgcttctgacactggaaccaagctttaacaagatgaagagaaaaaaaaatcaccatcatctctgaatctacgtgttaaagaatctgctagacagatgaaaaaaaatccaggtatgcagtcttagaattatactgtagttctattttacgtaaacatacagttagaaaagagtaattaattgcagtagcattcagcagaggcagtagatgaggctgatgctacagctaatttgttagaatctatccactaaaccctcctgatgggcaccaaggaaaatcctttcattgatagagcaaacatctgactcaacaaggcacagtgccaagtaatgcctagaaatacaaagttatgtcctaacgagtataatacaaaatttaaaataatacatatcaagtaataggagtg

SEQ ID NO: 172352 - DNA, 601 bp, Human
cgtattctaacaatgggcttcaattttattctgaaaacatggtcatcaaatttcccaggccctggttatgagtccaacttgcttatttctaccactgactgaggcaggtcccctgggaaggaggggagaagtgccctttaaaagccctggctctctgctctggtcttttcatctactgagctgttcattaactcctcagctttctgtcaaccacaacgctgtaggcaattctagacaattctagacattgaatgtgcaaccacagaacaatcccactgttaatgttactacaccaggggaraaactagggagttgggccttttcatcccatcagaatgctctatttaaccagagaattacttgcccttattgacagaaaacatgccagaagttcctatttctgtttttaaatccactcactgcattttctcagagggagcaatatctcaccatttttttttcttccctaaaaaggacctctaggaaaagcctctttcactttaaagaatttctattttagccattacctaaatagctaatgcattattctcactctccaacagaaagaccctctaattcaagggaattataatccaaggaa

SEQ ID NO: 172353 - DNA, 601 bp, Human; identical to SEQ ID NO: 21535

SEQ ID NO: 172354 - DNA, 601 bp, Human; identical to SEQ ID NO: 21536

SEQ ID NO: 172355 - DNA, 601 bp, Human; identical to SEQ ID NO: 21537

SEQ ID NO: 172356 - DNA, 601 bp, Human; identical to SEQ ID NO: 21538

SEQ ID NO: 172357 - DNA, 601 bp, Human; identical to SEQ ID NO: 21539

SEQ ID NO: 172358 - DNA, 601 bp, Human; identical to SEQ ID NO: 21540

SEQ ID NO: 172359 - DNA, 601 bp, Human; identical to SEQ ID NO: 21541

SEQ ID NO: 172360 - DNA, 601 bp, Human; identical to SEQ ID NO: 21542

SEQ ID NO: 172361 - DNA, 601 bp, Human; identical to SEQ ID NO: 21543

SEQ ID NO: 172362 - DNA, 601 bp, Human; identical to SEQ ID NO: 21544

SEQ ID NO: 172363 - DNA, 601 bp, Human
aggaacagaattcttgacactgtatagtctgcagcagtacttctccctactccagttcagccagtgtagtttactgtcagtttagtcatcctgaagcatgaatgtcaaaaggctactcctgtttgctcacaatttttagtttgaccttcagtgaactctatattttagcccctatctacatttctcgccttctttcccgctattccccaccttgcttctgccattgagtcccagtgactgattttggtgtttttttcctgggcactgctagtctctattcttagagtgctttccggcacartctctccctgtggaagatccatcagtccttcaaagtcttatctgagttttccgtaatgccttcacagtcaacatatattaagctcttattgtgtgaagattttcacagtatcctggctgaaagtgactactccgtttctgaatttatgtttctcactttgtgtcattcttctgatattgatcccagacttttctgttgtatagatacttgtataggcacctctattatgtaggtacctattatatacttcttgaagtcagaaaagatgttttgtatggctctgtatttctttcaggaaga

SEQ ID NO: 172364 - DNA, 601 bp, Human
agcagcccaacccctagagattttgattgactagatttgaggtggagctgaatgttgcaaaacctgcggccagaagtactagtcattttattttattatataagcagatttgttagaattaccttcaaaaaacaacctgggaagttcagaggtagaaaaattctattaaagcttttttattgagatgtagcatgcatataaaagaatatataaaatacatatacacagtttaatagttttaaagaataatgataaacacccatgcaaaaggactccacattctttttctttttttttttttcttgagacagtctcgctgtcacccaggctggagtgcagtggcgcaatctcagctcactgcaacttctgcctcctggattcacgccattctcctgcctcagcctcccgaatagctgggactacaggcgcccgccaccacgcccggctaattttttgtatttttagtgaagacgggctttcactgtgttagccaggattgtcttgatctcctgacctcgtgatccgcccgcctctgcctcccaaaatgctgggattacaggcatgagccaccacgcccggccaaggactccacattcttaca

SEQ ID NO: 172365 - DNA, 601 bp, Human
ctgtattatttagttttgcccatttttagatgtgcttagctgtttcatttatcaaatgagagctgaaacatatcttttaacatcatttacaatttagatgatatacttttgttaaccttcatttttttttttttttttgagacaagtctcgctttgtcgcccaggctagagtgcagtggcgcgatctcggctcactgcaagctccgtctcccgggttcacaccattctcctgcctcagcctcccaagtagctgggactacaggcgcccatgaccatgcctggctaattttttgtgtttttrgtagagacggggtttcaccatgttagccaggatagtctcgatctcctgacctcgtgatccgcctgcctcggcctccaaatttttgctttatatatattattggtagtctttcaggatttttgactagctcttttctgtctgttttctaacccagtttatttactacttcctccccctaatatttataccgtgcctgagactttatagtgaatcatagaggctattgtccctgttgttctcattcctttttacctttcttaaactcctctggtgactctccctactcatcttctcaattgg

SEQ ID NO: 172366 - DNA, 601 bp, Human
tttgcttctgattcctcttaaaaataatacagtatagcgagtgtaaatatacaactgcttttatagggcattttctctagaggcataactcattgaatctatgaggaagacaccattttataggtgaggaaagggacactggttatcacatacagtctttttgtatacagctagtaactgaccaatatggaacatgaacccaggtttttcggactccaaagttcatgctctcttccccatattacagttcctgattcccataaatttcacatcagacctcttctgttggcttactgtttgstctgttaagtttctgtgagagtacatagccttcaattcccttaaataggtaggacctccattcatgcataatagtgcagaactatcctatataaaagtaggataaagtactttctctgctatttaccagccatgtgactatgggcaacccatttgatctttctgagtctttgtgtcgttatctataaaatgggaatgaataaatgatatcatatgtgtaacagtgacttgaataacaaatgattatatcttttttatcctgcttctttgaatgttacaataatttccccatatgcatttg

SEQ ID NO: 172367 - DNA, 601 bp, Human
agttactgtgcttggctcctggtaatgatttaaaagactcggtaggattttgttctgtgaaggaacagaaacgcactccagctagctcaagaaaagagatttatgataagaatttaaagagggcttatagtaatccaagtaaaacagtgtaacagatcttgggcaattggctactctgaagtttttgttttcttctcatggcttctctcttgacccattaagcatgtttcttttttttttctttgtctttttcttcttttttaaaaaatcttttcattattgatttctgactttattacayttagagactgtaggctatatgtactgattcttcagtgtgtgagactaattttgtagccgagtacttgattggtttttgtacatgttccatatgtgcttgaaaatattcttgtgtgtgtagtgagttcaggtttccgtacatgtctgttagatcagacttgatattagcgtggattatatcttctatatagtcttttgtctacttcttttttgacctttggggagagatgttaaaatctcatattgtgacaatggatttttcttgttcttctgtcagattatttctcccctccccgcgtga

SEQ ID NO: 172368 - DNA, 601 bp, Human
gcgtaggctcccaagtagctgaggtcacaggcacatgccaccacacctggctaatttttttttcttttttttttttttttttgagagagagagagtctcgctctgtcacccaggctggagtgcagtgacacagtcttggctcactgcaacctctgcctcctggtttcaagccgttctgcctcagcctctcaagtagctgggattacaggcacacaccaacacacctggctactttttgtgtttttagcagagacagggtttcagcgcgttggccaggctagtttcaaactcctgacctcaygtgatctgcccacctcaacctctcaaagtgctgggattactaatgtgagcccccatgcctggctgctcctggctgatttttaaattttctgcagaaatgggtcttgccatgtttcccaggctggtctccaactcctgggctcaggtgatcctcccacctcggccttccaaagtgttggattacaatatgaaccaccatgcccagccctttatcaccttttttttaaaaaaggcctattttttaatgtagcccatttctatatttttaaaaatttcaatctaggagtctgtattttaacag

SEQ ID NO: 172369 - DNA, 601 bp, Human
aatttttttttcttttttttttttttttttgagagagagagagtctcgctctgtcacccaggctggagtgcagtgacacagtcttggctcactgcaacctctgcctcctggtttcaagccgttctgcctcagcctctcaagtagctgggattacaggcacacaccaacacacctggctactttttgtgtttttagcagagacagggtttcagcgcgttggccaggctagtttcaaactcctgacctcacgtgatctgcccacctcaacctctcaaagtgctgggattactaatgtgagccmccatgcctggctgctcctggctgatttttaaattttctgcagaaatgggtcttgccatgtttcccaggctggtctccaactcctgggctcaggtgatcctcccacctcggccttccaaagtgttggattacaatatgaaccaccatgcccagccctttatcaccttttttttaaaaaaggcctattttttaatgtagcccatttctatatttttaaaaatttcaatctaggagtctgtattttaacaggagaatttaatgtttttatatgtattgtaatcactgatggatttgggtttat

SEQ ID NO: 172370 - DNA, 601 bp, Human
atcaccttttttttaaaaaaggcctattttttaatgtagcccatttctatatttttaaaaatttcaatctaggagtctgtattttaacaggagaatttaatgtttttatatgtattgtaatcactgatggatttgggtttatttctactatcaagtaccaccctggttcagtcatatagacaaagatcaaggtgtagatcacaggcatgcccacttgtcatgggcttttgggtttagacgggcacatgtcttggcacaggaaacaatgtggtagattttccaagcatgtataggtcacctattccttgcaggccagtagagagattactgaagagaagatacctgccactaacttactagtgcacatgaacaattaatttaaattctgaaattttctgtttctaaaacaggtatagtacctgcctagtgcaccctatagggttattcaccaagactcagggttttgttttgtttttttcccctagctttacagctgtctttaaaatttaagtgtcagtcatgtgtttccttcatttatttacagttgatatatcagtgtcagtggtgtattcatgcttgctctgctgccccagcattatta

SEQ ID NO: 172371 - DNA, 601 bp, Human
ctcagggttttgttttgtttttttcccctagctttacagctgtctttaaaatttaagtgtcagtcatgtgtttccttcatttatttacagttgatatatcagtgtcagtggtgtattcatgcttgctctgctgccccagcattattaaaattgatggatgacccttttgcatttgtccttctttagaaatagctactatgtagtcctcgctggttattttagcttagacaccactcttgaaaattttccgagagcctggtatttgtaattagcatatctcgattaatgtggtgtctgtacygtttacttgtgacctcagtaaagttcatacctcttcagttttagttttctcatctggaaaaaccaatagcaatgcctggattatctatacctcacaggatttttgtgagcttaaagtaaataatatgtgaaggtaaggtgccttgtaagctgcaaagtgctttattaatagtaataccttagagataatgtttcctatctgttgagcatcctaaaatttagtggggttggtcttgcctatagaaaaaagctgttcactgtgctgatcatgtgttaaccacaaaatggctctccttgattc

SEQ ID NO: 172372 - DNA, 601 bp, Human
catgtgtttccttcatttatttacagttgatatatcagtgtcagtggtgtattcatgcttgctctgctgccccagcattattaaaattgatggatgacccttttgcatttgtccttctttagaaatagctactatgtagtcctcgctggttattttagcttagacaccactcttgaaaattttccgagagcctggtatttgtaattagcatatctcgattaatgtggtgtctgtactgtttacttgtgacctcagtaaagttcatacctcttcagttttagttttctcatctggaaaaacsaatagcaatgcctggattatctatacctcacaggatttttgtgagcttaaagtaaataatatgtgaaggtaaggtgccttgtaagctgcaaagtgctttattaatagtaataccttagagataatgtttcctatctgttgagcatcctaaaatttagtggggttggtcttgcctatagaaaaaagctgttcactgtgctgatcatgtgttaaccacaaaatggctctccttgattctattgtcctccatgactcaataaaagaaagttcttttccatctcagatgtcttcatagtccact

SEQ ID NO: 172373 - DNA, 601 bp, Human
tcagtggttatcttctttctttggataaagtattgttagttcagttttaactgtgtcaaagggaaagtaaaagtatatgtgtcccaaattatttatgctcaaggctttacttgacacaaaaattaataaatagctaaaaagtaataaattaaagcaataataatgtatgcccgatgaattgagtcaccagtcctctatgtaaaggtatttgttatacttgctcaggataaacttgggtgtgtgttgaagaaattctactggtttcatagctacgtggattttttttttccaagatgaagtyttgctctgttccccagggtggagtgcagtggcatagtctcagctcactgcaacctctgtctcccgggctcaagtgatcctcccacctcagcctcctgagtagctgggactacaagtgcatgccagcacagccggctatttttgtattttttgtagagacaaggtttcactttgttgcctaggctggtctcaaattcccgggctcaagcaatctgtccatcttggcctccccaagtgctgggattacatacatgagccactgcactcagccagctacatgaattttcaaccggtttaagaa

SEQ ID NO: 172374 - DNA, 601 bp, Human
gctgggcgtggtggtgggtgcctgtaatcccagctacccgggagactgaggcaggagaatcgcttgaaggcggaggttgcagtgagctgggatcgcaccactatactccagcctgggcgacagagcaagactctgtctcaaaaacaaaacaaaacaatagcaacaacaacaacaacaaaaagatactattgtgggcagtccctgtgctggagttcgaaaaatgaagactgtcccaccctacagagaagaccaatttgccacaataactataagaaaatgtaataaaaatatgtacgaagtwctaaaggtgtgtggacagggtactttctaactggagtgaatggcttataacagatttcagattgtcagtaaacctttattgagcacctgcttactgtatgccagtactatgttgtgacattcatatatgttctcgcggtaatcttagtaggtagctgctaaccccgttttccaaatgaaaaatcagtaaccagatgtggtggaatgtgcctgtagtcctagctactaggaaggctgaggtaggaggattgcttgaggctaggaattcagggctgcagtgtaccatgatcactgatgcctg

SEQ ID NO: 172375 - DNA, 601 bp, Human
ctaacacttattttgccaagaaggtttgatgactttataccaggagtgatgtacaaaatgtggcagtaaagggttttcatcagaactgggggaaagggagatgatgattaacactaaggaatcttgggaccacactgtgaagaccattgtgtgacatagtttaagggattgcttaaccctctggatatctgcattaaggagccttattcccttccccattctctaagtggggcagatttctacccttaactcagatatttgtacaataataagcctcattcaccatttaaccttttttttwttcttgcttggcctttccccctatcctttctggcttaaagtttcatttcttggagaatttgtaggagaaatagaaaaatcatgttggacttaagtgtcactatgtgaattttcagccgtagccatgaataaatcttattaaaaagtactactgagtagtattcttaagagatttttagacacaggtaggagaaagaaatcaaaattgtctgtttcacagtgcattattttacttgcaggctttcttgtaattttcttatcagattgacatttaaagtagctatatttggtcacagtagaa

SEQ ID NO: 172376 - DNA, 601 bp, Human
ataataagcctcattcaccatttaacctttttttttttcttgcttggcctttccccctatcctttctggcttaaagtttcatttcttggagaatttgtaggagaaatagaaaaatcatgttggacttaagtgtcactatgtgaattttcagccgtagccatgaataaatcttattaaaaagtactactgagtagtattcttaagagatttttagacacaggtaggagaaagaaatcaaaattgtctgtttcacagtgcattattttacttgcaggctttcttgtaattttcttatcagatygacatttaaagtagctatatttggtcacagtagaagttttgctggttatttaagtgcagtgtcactatggaggtagttgaatgaagtcaataaaagtactgcttacatagcattgatgaaagttcctctttacactttacatatgtaagcaagcatggtaaacagtggcttacgtatccttccagaaattttctgtacctctataagcctgtgtgtgtgtacatgtgtcccaattctaccagtaggattatacaatcactactgttctacaactttatttttttcatttgagggtaaatc

SEQ ID NO: 172377 - DNA, 601 bp, Human
attaagataaactagtgaggaaagttccatgagttgggaggaagaaaggaatagggatgccatttttgccgcattcttacttgctattagatttaatacctctgtaacttattccctaataaaattatcaaatgctgtattttccaactttttaagatttaaatcatatctagctttgtatttgcaaaaatactgcacttgaagacaaactatgtctttcctaagaaaatttaaattctacctatattcaaataccctcaactttaccaaattaaatttggcttatctaatgaaggatacrttattcatgctagttgtatcattgggagttcaattaggaaacataaactacacaggaatttgaacagagaaagtctaatgtaaacagtccttaactgtaacgtagaattagagtaatgggagaattggctaagaggtagaaagaactctgaagactgtggtaacagcagatagggtagtagtcactacctctaaggctatgcagagcatggaaggaaggacagatctgacattcaaacctcattggaggggcatggctgaggcctactggatgtcagagacattaactaaggggctgaaa

SEQ ID NO: 172378 - DNA, 601 bp, Human
gagggggaaagttcctttccattggagaagcctgacagactaccttagccaggttatgaaggttaaagtcaacagtgatcagtcacattgatagtatgtacccttgatatgatgtgatgaaaatggtattctttctctgtcatcttccttccaaacacttataatcccagtctaatcatgaaaaaattagacaaatttcaacacagggcatgttacaaaatacctaatcagtactcaaaactgtcaagaacatcaaaaaaggaaagcatgagaaactgttacaaccaagaggaaccttaaagaaggcctgacaattaaatgtaatatggtttcttagatgtgatcctgagacaacaaaaggacatgaggtaaaaactaagggaaaaaattagaactttaagggagttaaaggtaaagagattttataaagagtgcaggataaagaataatcccagcactttgggaggcagtcagatcacctgaagtcaggagttccagatcagcctggccaacatgatgaaaccccatctctactaaaaatacaaaaattagccaggcgtggtggcaggcacctgtaatcccagctactcagcaggctgag

SEQ ID NO: 172379 - DNA, 601 bp, Human
aagtcaacagtgatcagtcacattgatagtatgtacccttgatatgatgtgatgaaaatggtattctttctctgtcatcttccttccaaacacttataatcccagtctaatcatgaaaaaattagacaaatttcaacacagggcatgttacaaaatacctaatcagtactcaaaactgtcaagaacatcaaaaaaggaaagcatgagaaactgttacaaccaagaggaaccttaaagaaggcctgacaattaaatgtaatatggtttcttagatgtgatcctgagacaacaaaaggacatkaggtaaaaactaagggaaaaaattagaactttaagggagttaaaggtaaagagattttataaagagtgcaggataaagaataatcccagcactttgggaggcagtcagatcacctgaagtcaggagttccagatcagcctggccaacatgatgaaaccccatctctactaaaaatacaaaaattagccaggcgtggtggcaggcacctgtaatcccagctactcagcaggctgaggcaggagaagtgcttgaacccaggaggcagaggttgcagtgagctaagatcacactattgcactc

SEQ ID NO: 172380 - DNA, 601 bp, Human
ttacaaaatacctaatcagtactcaaaactgtcaagaacatcaaaaaaggaaagcatgagaaactgttacaaccaagaggaaccttaaagaaggcctgacaattaaatgtaatatggtttcttagatgtgatcctgagacaacaaaaggacatgaggtaaaaactaagggaaaaaattagaactttaagggagttaaaggtaaagagattttataaagagtgcaggataaagaataatcccagcactttgggaggcagtcagatcacctgaagtcaggagttccagatcagcctggccaamatgatgaaaccccatctctactaaaaatacaaaaattagccaggcgtggtggcaggcacctgtaatcccagctactcagcaggctgaggcaggagaagtgcttgaacccaggaggcagaggttgcagtgagctaagatcacactattgcactccagactgggcgacgagcacaactccattaaccattgtgtaaccagttaaggtgcttagtaagtagttgctgaatatatcatattattacagttcttcataagtctatttttaaggtctaggccttcagtgaggcctacttcatctag

SEQ ID NO: 172381 - DNA, 601 bp, Human
ctctgtattcccaattttcttttcccacaccactcaatatttcttgtgtttgagtaacttactgattgcactaggaattattatagacagaatcaacaagactgggaaactaacaacgtaagagtcttaagaggaatgaaagatgactcttgattagtgtattaggtttttagggccactgtgacagcttacgagcttggtggcttaaaatcacagaaagttgttctgtcacatttctggaggccagaagcctgatattaggtgtgttctctcagaaggctccagggagaatcctgccttrcctcttccagcttgtggtggctccaagcgttcattggcttctggcagcagaactgtactctctatccctgtcttcattcacttaactgtactctctatccctgtcttcattcacttaactgtactctctatccctgtcttcattcactttgctttctcccctgtgtctttgtctccttctgcctttctcctaggacacttgtcattggatttaggccccaccctaaatccaggatccttaattacatctgcaaagatcctttttccaaataaagtcacattcatggttctagggtcagga

SEQ ID NO: 172382 - DNA, 601 bp, Human
tggcgtgatctcggcttactgcagcctccgcctcctggattcaagctatttcggctaatttttatatttttagtagagacagggtttcaccatattggccaggctggtctcgaactccggacctcaagtgatctgcccacctcagcctcccaaagtgctaggattacaggcgtgagccaccacgcccagcccaattcattttttaaaatatatatttaagttttttaacttggtcaggtgagtttagttggagataatgctctcttagctgtattcatcttgaagaatcctcagtttaacrtttgtattaaaactttaaatttgcaaaatgctaccacattttatcatttgagcctcatgacattcctctgaagtaggaatgctattttttttccctagtgccttttttttttttttttttttaaaatagagatggggtctcagtatgttgcccaggctggtctttaaactccttgcctcaagtgattctcccacctccacctcccaaagtgctgggattataggtgtgagcccctggcctgtattttcattttgcaattttatacatgtggaagtggagctcagtctccataactaactt

SEQ ID NO: 172383 - DNA, 601 bp, Human
tggattcaagctatttcggctaatttttatatttttagtagagacagggtttcaccatattggccaggctggtctcgaactccggacctcaagtgatctgcccacctcagcctcccaaagtgctaggattacaggcgtgagccaccacgcccagcccaattcattttttaaaatatatatttaagttttttaacttggtcaggtgagtttagttggagataatgctctcttagctgtattcatcttgaagaatcctcagtttaacatttgtattaaaactttaaatttgcaaaatgctacyacattttatcatttgagcctcatgacattcctctgaagtaggaatgctattttttttccctagtgccttttttttttttttttttttaaaatagagatggggtctcagtatgttgcccaggctggtctttaaactccttgcctcaagtgattctcccacctccacctcccaaagtgctgggattataggtgtgagcccctggcctgtattttcattttgcaattttatacatgtggaagtggagctcagtctccataactaacttgcttgaggtcacaggttatgaaattatccagatgg

SEQ ID NO: 172384 - DNA, 601 bp, Human
tcaagtgatctgcccacctcagcctcccaaagtgctaggattacaggcgtgagccaccacgcccagcccaattcattttttaaaatatatatttaagttttttaacttggtcaggtgagtttagttggagataatgctctcttagctgtattcatcttgaagaatcctcagtttaacatttgtattaaaactttaaatttgcaaaatgctaccacattttatcatttgagcctcatgacattcctctgaagtaggaatgctattttttttccctagtgccttttttttttttttttttttwaaatagagatggggtctcagtatgttgcccaggctggtctttaaactccttgcctcaagtgattctcccacctccacctcccaaagtgctgggattataggtgtgagcccctggcctgtattttcattttgcaattttatacatgtggaagtggagctcagtctccataactaacttgcttgaggtcacaggttatgaaattatccagatggatttgaacactggtgttaaaactgtaaagcctgttgtttattaattttctgtttgaaaagggcagactttattttttcatgtttcacg

SEQ ID NO: 172385 - DNA, 601 bp, Human
ggtagagacagggtttcaccatattgcccaggctggttttgaactcctgagctcaagcagtccgcctgccacggcctcccaaggtactgggattacaggcgtgagccaccatgcctgacttgcgttttcacatattttaaattaaagctgtttggcttgtggttgtaaaaatagaatcatcactaatattgacgaatcctgcaattagtgggaagttggtttaggacaaggaaaatgaactccagtagaatacccagcacctactcgtatttcttgtgaaggactctttgccttaaaatgaccagaggacttaattagattcttgggccccacgaaagacgtgctaagtctctgggatggggcttcaggaatctgccttttttttaatttttatttttggagataaggtttcacactgtcacccaggctgtagtgcagtgggacgataacatctcagcctcctgaactcaggtgatcctccctcctcatcttccaagtagctgagactactgccatgcaccaccatacccagcttattttttgtagaggtgccatgttgcccaggctggtcacgaactcctgggctcaagcagtcactcct

SEQ ID NO: 172386 - DNA, 601 bp, Human
tagagacagggtttcaccatattgcccaggctggttttgaactcctgagctcaagcagtccgcctgccacggcctcccaaggtactgggattacaggcgtgagccaccatgcctgacttgcgttttcacatattttaaattaaagctgtttggcttgtggttgtaaaaatagaatcatcactaatattgacgaatcctgcaattagtgggaagttggtttaggacaaggaaaatgaactccagtagaatacccagcacctactcgtatttcttgtgaaggactctttgccttaaaatgacmagaggacttaattagattcttgggccccacgaaagacgtgctaagtctctgggatggggcttcaggaatctgccttttttttaatttttatttttggagataaggtttcacactgtcacccaggctgtagtgcagtgggacgataacatctcagcctcctgaactcaggtgatcctccctcctcatcttccaagtagctgagactactgccatgcaccaccatacccagcttattttttgtagaggtgccatgttgcccaggctggtcacgaactcctgggctcaagcagtcactcctcc

SEQ ID NO: 172387 - DNA, 601 bp, Human
tccaaacagggagagagggctgagatctagttttggttggtaaaggaatatagtacttctctagcattaaagaaaggataaactacatggacatctagaggaaacttcaagtgaagaagtgatccatgttggatttttgtctttgtttgtttaattaaataataatactgttaagtttttacatagtgcttcctacatgttttcagtgctttatataggttaactggtttaattctcacaactcttgttgtgaagtatgtattgttcttatcctcattttgaaaatgattgcgtgcaaagrccaagtagtttttccaaaatcacccaggtagtgcttttaaccactacacaatgctgacagttcaatcagcatctctggaggtgtgaggcctgagcatcagtttgggttgctttttgtttttgttttttgggtcttttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgttt

SEQ ID NO: 172388 - DNA, 601 bp, Human
ctgctgggaggtggaggttgtagcgagccgagatcacgccactgcactccagcctgggcaccattgagcactgagtgaacgagactccgtctgcaatcccagcacctcgggaggccgaggctggcggatcactcgcggttaggagctggagaccagcccggccaacacagcgaaaccccgtctccaccaacctttttttttttttttttggtgtggattgaaaactactaatggatagaaaatgattggggattggagctacttcacatggaatggcaaaggacggcatctgtaatgtggrgtgtctgtctacgtggagagaaagggggaggatgtgcacaggccttgttcttggtgcagaatgaaagccattggcaggagatagttttttccccccatttcaaattgggtttttatcagagatcccagcataaatttttttaaaagagtagatagttgctttttctttaattttccatttctgttggaaaagtagcaacaataacaaaaataactgtttataggggattcctttctagaagttgttttttggtaaagatttaaatccaggctttctattcgtcctccttttgaaaaaaaa

SEQ ID NO: 172389 - DNA, 601 bp, Human
gaacgagactccgtctgcaatcccagcacctcgggaggccgaggctggcggatcactcgcggttaggagctggagaccagcccggccaacacagcgaaaccccgtctccaccaacctttttttttttttttttggtgtggattgaaaactactaatggatagaaaatgattggggattggagctacttcacatggaatggcaaaggacggcatctgtaatgtggagtgtctgtctacgtggagagaaagggggaggatgtgcacaggccttgttcttggtgcagaatgaaagccattggcrggagatagttttttccccccatttcaaattgggtttttatcagagatcccagcataaatttttttaaaagagtagatagttgctttttctttaattttccatttctgttggaaaagtagcaacaataacaaaaataactgtttataggggattcctttctagaagttgttttttggtaaagatttaaatccaggctttctattcgtcctccttttgaaaaaaaaaaaaagttttggaatttgccagcctttactcaaaagccatttttgtttgttctcattctgtttaattctgtgatta

SEQ ID NO: 172390 - DNA, 601 bp, Human
gagaccagcccggccaacacagcgaaaccccgtctccaccaacctttttttttttttttttggtgtggattgaaaactactaatggatagaaaatgattggggattggagctacttcacatggaatggcaaaggacggcatctgtaatgtggagtgtctgtctacgtggagagaaagggggaggatgtgcacaggccttgttcttggtgcagaatgaaagccattggcaggagatagttttttccccccatttcaaattgggtttttatcagagatcccagcataaatttttttaaaagastagatagttgctttttctttaattttccatttctgttggaaaagtagcaacaataacaaaaataactgtttataggggattcctttctagaagttgttttttggtaaagatttaaatccaggctttctattcgtcctccttttgaaaaaaaaaaaaagttttggaatttgccagcctttactcaaaagccatttttgtttgttctcattctgtttaattctgtgattaaataacaaacatgggctatgtctcagtcttttttttgctgattcctctttacatgtggcttatcttcatcct

SEQ ID NO: 172391 - DNA, 601 bp, Human
tttttgctgattcctctttacatgtggcttatcttcatcctgaatgtctttcttgaaatctgtactcacatattcacttgtctactcagctttgtctcttgggtgactaatagacatctcaactcaaaataaccaaactggaactgatgatctgtccactctcaatctgctctacctacatctcccatctcactgaactttctgtttgatcaggcaaaacattggatcattcttaacacacttctctttctcaaaaaattcacactgtcaacacattctcttggctctgcctcacaaattaaatttgaactacccccaatgcaaccaccctggtccaagtcaccatttctagccttattgagaaagctccttactggttcacggttttttttgtcttttttttttttgaggcagggtctcactccatcatccaggctgaagtgcagtggtgtgatctcggctcgctgcaacctccacctcccaggttcaagcgatcctcccacctcagcccccatgtaactgggactaaggtgtgcaccaccatgcctggctaagttttttgtattttttttgtagagacagggtttcaccatgtagtcca

SEQ ID NO: 172392 - DNA, 601 bp, Human
gcttaaagtgtaaacagacatagtaatagtgttttactattgatggtagcaacaaacatttgttgaattcttttttgaaactttactatgtgccagacactgttttaagacttacagtggattaacttatttaatgttctcaagtatcctattagataggtgttattaacctacttcttacaggttaggaaactgaggcactaaaaagataactacagatggtctctgtcttttgatggtttgacttagcaatttttcaactttacagtggtgcaaaagtgacattcagtagaaactgtayttcagattttgatcttttatttttactatttttattttattttagagacagggtcttgcttgtcactcaggctcgaatacaatggctcagtcatagctcactgcaacctcaaactcctaggctcaagcaatcctctgtccttagcctcttgagtagctaggactacaagatgtgctaccatgccttgattttttttttttttttttttttttggagacagagccttgctgtgtcgcccaaactggagttcagtggcacgatctcggctcactgcagcttccacttctcgggtttaagcaa

SEQ ID NO: 172393 - DNA, 601 bp, Human
aattgtatctgcattttagcaaacattttcacagtggtttacaaaataggttagaaaggctgaaggcagaaagatctggttcttagtgagaaccagaactagagcactgatgattcagaggagggtagagcatggaatttatgaagacttgcagagagaattgatgagattggtgaaccattagagctggatgatgaaagaagtggagtaattaaggatgattccaggtttcttttaagtatgatctattgggaaacaattccagagattaggaaatactgaaggagaagctgtgttttgktcttttctatcatgggtagggtgaatcacaggttgattgggaggatgatgaacaagagaatgaaaaagaatgaattcggttccgtaagtttgagttttggagctgaaggtattgaagtgtaaatgtttagtaggcagttggaaataattggagtgaagttaaggtggtggatttgataatcactgactaatttatagaagtaggttgaggaccagcctggcaacatggtgaaaccccatttctactaaaatacaaaaaattagctgggcttggtggtatacgctggtagtcccagctact

SEQ ID NO: 172394 - DNA, 601 bp, Human
tgagccgagattgcgccactgcactccagcctgggcgacagagcgagactccgtctcaaaaaaaaaaagaaagaaaaaagaaataggttgaggccacgggactggattcgtcctctcaaatgaaaagtaatgaaaggcagagtggagagtgttgaggaagacctccagtattttcagggttatatggaagaagaggagttggttgtcatagaattaagacatcaaggagataattgtagcctgacaaagccagaagagattattttcaaggaggttgtaggcagatacattatatagatayagtttatggacacaaatatatttgtcttcaataaattgtgctgggaaaactggatagccatgtgcaggaataaattagacctctgtctctcaccatatagaaaaatcagctcaaagtggatgaaagactttggtctttcaaaactagacccaaaactgtaaaactactagaagaaaatattgggaaaatgcttcaggacattggtcaaggcaaagatattatggataagtcttcaaaagcacaaaaagcaaacaaaaaggcaacaaaagcaaaatagacaaatgggattatatcaaacta

SEQ ID NO: 172395 - DNA, 601 bp, Human
atgttgggaaatggccattgtcaataactccaaagttcatataccattcaggagagcagagattctctttaactcaatttgaagtttcctagggacgagagttcattggctcaatttggttcaggctcacttatctcttgttctgtccactcttttcatgggcccagaatcacttttgtacaacatggtttccaaattggtagtcgtaggagcaatctgggtgagtagtcatacatagccactaccagaattccctcacacctagctattctatttagtcatcatgtccttatcttttgtsccctgtaatgatcagttctctactctgtttataaaccattgactcctgagctcatgattcttctcagtctgcctctcttgctttctctcttacttttccctaacacgtatagacactatgtgccgtcaagtctttgctgcttgctactccctgaatacttagtactttttcataccctcaatctttctcttctcagaggatgccattgcttgacatctctgcttattacagttcttttctgaacaactgtccatatcccaaaccatagctcccatttaaaggaggtaagatttgtatacc

SEQ ID NO: 172396 - DNA, 601 bp, Human
acacccagtacacattcataaaatggattgttttttgttggggtcatagtccagccatggctttagcaacagtctgttattaaagaacaaagatggtagctaacatgaactatttttttaaattgaaattttattttagatcctataaagtgaatgtaaatgtgctctatacattcactatgcagagtctcaatatttaagatgtttcaggatatttgaggtaatgatacttaaaaaaattatctgaagcaaacagaatatttaggatcataaaactgttctgagcatactgataggtgcktaatgttcattgtcgataatgataattacattgtttttactgaaaaccattttttaaagtgaaagccgacccagttgctcttcctctggaagaggaagagtaaaggggtgcttcttgccactaccacttatgtagagttgcatatatacattgaaagggtattcagtaccaccattcattcagtcaagctaaatacaggccagtagaagcagtattgttaatgcatgtttttgccttcattggcccaaggcctacttaacatttttgacacccatcacagcaatttatctttcagagata

SEQ ID NO: 172397 - DNA, 601 bp, Human
ttgtcgataatgataattacattgtttttactgaaaaccattttttaaagtgaaagccgacccagttgctcttcctctggaagaggaagagtaaaggggtgcttcttgccactaccacttatgtagagttgcatatatacattgaaagggtattcagtaccaccattcattcagtcaagctaaatacaggccagtagaagcagtattgttaatgcatgtttttgccttcattggcccaaggcctacttaacatttttgacacccatcacagcaatttatctttcagagataaaaaaaaaaatagcagattattatcacatatttttaaaaagaacattagaatttttggtaaaataagtagtaagacagtatcttgactctgctgcatacttgcttttgctggatgactaaatgagggtgaaaaatttaaggttggtttatgactaagaaggtattaaatgatagaaaagagaaaataaaagaccgtaaaagtttttaaaagcctctatacaaatattctttaacctttgactatctttgagtcatagaaacagtttataaatagcttcatggacacaattcagaaggtacagactagagc

SEQ ID NO: 172398 - DNA, 601 bp, Human
tcactatgttagccaggatggtctcgatctcctgacctcgtgatccacccgcctcggcctcccaaagtgctgggattacaggcgtgagccaccatgcctggccctctgtagctgatttttaaaatgtgaaagtattttcctctcagaatatgatcattgtgaaaatgttgtaaaaatctggagaaagttaaattccctatataactttggccctccagcaaccactgagtggtgtatgtttggtgtgtgttagtgccttctaaagcttttaaatgtattcctaaacacacacacaaagctrttctaatttgcactttccccactgatgtatcaaagtgcgcattcctcctcatccttgcttctactgcagctcattcagtttttaatgtttgtaaattagagtcaaaaaaatttttactttttcgttcttttttagtgaggctgagcatttttcgtatgtttaagaactatttatcttctctttgattttacttgttatatatctttgtcttttttttgtttgctactttgaattattaagggataactagtttttttgtttttttgttttttaactcaaatctactgtggcttcctagcc

SEQ ID NO: 172399 - DNA, 601 bp, Human
ttatcttctctttgattttacttgttatatatctttgtcttttttttgtttgctactttgaattattaagggataactagtttttttgtttttttgttttttaactcaaatctactgtggcttcctagccttgctgtatgcaaaaattacatacaatgtcctaaatattcttctgtaactataaatttgcattctatttggtatgtggtcatgtatatcattttctttttttaaattttattttagatatgggggtacatgtgcatgtttgttacatgagtatattgtgtactggtggacrttgggcttctagcatacccgttaacccaaatagtgaacgtggttctcaataggtaacttttcatcccttacccccttcccaaactccacttttttggagttcccagtatctgttatttccatctttatgtctgtctgtacccattgtttagctcctactttataagcaagaacacgcagtatttgattttttgagttagttcactgaggataatggccttcagctccatccctgctgctgcaaaagacacgatttcattcttttttatggctgctatgtctttctttaatccctatatag

SEQ ID NO: 172400 - DNA, 601 bp, Human
cgatctcctgaccttgtgatccacctgccttggcctctcacatctttttttctatttcatgaggcaatatcatactgtggtagttattgcaactttgtagtgtacttcataccaattggtgttctttctttcctaagttttcttgatcatccttgtgcatttgttcttccagatggaactttgccaagttgcaagatttttagtgaggcttttaaatttgaaaatagttttattcaatacatgggctaatttggagataatttatgtttttacagcattgattacctgtttatacacatartatatgttttcacttattcagactttcttaaatgctgttcagtaaaattttatggttttgttcatataggccttatgcttttttaagtttggagattgtatagattttgttgttattgtaagtaaatttttttcatcattgttaaattattttgcatgttctaggtagactttttagtcctatctgtaagttacaattttttcctaagccaaaatctgtttctcttaattttattactctaatttttgaccaaagtctctagaataatttccaaattgaaaatattataatatttttctc

SEQ ID NO: 172401 - DNA, 601 bp, Human
agtatggtgtttgctgttttgttttacatagaaaattgaggacattactttttgtatctagttttcctttatttctagaattaggaaaaatcaggccaccttccctcaagtctccattttgaacttctgcagtgtctaggtttcaggaacaggaatgggggataggagtccatatgttaccatgctggtaaggaaggctgtttgctctacacctagctgtgctctctgcttagcaccccacctagtacctcagcagcctagaagttctagccttgacattacaaggaggcctgaatgggcrtgccccagccttacctaggtaaggagccacattctgcctctgcacatatctgtaccagtgattacctggctctgacagatggctctttctcacagggtctcatcattagtcatgcggatggtagtttagacattctagtgcataatatggaataataataattatacctaacatattaaatactatgtgccaggcattgttctattttatatgtaatcatccttttaatcttaaaaaaaaatctcatgagataggtattatgaataccattttacagatgagaaaactaagacaaagaag

SEQ ID NO: 172402 - DNA, 601 bp, Human
tccctcaagtctccattttgaacttctgcagtgtctaggtttcaggaacaggaatgggggataggagtccatatgttaccatgctggtaaggaaggctgtttgctctacacctagctgtgctctctgcttagcaccccacctagtacctcagcagcctagaagttctagccttgacattacaaggaggcctgaatgggcgtgccccagccttacctaggtaaggagccacattctgcctctgcacatatctgtaccagtgattacctggctctgacagatggctctttctcacagggtcttatcattagtcatgcggatggtagtttagacattctagtgcataatatggaataataataattatacctaacatattaaatactatgtgccaggcattgttctattttatatgtaatcatccttttaatcttaaaaaaaaatctcatgagataggtattatgaataccattttacagatgagaaaactaagacaaagaaggggcttaataacttgcacagggtcacacaaccaagtagatattgattatgaatgctcagtaaatgatgcaaggatgataacgattggagacaattagaaag

SEQ ID NO: 172403 - DNA, 601 bp, Human
ttgatctgtatattacctagcatagcatgtcttggaagtaaacattctgtttttaatccttgaaagtgagatatattcccactaattttgtaacaaatcatttcctactctatttaggtgtagagttcggtgctcgaatgataactattgatgggaaacagataaaacttcagatatgggatacggtaagtataggaaaagtgcactgtatgatctcagtaaagttactttatgaaagtacatcgtatatttgttttaatgttattatatgcctgttatggtttgttagacactgacttcstgcagccatgagatgaaatgtggtgctggagtagactggtttttcttatgcactgttttcaatagatgggccctgggtgttggtgttagtgagcatatctgagtgaatgttcacgttatgtggtctaaattgaaatgctctagaaactgtatttttaagaaaaacaatcagcatgtctcaagtacacataggaagtaaaataagaatatcaatattatacaataacttattcttcaggcttattattttaaatgttttagtcctaacaacttgaagtcacgttgctcttaattcagtatc

SEQ ID NO: 172404 - DNA, 601 bp, Human
attacctagcatagcatgtcttggaagtaaacattctgtttttaatccttgaaagtgagatatattcccactaattttgtaacaaatcatttcctactctatttaggtgtagagttcggtgctcgaatgataactattgatgggaaacagataaaacttcagatatgggatacggtaagtataggaaaagtgcactgtatgatctcagtaaagttactttatgaaagtacatcgtatatttgttttaatgttattatatgcctgttatggtttgttagacactgacttcctgcagccatgmgatgaaatgtggtgctggagtagactggtttttcttatgcactgttttcaatagatgggccctgggtgttggtgttagtgagcatatctgagtgaatgttcacgttatgtggtctaaattgaaatgctctagaaactgtatttttaagaaaaacaatcagcatgtctcaagtacacataggaagtaaaataagaatatcaatattatacaataacttattcttcaggcttattattttaaatgttttagtcctaacaacttgaagtcacgttgctcttaattcagtatcctaattctgtc

SEQ ID NO: 172405 - DNA, 601 bp, Human
ccagtcactcagtcttagtttctcacttgtcatgtgtagtagccattgaaagaaggaaccttagagaacatccggtctcacagactggattccctagaccaagcaagttgctgaaggctgctgtgggacctgggtttcctgatacttcctatgtgtcacagttttcccttaaatgataaccgtacatctctgtcttgccttgtccttgaattgtccactcgactctgggttcttgtgtttttttgcctcttcttcctcagtgaagagtcatacttttactatttctcaaggatttcccacrtgagcctaaagcatctcaaaacatttgatttacattctctcaggcagcatctcaaaactgcatggaaaagaggaaaataaaatacacaaagtcccttttttcctagagatttaaaattaataatctccaaccaaaaagaaacattttctacttctgtattaaaagaggttctctcttcttgttttggagacagggtctcactctgtcacccaggctgtagtgcagtggcacaatcatagctcgctgcagcctcgagctcctgggctcaagcagtcctcccacttcagtctcctgaatagc

SEQ ID NO: 172406 - DNA, 601 bp, Human
ttagtttattcacttgttcttctattcttaaagtagtcccttaaataatctttgttttttgaaacttgagtaagccattcatttcctagttgtctgttttgtagattaactcgtcatacatcattttgatagaagcctggttttttgtgggttttcttgtttttgtttttgcttgagttgatttctttgcacaacaataaacttgcaaaagaaatctaaaataatttcttatgctggacagtatgagaaaggaagagaagaaaaacccttgtttgtgttcctctaggagggtagagggctmgttttctttcctctatttctgagagagatggtggtccgtttaaagacatcataacatcccagaaagaattcgaccacttccagcttctacatggagagctcccagacccaatggcctgttccagatttaaaggactgtttaaaatagtttaacttatttcttttggaggttgtttcttgagtctttgtcttacaggttttcctcttttgtttttgtttttttgggggtttttttttttttttttggttttgagacagcgtcttactctgtcgcccaggcttgagtgtagtggcatgatca

SEQ ID NO: 172407 - DNA, 601 bp, Human
cccttaaataatctttgttttttgaaacttgagtaagccattcatttcctagttgtctgttttgtagattaactcgtcatacatcattttgatagaagcctggttttttgtgggttttcttgtttttgtttttgcttgagttgatttctttgcacaacaataaacttgcaaaagaaatctaaaataatttcttatgctggacagtatgagaaaggaagagaagaaaaacccttgtttgtgttcctctaggagggtagagggctcgttttctttcctctatttctgagagagatggtggtcygtttaaagacatcataacatcccagaaagaattcgaccacttccagcttctacatggagagctcccagacccaatggcctgttccagatttaaaggactgtttaaaatagtttaacttatttcttttggaggttgtttcttgagtctttgtcttacaggttttcctcttttgtttttgtttttttgggggtttttttttttttttttggttttgagacagcgtcttactctgtcgcccaggcttgagtgtagtggcatgatcacagctcactgcagcctcaaacgcctggcctcaagcaa

SEQ ID NO: 172408 - DNA, 601 bp, Human
gagaaaggaagagaagaaaaacccttgtttgtgttcctctaggagggtagagggctcgttttctttcctctatttctgagagagatggtggtccgtttaaagacatcataacatcccagaaagaattcgaccacttccagcttctacatggagagctcccagacccaatggcctgttccagatttaaaggactgtttaaaatagtttaacttatttcttttggaggttgtttcttgagtctttgtcttacaggttttcctcttttgtttttgtttttttgggggtttttttttttttttttggttttgagacagcgtcttactctgtcgcccaggcttgagtgtagtggcatgatcacagctcactgcagcctcaaacgcctggcctcaagcaatcctcccacgtcagcctcttgagtagctgggactacacatgcatgccaccacatgcagctaattttcaaaattttttgtagagatggagtcttgttatgtttcccaggctggtcaggcttttctcttattttcattgactttcttcttactttcatacccaacttccaaaactttttaataaatgtaacctaatacacattaagatt

SEQ ID NO: 172409 - DNA, 601 bp, Human
tggtccgtttaaagacatcataacatcccagaaagaattcgaccacttccagcttctacatggagagctcccagacccaatggcctgttccagatttaaaggactgtttaaaatagtttaacttatttcttttggaggttgtttcttgagtctttgtcttacaggttttcctcttttgtttttgtttttttgggggtttttttttttttttttggttttgagacagcgtcttactctgtcgcccaggcttgagtgtagtggcatgatcacagctcactgcagcctcaaacgcctggcctcragcaatcctcccacgtcagcctcttgagtagctgggactacacatgcatgccaccacatgcagctaattttcaaaattttttgtagagatggagtcttgttatgtttcccaggctggtcaggcttttctcttattttcattgactttcttcttactttcatacccaacttccaaaactttttaataaatgtaacctaatacacattaagattggtctcacacttagtttatatctgagtgaaacgggattttccatagcattaatgttttacagtgtgtctgtacatttggatagccggt

SEQ ID NO: 172410 - DNA, 601 bp, Human
aggcttgagtgtagtggcatgatcacagctcactgcagcctcaaacgcctggcctcaagcaatcctcccacgtcagcctcttgagtagctgggactacacatgcatgccaccacatgcagctaattttcaaaattttttgtagagatggagtcttgttatgtttcccaggctggtcaggcttttctcttattttcattgactttcttcttactttcatacccaacttccaaaactttttaataaatgtaacctaatacacattaagattggtctcacacttagtttatatctgagtgaaaygggattttccatagcattaatgttttacagtgtgtctgtacatttggatagccggttgcatttttggtagcaagggttatgtctattcatgacccaagatgtttacaaaaccatcctagagtccttcaagggaaaattagccaaatgttattatttgttttatcagccttatagaaatgaagagttttcttagtatcttaggatatttgtctttttttttttttttttttttgagacggtgtttcactcttgctgcccaggctgtagtgcaatggtgcaatctcagctcaccgcaacctc

SEQ ID NO: 172411 - DNA, 601 bp, Human
aatacacattaagattggtctcacacttagtttatatctgagtgaaacgggattttccatagcattaatgttttacagtgtgtctgtacatttggatagccggttgcatttttggtagcaagggttatgtctattcatgacccaagatgtttacaaaaccatcctagagtccttcaagggaaaattagccaaatgttattatttgttttatcagccttatagaaatgaagagttttcttagtatcttaggatatttgtctttttttttttttttttttttgagacggtgtttcactcttgytgcccaggctgtagtgcaatggtgcaatctcagctcaccgcaacctccgcctcccgggttcaagcgattctcttgcctcagcctcccaagtagctggaattacaggcatgcaccaccacgcccggctaattttgtatttttagtagagacggggtttctccatgttggtcaggctggtcccgaactcccgacctcaggtgatccacgcctcagcctcccaaagtgctgggattataggtgtgagccactgcacctggcctacaggatgtttgtcatttttatcttcaaaaaatttaagga

SEQ ID NO: 172412 - DNA, 601 bp, Human
ttgtcatttttatcttcaaaaaatttaaggagttttccttgcaagattttcacatccaccacctttgctttcttttgccagtagtgagaatagctgctagcagatactccttggaggcatgaaggccatcaatcagtttcacagctggaaacagtgataagagtctatcagtgcctccctttaagcactgacacttggccctttactgagttacttttctttcatttattaaaagccaaagccaaactgtaaatattcttttctgccaggggaagtcaaagaagaaacatacgttgccccyggtttctgttcattggcagaaaaaaggcagaggtgtgttctcactgttagaccctggccagccattactgccttgttctgctcttgttctttttctcttactttttctcttgccttctattcctctttcagttgccttccagcatatccaaatacatttgatttcccagcccctccaaaaaaaattgtaatatggatgttttagttaagttcatttatccactcagcttccctagaaatattcctattttacatgtcttatatcaagtaagtcagtgaaacttttgaccaaattgtgtga

SEQ ID NO: 172413 - DNA, 601 bp, Human
tgttctcactgttagaccctggccagccattactgccttgttctgctcttgttctttttctcttactttttctcttgccttctattcctctttcagttgccttccagcatatccaaatacatttgatttcccagcccctccaaaaaaaattgtaatatggatgttttagttaagttcatttatccactcagcttccctagaaatattcctattttacatgtcttatatcaagtaagtcagtgaaacttttgaccaaattgtgtgaaaactaacatgctaaaagtttcttctcagcaaatcrcaggcattttttttctcctttgaaaaacatgttactttatactcttgacgtattatttctaaaaattgaatattattttgtttcaatgcatcagtaaggatggatgaccagatgcagtgagccagggagaggacctggaaccctgagggctgaaaacaatactgcctccccacttctgcctttcctctctgctcccattactgtcacttcctccctctcccccaccatcccttaagctgggagttgaggggcttagagctccaactgttcttcctccttaggcagcaattcatcaacatt

SEQ ID NO: 172414 - DNA, 601 bp, Human
atctttttttttttcttgttttttgaggcaggatcttgccctgttgcccaggctggagtgcagtggtgtgatcacagctcaccacagcctccacctcccaggctcaagtgatcctctcacctcagcttccccagtacctgggactacaggcactcgccaccactcccagctaatttttttttttaattttgtagagatgggattttgccatgttcccaaggctggtcagaaactcctgggctcaagcaatctgcccaccttggcctcccaaagtgctgggattacagcgtgagccactgcrcccagctaagccttttttccaaagtaaatatcctcaaattttttaaagcattcaacttgtgctgttttttctaggtatttccacccattgttacttttctcaggatcccacaactaactagtgcaggttgactttttcaccacccttgctgtgtacactaagacagcctaaaaatcactttgattcttactgatcttactgtcacctggaatagaagttttgtacatgcatgtagatttcaaaatatttcctctcaattatagcagttccttgatagaggtctaaatttttttttttttt

SEQ ID NO: 172415 - DNA, 601 bp, Human
ctcccaggttcacgccattctcctgcctcagcttcccgagtagctgggactacaggtgcccgccaccaagcccggctaattttttgcatttttagtagagacagggtttcactgtgttagccaggatggtctcgatctcttgacttcgtaatatgcctgccttggcctcccaaagtgctgggattacaggcgtgagccaccgcgcctggccctaggttaacatttttgtttcacttaaaacaatataggtcaatccgagtttggataggtatatattaaagcaccttttttttttttttttgagacagtctcactctgttgcccaggctggagtgcaatggcatgatctcggctcattgtaacctccgcctcctggcttcaagtgattctcctgccccagcctcccaagtagctgagattacaggtgtgcgccaccacacccggctaatttttgtattttttagtagagatggggtttcaccagttggtcaggctggtctcaaacgcctgacctcgtgatctgcctgtctcggcctcccaaagtgctgagattacaggcgtgagccactgcgaccagcctaaagtgctttttaaaaatcaa

SEQ ID NO: 172416 - DNA, 601 bp, Human
tgcctgccttggcctcccaaagtgctgggattacaggcgtgagccaccgcgcctggccctaggttaacatttttgtttcacttaaaacaatataggtcaatccgagtttggataggtatatattaaagcaccttttttttttttttttgagacagtctcactctgttgcccaggctggagtgcaatggcatgatctcggctcattgtaacctccgcctcctggcttcaagtgattctcctgccccagcctcccaagtagctgagattacaggtgtgcgccaccacacccggctaatttttrtattttttagtagagatggggtttcaccagttggtcaggctggtctcaaacgcctgacctcgtgatctgcctgtctcggcctcccaaagtgctgagattacaggcgtgagccactgcgaccagcctaaagtgctttttaaaaatcaaattactttgctttaatacgtcaaggtagttaacctttgggctaactttatgcagttagttgttatataacagtttatttatagttagagaagccataataaaaaaaaaaacttcactgggcaagatttatttcaaggctaccaataccattat

SEQ ID NO: 172417 - DNA, 601 bp, Human
ttgcccaggctggagtgcaatggcatgatctcggctcattgtaacctccgcctcctggcttcaagtgattctcctgccccagcctcccaagtagctgagattacaggtgtgcgccaccacacccggctaatttttgtattttttagtagagatggggtttcaccagttggtcaggctggtctcaaacgcctgacctcgtgatctgcctgtctcggcctcccaaagtgctgagattacaggcgtgagccactgcgaccagcctaaagtgctttttaaaaatcaaattactttgctttaataygtcaaggtagttaacctttgggctaactttatgcagttagttgttatataacagtttatttatagttagagaagccataataaaaaaaaaaacttcactgggcaagatttatttcaaggctaccaataccattatcaaagagaataggccagagttgtgatagttttcagataagtaaggtctcaagaatttgtaaactattctgaacactcatctttatttattataaagtaatcgtagatcttaagatgcatagctacagtcatagtcttcagtgggaattgtgtttttttatttgct

SEQ ID NO: 172418 - DNA, 601 bp, Human
aggcgtgagccactgcgaccagcctaaagtgctttttaaaaatcaaattactttgctttaatacgtcaaggtagttaacctttgggctaactttatgcagttagttgttatataacagtttatttatagttagagaagccataataaaaaaaaaaacttcactgggcaagatttatttcaaggctaccaataccattatcaaagagaataggccagagttgtgatagttttcagataagtaaggtctcaagaatttgtaaactattctgaacactcatctttatttattataaagtaatcrtagatcttaagatgcatagctacagtcatagtcttcagtgggaattgtgtttttttatttgctcgagcttttgtttaattttgtagtgggcagaagtctagattcaaatgtattgtgtaagttatttccatattggaacgtgttttgttctttgcaaaacagttcagaaggaatgagaatggttataaaagtttgcttttctccttttcctaaatttattttgtcttttactctttactatctcttatctaggctctaaactggaagttgtggatcttatagtagtacttttctagcaat

SEQ ID NO: 172419 - DNA, 601 bp, Human
ttcttgtctctctttatgcactccttccctacctgctcttattctgtatatgaataatatgaaaatgtagaggacattgtattaaaggaaactctccaaccttttttttcgttacaggcagggcaagaatcctttcgttccatcacaaggtcgtattacagaggtgcagcaggagctttactagtttacgatattacacggtgagaacttgaaaactttgcaattcagtagttgatacagagaatttttctaaatagatgtggttaacagtaatgaaagaatagcttagcctttctgcccyggctactcacctttaaaactgcatcttgagtccaatttaaatttactacagaaacctgcaactgaattgtttttcttatttgaattagcaccttcaaattgaaatcggccatattatttattcattggaattttctaaagtgtgattacatttaatttataaactgaaatacaatcagtgaactctaaacccagatatggtgcttaaaactacttctcgttacataagtggatatggctaaaagtggttctctttaaaaatatgtatattgttcgttgtatactgagggaaatgctttga

SEQ ID NO: 172420 - DNA, 601 bp, Human
gctaggcaccattctttttgttttgttttgttttgttttgttttgttttgttttgtttgagacagggactcactctgttacccaggctagagtgcagtggtgtgatcatagctcactgcagcttggcctcccgggctcaagggaatcctcctgcctcagcctccaaagtggctgagactgtaggcatgcacaaccacagctagtttatctttttatttcttataaagaaagggtctcactttgttgcccaggctggtctcaggctcctaacctcaagtgattctcccacctgggcctccaraagtactgggattataggcataagccaccacacccggcccattcattctttagggttatattaataaaatactctgaagagatgctgtttttagataggtaaaatcatgacttatatgataatgaagacatctcaaaacttttatctcattaattaacaagataaggaaactggtaagatatttcagccagttcaaaagggaactcaaattactatacattgataatcaaataaagaaactgaaatgaatttacaagatggatgcaaaactgaacagtattcacagggtattaattgtat

SEQ ID NO: 172421 - DNA, 601 bp, Human
gattcatatatatatgatatattaattttttgacagagatgctaatttagttgaagaaggggtaatctttttcatcaaatggtgctgaaacagttaatagtcatatgtaaaaatatgaacctcaactgttacattataccatttacaaaaattaactggaagtggatcatagacctaagtgtgagagctaaaactacttaaaatttctaaaagaaaacaaattgtagtgaccctgttttggcaaacatttcttaaatgggacagagaaaagcatgaacttatagttcagaaaaaaaatcartaaattgttctttaactgaatttaaaacttttgttcttcaaaagacggttacactattatacaacatcgtgacatggttaatgatgatatagtgcattctggaaaaatgctgaaagagtggatgttaagtgttctcaccacaaaaaacgataactgtgagataatgcaaattagctagattaaccattccacagtgtatatatactttaaaacaatatgttgtacatgataaatatatgcaattttacctatcaatttaaataaataaatttgaagaaaaacggttacaaaaatgaaaag

SEQ ID NO: 172422 - DNA, 601 bp, Human
tcaaaagacggttacactattatacaacatcgtgacatggttaatgatgatatagtgcattctggaaaaatgctgaaagagtggatgttaagtgttctcaccacaaaaaacgataactgtgagataatgcaaattagctagattaaccattccacagtgtatatatactttaaaacaatatgttgtacatgataaatatatgcaattttacctatcaatttaaataaataaatttgaagaaaaacggttacaaaaatgaaaagacaagctacagactagcagaaaatatttgtgaaaaatrtatctgacaaaggatttatatctagaatatatgaagaatgcttataattcattaataagaagacatccactttttaaaaatgatctaaagatttgaaccagcaattactacagaagatatactactgatgggaacgtaaaatgatacaatcactttggaaaacaatttggtagtttctttagaaattaaaaggccgaggcgggaggattgcttcagcctaggagtttgagaccagcctgggcaatgtagggagacttcttctatacaaaaataagaaattttttaaaaaagtagctgaac

SEQ ID NO: 172423 - DNA, 601 bp, Human
atgaagaatgcttataattcattaataagaagacatccactttttaaaaatgatctaaagatttgaaccagcaattactacagaagatatactactgatgggaacgtaaaatgatacaatcactttggaaaacaatttggtagtttctttagaaattaaaaggccgaggcgggaggattgcttcagcctaggagtttgagaccagcctgggcaatgtagggagacttcttctatacaaaaataagaaattttttaaaaaagtagctgaacatggtggtacatacttgtagtcccagctacyccagaggctgaggtggtaggatcacttaagcctgagaggtcaaggctgcagtgagccatgatcatgccactgtattccagcctaggccacagagcaagaccctgtctcaaaaaaaagaaataaagcacacatctatatttcctagccactttactcccagatgtttacccaacataaatatgtcttcatgtgtccacagaattatgtacaaatattcataccagctttatttctaatagccccaaactggaaacaacccaaatatcaattaacagatgaatcgaaaaatagtgatacagc

SEQ ID NO: 172424 - DNA, 601 bp, Human
taagtacaacttcttttatgtctgttacacctcaaaaaagctataatgtaaaacatcgttatactgtatagattttagagtgttgttttaatagaaattgagatttgctattaagagaaaatattacctaagtgatatttacattataaaaagctaaacattgtttacttctttgtgtagagaagaaactattatcatattctctgaaggcctttcttgggtattcttttccacatttaaatcatctcactaaacctttttaaggttataaagctattggagggaagttttagtctttctrtgatggaaatagttattctgtcattcaaggtatgaaataataagaggagaatacttggaaaataaagagaatttttatccttttattttaccaattttttccttgtggctgaaacatgatgagtgacagcttactggtggcttaaatttggtcaccgaccactaggagctgatagttcaaatgtgagaagaaataaacaaagcatagtatgtaaacgagatgtttctgatgatcgtaggtgggtgacctttaaaatcaggagtataacgaacaagaaagaacagagagaaataaatgaga

SEQ ID NO: 172425 - DNA, 601 bp, Human
tatatataatacatatatatataatgcttattgtaacattgtttgtaataatgaaaaattataaataactttgccttatagagaatttaagttgtattgcattcattcagtagactgtaattcaccagtttaaaaacaaactagatctgcatgtattatatggataaatttgaaaaacatagtgttgaccaaagttaacaagttgtaaaacagtagctacatctgaatttttaaagacatgaaaaagaaatactatttatggttataaacatgaggataaatgcaaaaacatgcatgagartgaaaacaccaaatttaggtagtggttacctttagggtaagagggaggagagtgggatcagagacacacaggtggtgattctgctgttgctgattttatttcttaaagggaaagaaacctgaaatctggcaaataatatgtcaaggctagctggaagtatgtggacattatattatacatcttttttcatgtataaacatgtaataataaataatatataaaaagtaataaatataataataaagttttttaactttaaaaataaaacacgctttaaaagcaactgctacctcccctccc

SEQ ID NO: 172426 - DNA, 601 bp, Human
aaacaccaaatttaggtagtggttacctttagggtaagagggaggagagtgggatcagagacacacaggtggtgattctgctgttgctgattttatttcttaaagggaaagaaacctgaaatctggcaaataatatgtcaaggctagctggaagtatgtggacattatattatacatcttttttcatgtataaacatgtaataataaataatatataaaaagtaataaatataataataaagttttttaactttaaaaataaaacacgctttaaaagcaactgctacctcccctccccccsactaataaaattctagtatgataaaaatgaataccctgctttcattggaaatttctagcttacactttctctctcactccgtttctccttttctgtctctctctactccttctccctccctccctccctctctctctctgtctatatcaattttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatg

SEQ ID NO: 172427 - DNA, 601 bp, Human
ctttcattggaaatttctagcttacactttctctctcactccgtttctccttttctgtctctctctactccttctccctccctccctccctctctctctctgtctatatcaattttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatggaggagaatagtatagtcctgctctttcaaattatgttragcaaaatggctttcttctctgggaatgcactgtactcaaagatataaggtattagactagaggctcccttaagttacggctagttctaacgttctaaaactctaacacagaatctttcttctgttggattgttagttctttgaaactagacagtgtgttctaaatactaaccctcataataccctgaataatacagttagtatgttaaaaattaattaaaagaatggtcatcacaactttgaattccatggtacactttccacaaatgcttctgtttgtaccatgttgattagtaatgt

SEQ ID NO: 172428 - DNA, 601 bp, Human
tgtctatatcaattttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatggaggagaatagtatagtcctgctctttcaaattatgttaagcaaaatggctttcttctctgggaatgcactgtactcaaagatataaggtattagactagaggctcccttaagttacggctagttctaacgttctaaarctctaacacagaatctttcttctgttggattgttagttctttgaaactagacagtgtgttctaaatactaaccctcataataccctgaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatgg

SEQ ID NO: 172429 - DNA, 601 bp, Human
gtactcaaagatataaggtattggacttcttcgtgttgcatggtagggaaatcttttttgtgttgcatgggagggaaacaaggaaccacactaatgaaatttggaaatgtttcaagacagcagaacgtttgtagctatttatatccacttctgcttatttttttaattttatttatttttttaactgtcaatatattaccacatcaccacttctgcttaaagtattctattattgctgtgtaacattttacaaagcatgagaattctgtttcatctattgatgaaatttgtattatttcakttatttccattgatgaacctgaactattggaacttttctgaacacagtgtattcttttatgctctatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcac

SEQ ID NO: 172430 - DNA, 601 bp, Human
gcatgggagggaaacaaggaaccacactaatgaaatttggaaatgtttcaagacagcagaacgtttgtagctatttatatccacttctgcttatttttttaattttatttatttttttaactgtcaatatattaccacatcaccacttctgcttaaagtattctattattgctgtgtaacattttacaaagcatgagaattctgtttcatctattgatgaaatttgtattatttcagttatttccattgatgaacctgaactattggaacttttctgaacacagtgtattcttttatgctstatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaa

SEQ ID NO: 172431 - DNA, 601 bp, Human
cagaacgtttgtagctatttatatccacttctgcttatttttttaattttatttatttttttaactgtcaatatattaccacatcaccacttctgcttaaagtattctattattgctgtgtaacattttacaaagcatgagaattctgtttcatctattgatgaaatttgtattatttcagttatttccattgatgaacctgaactattggaacttttctgaacacagtgtattcttttatgctctatgtgtttgtgtttggaggtagtatgtatatacatattataaatagatgattacrtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttg

SEQ ID NO: 172432 - DNA, 601 bp, Human
acagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgtcaccaggtgatttcatcgtcacgtgaccatcatagagtgtacttacataagcctagatggcatagcctactactgcacctactacacacttcycttagtagaccttggtgccagaggaatgacacagtgatgatttcccttggttttctttttgccacatacccgagactgggtgctagagaaacaggcaacctagaaaggtcaacaggcacagaaaaagaaagtcttctagccagagaaccaggaaataggcaggtcagaacagtgttcgcaagccagaacactcttagaaagtaaccattctactgtagccaaacatcacagaaaaaattgtggctctgcttccacaatccccaggcagtaatgaagtagcaccctaccaccaccatttcc

SEQ ID NO: 172433 - DNA, 601 bp, Human
aataagacccagagtctcataacatagtatctaaaatacccatgtttcaatagaaaatcattcatcatacctagaaccaggaagatcttaaattgaatgaaaaaaagataataggtgccaacagtgaaatgacagtggtgtttgaattatcttacaaagattttaatgcagcaatcattaaaatgcctcaacaaacaaggaacatgcttgaaacagaagagtcttagcaaacaaacaatctgagcaaaagaaatgcaagataaaaaaaagaaccaaataggaattttaaaataaaaaaaaatacaataattgaaattttaaaactctttcaaagctctttgtacactagaaaaaaaaacttagtgaatggactcaacagcagaatggagataaaggaaagaaatagtgaactggatgatagaacaatagtaactacttagtctaaactgcagagagaaaattgaggaaacaaatgaacactacctcagggacttataggactgtaacaaaagctgacgttatatgatgcatcataagtcctagaaggagaggaaaaaggaatggctctgaaaaatactcaaagaaataatggctgaaaact

SEQ ID NO: 172434 - DNA, 601 bp, Human
aggaaacaaatgaacactacctcagggacttataggactgtaacaaaagctgacgttatatgatgcatcataagtcctagaaggagaggaaaaaggaatggctctgaaaaatactcaaagaaataatggctgaaaacttcttaaatgtggcaaaaagtatataaacctacagattgaagacagccccaaagaggttaaacccagacaaatccacatgatgacgaacctctgtatggtcaaatttctgaacgtgaaagacagaaaaaaaaatcttgaaagcagcaaaaaatagcaccctacrtataggggaaaaacagttctaatgatagcagatttctcatcagaaaccatggaggacagagaaaatagcacagtgatttttgtttgtttgtttgtttttattatactttaagttctaggttacatgtgcacaacgagcaggtttgttacctaggtatatatgtgccatgttggtttgctgcacccaccaagtaatcatttacattgggtatttctcctaatgctatccctcccccagcccttcaacccccaacaggccccggtgtgtgatgttccctgccctgtgtccaagtgttctcat

SEQ ID NO: 172435 - DNA, 601 bp, Human
aatattaaagataagagcagagattaattaagttgaaaacaaaaatcagtgaaacaaagagctggattttttaaaaacttcagtaaaattggcagacctctagcaaaactgacagaaaaggtgcaagttaccaattatcagtaacaaaacagaagctatcactacagattctccagacataaaagaggtaattagggaatgctgtgaatagctttacccacataaatgtgacaacttagatgaaatagaccagtttatccaaaaacacaaattgctacacccagccagtatgaaaaagttwatttgagcctgggcaacatggtgaaaccctgtctctactgaaaatacaaaaagtagctgggcgtggtagcaggagcctgtaatcccggctactcgggaggctcaggcaggaaaatcgcttgaacccaggaggcagaggttgcagtgagccgagaggcaccattgcactccagcctgggcaacaagagtgaaactacgtctcacaaaaaagaaaaaaattgaatagccctataaactacaacggaaattgaattcatagttttaaaactccccaaaaacgaaacctctaggtccaaatggt

SEQ ID NO: 172436 - DNA, 601 bp, Human
caaaactgacagaaaaggtgcaagttaccaattatcagtaacaaaacagaagctatcactacagattctccagacataaaagaggtaattagggaatgctgtgaatagctttacccacataaatgtgacaacttagatgaaatagaccagtttatccaaaaacacaaattgctacacccagccagtatgaaaaagttaatttgagcctgggcaacatggtgaaaccctgtctctactgaaaatacaaaaagtagctgggcgtggtagcaggagcctgtaatcccggctactcgggaggctmaggcaggaaaatcgcttgaacccaggaggcagaggttgcagtgagccgagaggcaccattgcactccagcctgggcaacaagagtgaaactacgtctcacaaaaaagaaaaaaattgaatagccctataaactacaacggaaattgaattcatagttttaaaactccccaaaaacgaaacctctaggtccaaatggtttcactgcggagttctaccagacgtttaaaaaaggaatgaacaccaattctagaccatcttttgcagaaaatagatgtaacacttccctatttattttataaa

SEQ ID NO: 172437 - DNA, 601 bp, Human
ggcaacatggtgaaaccctgtctctactgaaaatacaaaaagtagctgggcgtggtagcaggagcctgtaatcccggctactcgggaggctcaggcaggaaaatcgcttgaacccaggaggcagaggttgcagtgagccgagaggcaccattgcactccagcctgggcaacaagagtgaaactacgtctcacaaaaaagaaaaaaattgaatagccctataaactacaacggaaattgaattcatagttttaaaactccccaaaaacgaaacctctaggtccaaatggtttcactgcggarttctaccagacgtttaaaaaaggaatgaacaccaattctagaccatcttttgcagaaaatagatgtaacacttccctatttattttataaaactgattttactctgacactaaaaccaaagacaatacaaaaaaaggaaaagtacaaaccaatagcctttataaatatataagcaaaactcctcaacaaaataccagaaaatagaatttcaacaatatacgaaattgtgtatgtgtacgtttataaagtatatacatcatggccacatggggtttattccagggatgcaaggcttgctct

SEQ ID NO: 172438 - DNA, 601 bp, Human
taggaacaaagcagtaatgtctcttctcaacattaatcaacatattgatggaagttctagccagtgcagtaaagcaaaaaaaaaaaaaaaaaaaaaaaaaagaaaaggcatacaactaagaaaggaagaaataaaaagtgttctatttgtggatgatgtaattgtctcagtaggaaatctcaagggatttgcaacaaaaaaaagtgagttcagcaaggttgcaggatacaaggtagacataaaaatcaatcgtatttctatgttttagccatgaaaacatgaacaccaaaactcaaaatayatcatttttaagcacacaaaaaataaaatgaaatacttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaac

SEQ ID NO: 172439 - DNA, 601 bp, Human
caaaaaataaaatgaaatacttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacarcttagcaaaggagaataaaatgggatggatccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagt

SEQ ID NO: 172440 - DNA, 601 bp, Human
acttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacaacttagcaaaggagaatamaatgggatggatccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagttaaatgtaaaatatgaac

SEQ ID NO: 172441 - DNA, 601 bp, Human
gaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacaacttagcaaaggagaataaaatgggatgratccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagttaaatgtaaaatatgaacatatttatct

SEQ ID NO: 172442 - DNA, 601 bp, Human
aacctatacacagatgttcatagtagttttattcagaatggccaaaaactggaaacaggctagagacattgggttgaaggacactttagtggctgcatggttacagtgtggtccatctataccatggaatactactcaacaataagaagggggaaactacagatactatacagcaatctggataaatctggagagaactatgcttagtgaatcaagccattctcaaaaggttgatcctgtattatcccatctgtgtaactttcttgaaatgataaaaatttttgtaacaatgtactaatamtgtagttttgtatgaagtcactactggggggaaactacataaatgttacacgggattcttctgtattatttcttacacctgcatgtgaatctgtaattatcttaaaacaaaaagtttaatcaaaaaataactgtgtacatccaacttaaactgattgagtcctttaacaccatgatgacagttttaaaaatgagaattcatcaggaagaagcctcctaaccacaataaaatactaatgttagaatatggaatatggctatagaagcttgttggtattttatgaattcttgaagaatacag

SEQ ID NO: 172443 - DNA, 601 bp, Human
gtcactactggggggaaactacataaatgttacacgggattcttctgtattatttcttacacctgcatgtgaatctgtaattatcttaaaacaaaaagtttaatcaaaaaataactgtgtacatccaacttaaactgattgagtcctttaacaccatgatgacagttttaaaaatgagaattcatcaggaagaagcctcctaaccacaataaaatactaatgttagaatatggaatatggctatagaagcttgttggtattttatgaattcttgaagaatacagattttcaaattactagctttttggctctgtatgttgcgtttctgcacagggcaaacttttatacaaatagttccctccatatatgtttagcatatgcctagcaaataataattaatgttgagatttttattatgcatagactttattttctttctttttttttttgagatggagtgtcgctctcacccagttgggaatgcattggcacaatctcaactcgctgcaaccttcacctcccaggttcaggcacttctcccacctcagcctcctgagtagatgggactacaggcatgtgccaccacgcctggctaattttt

SEQ ID NO: 172444 - DNA, 601 bp, Human
tcactactggggggaaactacataaatgttacacgggattcttctgtattatttcttacacctgcatgtgaatctgtaattatcttaaaacaaaaagtttaatcaaaaaataactgtgtacatccaacttaaactgattgagtcctttaacaccatgatgacagttttaaaaatgagaattcatcaggaagaagcctcctaaccacaataaaatactaatgttagaatatggaatatggctatagaagcttgttggtattttatgaattcttgaagaatacagattttcaaattactagaattttggctctgtatgttgcgtttctgcacagggcaaacttttatacaaatagttccctccatatatgtttagcatatgcctagcaaataataattaatgttgagatttttattatgcatagactttattttctttctttttttttttgagatggagtgtcgctctcacccagttgggaatgcattggcacaatctcaactcgctgcaaccttcacctcccaggttcaggcacttctcccacctcagcctcctgagtagatgggactacaggcatgtgccaccacgcctggctaatttttg

SEQ ID NO: 172445 - DNA, 601 bp, Human
taacaccatgatgacagttttaaaaatgagaattcatcaggaagaagcctcctaaccacaataaaatactaatgttagaatatggaatatggctatagaagcttgttggtattttatgaattcttgaagaatacagattttcaaattactagatttttggctctgtatgttgcgtttctgcacagggcaaacttttatacaaatagttccctccatatatgtttagcatatgcctagcaaataataattaatgttgagatttttattatgcatagactttattttctttctttttttttttgagatggagtgtcgctctcacccagttgggaatgcattggcacaatctcaactcgctgcaaccttcacctcccaggttcaggcacttctcccacctcagcctcctgagtagatgggactacaggcatgtgccaccacgcctggctaatttttgtacttctagtagaaacaaggtttcactatgttgcccaggctagtctcaaactcctaaactcaaatgatccgcctgctgtggcctcccaaagtgctgggattataggcatgagctgccatgcccagcatattatgcatagactctctt

SEQ ID NO: 172446 - DNA, 601 bp, Human
tccatatatgtttagcatatgcctagcaaataataattaatgttgagatttttattatgcatagactttattttctttctttttttttttgagatggagtgtcgctctcacccagttgggaatgcattggcacaatctcaactcgctgcaaccttcacctcccaggttcaggcacttctcccacctcagcctcctgagtagatgggactacaggcatgtgccaccacgcctggctaatttttgtacttctagtagaaacaaggtttcactatgttgcccaggctagtctcaaactcctaarctcaaatgatccgcctgctgtggcctcccaaagtgctgggattataggcatgagctgccatgcccagcatattatgcatagactctcttaattacatttctcagaagcagctaaagatgaaattgtactaatatggaataagaaagtcctggttagaagaaaaaccgcattcattcacaatgtccacatgacagatttttaagtaaaaggcatttttaggacaatacacttttattcattagcttatttttctacatcatgtatatcaaagcattttggtaggctcacaatgaagttgat

SEQ ID NO: 172447 - DNA, 601 bp, Human
gggagcagtttcttatgagtggtttaacaccataccgcttggtgcagttcttgtgatagttctaatgagatctgattgtttaaaagcatgtagtacctcccacctctttctctttctcctgctgtggtcacgtgaagtgcctcgctccccctttgccttgtgccatgattgtaagtttcctgaggcctccccagaagctgagcagataccactatcatgcttcctgtacagcctgcagaaccatgatacaattaaacttcttttctttataaattacccagtctcaggtatttctttatarcagcgggagaaaggactaatacagaaaattggtactgaggagtggggctttgttataaagatacctcaaaatgtggaaacaactttggaactgggtaatgagcagaggttggaagagtgtggagggctcagaagatgaggaaaaatttggaacttcttagagactgcttgaattgtgaccaaaatgctgataatgatgtggacaatgaaacccaggctgaggaggtctcagatggagattagaaaattattggggactggagcaaaggtcacttttgttatgctttagcaaggaagctgg

SEQ ID NO: 172448 - DNA, 601 bp, Human
gtggtttaacaccataccgcttggtgcagttcttgtgatagttctaatgagatctgattgtttaaaagcatgtagtacctcccacctctttctctttctcctgctgtggtcacgtgaagtgcctcgctccccctttgccttgtgccatgattgtaagtttcctgaggcctccccagaagctgagcagataccactatcatgcttcctgtacagcctgcagaaccatgatacaattaaacttcttttctttataaattacccagtctcaggtatttctttatagcagcgggagaaaggactratacagaaaattggtactgaggagtggggctttgttataaagatacctcaaaatgtggaaacaactttggaactgggtaatgagcagaggttggaagagtgtggagggctcagaagatgaggaaaaatttggaacttcttagagactgcttgaattgtgaccaaaatgctgataatgatgtggacaatgaaacccaggctgaggaggtctcagatggagattagaaaattattggggactggagcaaaggtcacttttgttatgctttagcaaggaagctggctgcgttgtgcccctgcc

SEQ ID NO: 172449 - DNA, 601 bp, Human
caaatgctaatagccatgacaatggggagaaggcctggaaggcatttcagagacttcacaggagcccctccctcacaggctcagaggcctaggaaggaagaatggttttgtaggtcagggccagggtcagggccccaccaccctgcacagcctcaggacactactccctgcatcccagccactttagttccagctgtagctcaaaggggcccaggaagagctcgggacactgtttcagagggtgctagccacaagccttggtagcttccatgtggtggtaagcctgtgggtgcacagagtycaagagttgaggcttggaaacctctgcctagatttcagagaatgtatggaaaactttggatgttcaggcagaagcctactgcaggggtggagccctcacagagcacctcttctagggcagtgcagagggaaaatgtaggcttggtgctccacatagagtccccactggggcaccacctagtgcagctgtgagaagatgaccacgtcctccagaccccagaatggtagatacaccaacagtttgcacccatcacttggaaaagccacaggcactcagtgccagccagtgagagcagtggtg

SEQ ID NO: 172450 - DNA, 601 bp, Human
acctagtgcagctgtgagaagatgaccacgtcctccagaccccagaatggtagatacaccaacagtttgcacccatcacttggaaaagccacaggcactcagtgccagccagtgagagcagtggtggggtctgaaccctgcaaagccacagtggtggagctgcccaaggccttgggagcacacccatcacacccctgtgccctggacgtgggacatggagtcaaaagattattttggagctttaagatttgatgactgccctgctgggttttgaacttgtatggcacctatagcccctttyttttggccaatttttcgtttttggaatgggagtatttacccaatgcctgtgtccccattgtatcttgaaagtagctaactatttattttacaggctcataggcaaaagggactaatacatatatacatatatatatataatgcttcatttcaagctgggggtggtggctcacgcctataatcccagcactttgggaggccaagacgggcagatcacctgaggtcaggagttcgagaccagcttgaccaatatggtgaaacctcatctgtactaaaaatacaaaaattagccgggcgtggt

SEQ ID NO: 172451 - DNA, 601 bp, Human
tcctcccatttcctcagagatgttattgcttcaaaccatctcattatattcaccctttccttctctattgattcttggctcccagcatgtaattaagtttcaaccatcttataaaatcctttcactccatttctcctggatgtttttccttctggcttctattaagagctgtctccatttccttgttctttttctcacctgtcttcatagtctgacttcttccaccacggccaaggtcatcctggtcttcctaaaagccacaactaacaaatacttttctgggtttttgtttgtttgttttttttggtatttatttttacttttagaaaaagtttattataaaaaagtaattgcatgaaagaaagcttgcaaaatagagaataagtaaaagaataataaaaacatatcatgcataatatgtaaaggctagaagaaaatacaccaaaatgttaacagtaatgatgactgtataggcgcccaaaaagcaagaattatacctttttttttctgcttttctgttcttagcttaaacagtcctttgggaatatttgatacttttgactactcttcagtaaacttctttcttagctccatgacaccg

SEQ ID NO: 172452 - DNA, 601 bp, Human
atcattgcacttgtttgtcatgtcggcccaccaaaaggattgagttctttaaagacacagactcttttcatttctgcaacccccacatggtagataacaaaagtttggatgagtaagtatgtatttgcttcaaccatgttcttcttccttcagtctttcattctggttatgctttggtcccatttgttacatgtaggtagaattctgtcctaaaccttatctttgcccaagcattttaaaacatgagattttagaaaatccaggtgaggctgggtatggtagctcacacctatactcccarcacttagggaggccaaggtgggcagatcacttgaggccaggagtttgagaccagcctggcccgcatggcaaaacctcatctctacaaaaaaataaaaaattagccaggcatggtgggacacgcctgctgtactcccagctatgaggtaggaggatcacttgagctcaggagggcaaggcttcagtgagctgagatcatgccactgcactccagccggggcaacaaagggagaccctgtgtctcaaaaaaaaaaaaaaaaaaaaaaatccagacaagcaaattggcctctcatcaggtgct

SEQ ID NO: 172453 - DNA, 601 bp, Human
acctttctttcttgggtcattgctctggactcctcagtctccctgtggccagtatcgcccccttgtgattcattctctaaactctcctctgattttgtccctcccctgcttcctaccttttcagggttcctctgcctatagggccacatctctaactttatctcacgttcctggccgtcctcagcttccaacagaattgaacttaaaatctgctcctctgtccagaatgcccttcttcccctcagttttcctaatatatgagtgggagcttacctgtctttcaggccttcacttgcagggyttttctctctcagaagtggtcatgctaccttattcatctaagcaactgaaggtttttcttctatgttcgcatattggatgcatatctatcctatataccacatccttgagatgtaaggtattcatatttatctgagtgtcctcagtgcctggtacaaatcaagcactcaggaaatgcttattaaatggaagaactaaattgctaaggaattaaacatttttgtgttacctctgacagaaagtaggaacaggaaattctttttttaattgaaaacattttaatatttacttttgaatataa

SEQ ID NO: 172454 - DNA, 601 bp, Human
cagagaggctaagcactggttccagagcaacacagctggtaagaagtggtactggggtttgatcctggagagcctggttctagagccctcagtaattctgttcattttaaaggtctaacttcatcccacaaatacagattttcttgaaagcaaaataaagttaacattaattttcttatttgtttacatacttagaatttcttttaagaaatagtgaaaacctttgtaaatcagtatagtgactgtcccatagtaaatacttagtatatattgattattattaacttaggcaaatggatamctgtaatgttcatagcattgacttttagcagttgagaagaaaagccacattttagctacctcatatttctcagttctaagagaaaactaaaagtcgcttgtttacaagataccctgctctgtagcatctgttcaagatatttaaactgtccaaaatactggtcttacctaatttttatcatgccaccaggtggcagcatgttatgtaaggaagtaatttaaatattctattgaagatcatttattttcaatattttgccttaaaaactgcccaaccataataaaaaataaaatagtatct

SEQ ID NO: 172455 - DNA, 601 bp, Human
gtgtatttactgaatgtttatttgaattagaacatatttatagtcttttgtggttacggttgtttcaactgtgcaatcgaagtccctgaaattttgccttaagtttaggtattatcagtatcattcagattaactgctgccaaacactgaaagattagtgtttgaggtggaaagcaagagaatgaatggctaaggaagaaaaggaaggtaaaggactgaatgtggcagttaaagtctgggggaaaggaaaggctagtggtaaaatgagagaggcaggcttcttttactgcaacagagcacgggccacatggggaagcaggaggaccaccaaattcagttggctgcagagaaatctgtttatacttcataatcgtggatctgcctagacattgcttgtttcatggtgcaaacagtgaaatcattgaaacaaatgaaatcatttgacatcagtttgttaacaaatattttttcctattctaaaacctattagttttgcctactgcttgtcccttaatgaagtcttaaaagagcttgcccctaaagagatgtacataagcaaaaagaaaccagcaatttcatgtaagcccaccttaccctgtag

SEQ ID NO: 172456 - DNA, 601 bp, Human
agattgaacgaccaagtaatgtagcattatccaaagattatttgttatatttcagttgtaatggagttaattgcatgcctttcagataaaaaaatactgtatgtacatccttaattcatctggtacaactatgtttaaaagtgcttaataaagtattcagtactatttaggtaataaaattagtagtgacttacttaattttatgtagcatcactttcttaagcctgtttttaaagtgatttattaccagacgggcaaaaaggcaatttttatgcaaattgacacatttaataataacttktgtagtataaaagtgcttgtttgtatgaagttataactcacttatggggccttgtagttctatgtaacattctagtgaaatgtgcacatgtggatgctcttggaagcacttccagccctgtgaatttatgtatctgttgacttcaatattaggtagcttgatttctaaagccatcacagtaattgacatgttattggaaataaagttaagtttttccttatttatagggataacctcaattttgaagaatgtgaatcaattcatacttggctgaaagccagttccctcttcagtttagct

SEQ ID NO: 172457 - DNA, 601 bp, Human
tatgcagtttacataattgaaatgtgtttttctctgtgtgctgttctcatattccaatattcttttttcctctcatggtcatgatgttttcttttgagatataattcacataccataaaattgatgcttttaaactatacaattcgttagctgggtgtggcagcacacacctgtagtcccagctactcaggaggctgaagtgagaggatcacttgaactgggaggcagaggttgcagtgaaccgagattgcgccgctgcactccatcctaggcgacagggtgagcccctgtctcaaaaatraataaataaacaattcagtggtttttagtctattcacaaagttacacaaccatcaccactatctaattccagaacattttagttaccccaaaaagaaacctcatactcattagcattctctcccctttttctcttccatctagcttctggcaaccagtaatctactttctgtctccatggatttgcctattctagacatttcgtacaaatggagttgtagtattgtggcgttttgtgtctgccttctttcatttagcacagtgttttcaaggttcatccacattgtagcatgaatcagta

SEQ ID NO: 172458 - DNA, 601 bp, Human
gtagagcaacactttgtctatggaaatggattaaagtaagtggccctatccattcattgcaagcaatgcaaaataatataaatcccccaaagagaaaagaaaatccacttttatccacatgaccatatggtgtcatctgctttgggaataatgttctggtatataaatgcatgtactatgtactaatgcaagatgctctctctgttatctggcaggaaagagggaaataccaaatttggaaattactcccaatatagcatagcatgttttcaggagactaaattcatatatatatatatawaattggcatttggcatagggttttttgtaatgttattttgatcctgttttggtcaacatgattaggataaaatgtaaagctttgaagcatctaattcagagtgttcaccaaagatcatcacttgacccacatccccactctgcatttatctgtatttatttcaaaatgtttatgtggatgtagcctacttattcttacataaatatttttgccattctgtattaagatttctggcttctgaaagaaaagccctggtttctccccagttgcagttagaaaagcattgtgttaggaagccat

SEQ ID NO: 172459 - DNA, 601 bp, Human; identical to SEQ ID NO: 21716

SEQ ID NO: 172460 - DNA, 601 bp, Human
gtagcagctaaaaggcaaaatcaagtaaaggatgattcaacaagaaaagcaccagtatttatattctttgcactttcattgaaacgtttcaccggagattggtaatgattaggccaagatgacagagatgattcaaggttgggtttttcatttgaaaagtctactaattttagagttgtgttaaacctaagttaaagttggaatagggttttccccggaccaatattaagtgaagtggatcaccaagtggagtagcggcacgaaggtggtttctttagacttttaagtccaactcctacgsagccgtttggtattaggcatataatctaagctttctgagcctcaatttccccattcacaacaaaagggcaatgcaggctcttctcataacttcaaggggcggtggtctgatatagagtactatgaaaacaaaagcagcacaccaaagtaacacattattattatgatcacttatagaaccattacccgctaggatgaaactccccacacaagagatgaagcccgagagaaaagagttgaaggggaaggtccccacgaggagacagtaaccgaactgcagcgccccggtcagcagtatata

SEQ ID NO: 172461 - DNA, 601 bp, Human
tgtaactttaagcacagcaccactgtcaccagactttttttttttttttttgaggctgagcctcactctcacccaagctgaagtgcaatggcacgatctcggctcactacaacctccacctcccgggttcaagcgattctgcctcagcctcccgagtagctgggattacaggtgtgtgccaccatgcctggctaatttatgtattttcagtagagatggggtttcaccatgttggccaggctggtcttgaactcctgacctcaagtgatctgcctacctcggcctcccaaagtactgggawtacaggcatgagccactgtgccaggcctccagacaattccaatgctgtattttgtctgtaccccaactagaccataaactctttacggataaagaacatgtgccaaagcttttaccataatgcctcatattggactgaaaatacaactgatgacctgactgatgatcacactgaaaagaaaccatgaatgctggcatgttttcaaagtcaaagtagcaggtgataccagtgatagaggccacgcctgttttcagtattcactgaatccccgttgggcaagaaaagtcagattttaacaaa

SEQ ID NO: 172462 - DNA, 601 bp, Human
cgggctggctaataaaaacatatagtaccgtggcagagggcggtgggtgggtggtggagaatacttagagcaaaggggtagtgtatctggtcggatgatggttaacacatcctgaaggcaaggacgccaccacagacaactaggtcttggtcatctaggacaaaagtcaaagatggtaactaaatatccaatcaaaaggctaatctgcaacttcagtacacaagtcattagatcctcagacctgttttaaattctaagaaatatctctggtgtgtcagaacaatgtaaatgtacaataagyattctataggtctgtaactttaagcacagcaccactgtcaccagactttttttttttttttttgaggctgagcctcactctcacccaagctgaagtgcaatggcacgatctcggctcactacaacctccacctcccgggttcaagcgattctgcctcagcctcccgagtagctgggattacaggtgtgtgccaccatgcctggctaatttatgtattttcagtagagatggggtttcaccatgttggccaggctggtcttgaactcctgacctcaagtgatctgcctacctcggcctccc

SEQ ID NO: 172463 - DNA, 601 bp, Human
tgctcctactcttccagacctggaaacaaaaacatcaaacaaaattaaatcaaaagttctcatcaaggttccttctccgggctggctaataaaaacatatagtaccgtggcagagggcggtgggtgggtggtggagaatacttagagcaaaggggtagtgtatctggtcggatgatggttaacacatcctgaaggcaaggacgccaccacagacaactaggtcttggtcatctaggacaaaagtcaaagatggtaactaaatatccaatcaaaaggctaatctgcaacttcagtacacaartcattagatcctcagacctgttttaaattctaagaaatatctctggtgtgtcagaacaatgtaaatgtacaataagcattctataggtctgtaactttaagcacagcaccactgtcaccagactttttttttttttttttgaggctgagcctcactctcacccaagctgaagtgcaatggcacgatctcggctcactacaacctccacctcccgggttcaagcgattctgcctcagcctcccgagtagctgggattacaggtgtgtgccaccatgcctggctaatttatgtattttcagt

SEQ ID NO: 172464 - DNA, 601 bp, Human
agaattgcttaaacctgggagacagaggttgcagtgaaccgagatcgccattgcactccagcctgagaaaaaagagcaaaactccatctcaaaaaaagtccaaattccttggcctggcattcaaacatctagcacccagcactacctaatccttcaacagtatcgcctacatttccctctcccagctcactggactcctccattctcttgcaacaggaaattccacaggaaagttagaaaccccagcaccataaaaaggaacaaggctacctttgccaacaatcaaaacaaaggataagcrtccaaatttcccattaaaaccagtctccagttgatgatctaggctaacaaatggcagaagaggcaggatttaggaaagtcaatgctgtcaaaagaagggtaaatcatacccttctgtggcaactaagaattatcatgaatcccttcttttcttgaagttgctttcatttctatagctctattatctgttatctaacagatctggaaatcctaatcccccttattggccccattactaatatgcccttttactaggtttttcttcaatgacaagccacctagttcccactggagaggagaa

SEQ ID NO: 172465 - DNA, 601 bp, Human
aggagagaaacagaaattaatgacacggaacagaggaataattgcagaagcggagtccctgagtgagcaagggaagactggatcctctgcacaagcagagctttcacaggaaagagacacatcatccaccatgagaagtcagagagtatgggtataaaagtaggtgatctgttatgattcagtggtgaaaagatgaaggaattcttatctacttcttttttttagtgaaaaaataaaagcaagatcaccaactaagaataaaggaaaagaggaaaaatagagtgatttatgaagcctactktaggaaggcgaatgtataagagaaatattattgcaggaccactaggcagggttggatgcacattgtgttcccattctcaccaataattctccatcagcaccatatccatatttacttgtctgtatttcccactaattacaaactctgtgagagtagaagccacgtctgtgtgcttcacagttgaattcccagcaccttggcagagaacctagcacatcattgctcactattcctgacatgactataggcctgctcaccatttaacatatacagtgttcagcactgaggatggagagatga

SEQ ID NO: 172466 - DNA, 601 bp, Human
ttcgggggacagttcaaaactaaaaatataaaggagtagttgtaggtatacaggtgttatttaagtttatctatttaaaaaaaaatacaaagtgaaggtatctacaaccatgctctcagtcagagaagcgcccagcacaaaacagcagaaaggaaaaagcagtgaggtgagacagaacaagcaggagagtgttgtattcaagaaaaaactttccttttacacagaagccaatacctacattaaatgctaaacgttgcaacatggcaagagtagtttcagtgaagtaattcagtgaagtagygaggacagaccaataccaagagtgggttaaggaatgaatagttaagggaggaagtaggaacattaattattctttcaagaaattctgtaatgatggaaaggaaatgggatggtagctagaagattatctgtggtcaaacggattttttttaaatagacaatattagaacatgtttgtatgatgggaatgatccaggagagaaacagaaattaatgacacggaacagaggaataattgcagaagcggagtccctgagtgagcaagggaagactggatcctctgcacaagcagagctttcac

SEQ ID NO: 172467 - DNA, 601 bp, Human
gccgggcatggcggctcacgcctgtaatcccagcactttgggaggccgaggtgggtgaatcacctgaggtcaggagttcgtgaccagcctggccaacatggcgaaacctcgtctctactaaaaatacaaaaattagccgggcatgggggagcgtgcctgtaatcccagctactcaggaggctgaggcaggagaattgcttaaacccgggagatggaggttgcagtgagccgagattgtgccactgcactccagcctgggtgacagagtgagactatgtctcaaaaaaaaaaaaaaaaaaaaccacaaccaacattgacaccacgtactaactggtgaagaggcagatggctggatgagcaggtttgatcttggacatgttaagttcaaggtacatatcagacatcaagtgaagacatcaagttggcaactggatttactaatttggaattcgggggacagttcaaaactaaaaatataaaggagtagttgtaggtatacaggtgttatttaagtttatctatttaaaaaaaaatacaaagtgaaggtatctacaaccatgctctcagtcagagaagcgcccagcacaaaacagcagaaagg

SEQ ID NO: 172468 - DNA, 601 bp, Human
taaatttcttcatttaaaaacacaaccggccgggcatggcggctcacgcctgtaatcccagcactttgggaggccgaggtgggtgaatcacctgaggtcaggagttcgtgaccagcctggccaacatggcgaaacctcgtctctactaaaaatacaaaaattagccgggcatgggggagcgtgcctgtaatcccagctactcaggaggctgaggcaggagaattgcttaaacccgggagatggaggttgcagtgagccgagattgtgccactgcactccagcctgggtgacagagtgagaytatgtctcaaaaaaaaaaaaaaaaaaaaccacaaccaacattgacaccacgtactaactggtgaagaggcagatggctggatgagcaggtttgatcttggacatgttaagttcaaggtacatatcagacatcaagtgaagacatcaagttggcaactggatttactaatttggaattcgggggacagttcaaaactaaaaatataaaggagtagttgtaggtatacaggtgttatttaagtttatctatttaaaaaaaaatacaaagtgaaggtatctacaaccatgctctcagtcagag

SEQ ID NO: 172469 - DNA, 601 bp, Human
aaagagctcaggggaatggtagtaaaaatggacagaaataaagacatacaggctatattttggagaagacagagcttgctgatgaaacagatgcaggagataagagaaatcaagggaccccggaaacttaaatttcttcatttaaaaacacaaccggccgggcatggcggctcacgcctgtaatcccagcactttgggaggccgaggtgggtgaatcacctgaggtcaggagttcgtgaccagcctggccaacatggcgaaacctcgtctctactaaaaatacaaaaattagccgggcatsggggagcgtgcctgtaatcccagctactcaggaggctgaggcaggagaattgcttaaacccgggagatggaggttgcagtgagccgagattgtgccactgcactccagcctgggtgacagagtgagactatgtctcaaaaaaaaaaaaaaaaaaaaccacaaccaacattgacaccacgtactaactggtgaagaggcagatggctggatgagcaggtttgatcttggacatgttaagttcaaggtacatatcagacatcaagtgaagacatcaagttggcaactggatttactaatttg

SEQ ID NO: 172470 - DNA, 601 bp, Human
gagaatggcgtgaacccgggaggcggagcttgcagtgagccgaaatcgcgccactgcactccagcctgggcaacagagcgagactccgtctcaaaaatataaaaaataaaaagaagcagaagaattacttaggacccaaagagctcaggggaatggtagtaaaaatggacagaaataaagacatacaggctatattttggagaagacagagcttgctgatgaaacagatgcaggagataagagaaatcaagggaccccggaaacttaaatttcttcatttaaaaacacaaccggccgggcrtggcggctcacgcctgtaatcccagcactttgggaggccgaggtgggtgaatcacctgaggtcaggagttcgtgaccagcctggccaacatggcgaaacctcgtctctactaaaaatacaaaaattagccgggcatgggggagcgtgcctgtaatcccagctactcaggaggctgaggcaggagaattgcttaaacccgggagatggaggttgcagtgagccgagattgtgccactgcactccagcctgggtgacagagtgagactatgtctcaaaaaaaaaaaaaaaaaaaaccacaac

SEQ ID NO: 172471 - DNA, 601 bp, Human
ccagcctggcgacacagtgagactgcgtctcaaaaaaataaaaataaaaataaaaataggccaggcgcagtggctcacacctgtaatcccagcactttgggaagccaaggcgggcggatcacaaggtcaggagatcgagaccatcctggctaacatggtgagacccatctccactaaaaaatacaaaaaaaaaaaaaaaattagccggtcattgtggcgggtgcctgtagtcccagctactcgggaggctgaggcaggagaatggcgtgaacccgggaggcggagcttgcagtgagccgaratcgcgccactgcactccagcctgggcaacagagcgagactccgtctcaaaaatataaaaaataaaaagaagcagaagaattacttaggacccaaagagctcaggggaatggtagtaaaaatggacagaaataaagacatacaggctatattttggagaagacagagcttgctgatgaaacagatgcaggagataagagaaatcaagggaccccggaaacttaaatttcttcatttaaaaacacaaccggccgggcatggcggctcacgcctgtaatcccagcactttgggaggccgagg

SEQ ID NO: 172472 - DNA, 601 bp, Human
actagggaggctgaggcagaagaatcgcttgaactccaagggcggaggttgcagtgagctgagatcgcgccactgcactccagcctggcgacacagtgagactgcgtctcaaaaaaataaaaataaaaataaaaataggccaggcgcagtggctcacacctgtaatcccagcactttgggaagccaaggcgggcggatcacaaggtcaggagatcgagaccatcctggctaacatggtgagacccatctccactaaaaaatacaaaaaaaaaaaaaaaattagccggtcattgtggcgggygcctgtagtcccagctactcgggaggctgaggcaggagaatggcgtgaacccgggaggcggagcttgcagtgagccgaaatcgcgccactgcactccagcctgggcaacagagcgagactccgtctcaaaaatataaaaaataaaaagaagcagaagaattacttaggacccaaagagctcaggggaatggtagtaaaaatggacagaaataaagacatacaggctatattttggagaagacagagcttgctgatgaaacagatgcaggagataagagaaatcaagggaccccggaaact

SEQ ID NO: 172473 - DNA, 601 bp, Human
tcacaaggtcaggaattcaagaccagcctggtcaagaaggtgaaaccccatctctactaaaaataaaatacaaaaaattagccgggtgcagtggcaggctcctggaatcccagctactagggaggctgaggcagaagaatcgcttgaactccaagggcggaggttgcagtgagctgagatcgcgccactgcactccagcctggcgacacagtgagactgcgtctcaaaaaaataaaaataaaaataaaaataggccaggcgcagtggctcacacctgtaatcccagcactttgggaagccraggcgggcggatcacaaggtcaggagatcgagaccatcctggctaacatggtgagacccatctccactaaaaaatacaaaaaaaaaaaaaaaattagccggtcattgtggcgggtgcctgtagtcccagctactcgggaggctgaggcaggagaatggcgtgaacccgggaggcggagcttgcagtgagccgaaatcgcgccactgcactccagcctgggcaacagagcgagactccgtctcaaaaatataaaaaataaaaagaagcagaagaattacttaggacccaaagagctcaggg

SEQ ID NO: 172474 - DNA, 601 bp, Human
taagccgagatcgtgccattgcactccagcctgggcaacaagagcaaaactccatctcaaaaaaaaaaaaaaaaaaaaaaaaaaatcaaggacagaccaacaagactatagtgatcaaggggaaggacacaagggccaaatcctgaggggcatggtaagcctcagaaaacagtatggattcagttataagagcggtggaacagtataatggttcgcaaggttaaaaagaggcagaaggccgggcgcagtggctcacgcctgtaatcccagcactttgggaggccgaggtgggtggatcacraggtcaggaattcaagaccagcctggtcaagaaggtgaaaccccatctctactaaaaataaaatacaaaaaattagccgggtgcagtggcaggctcctggaatcccagctactagggaggctgaggcagaagaatcgcttgaactccaagggcggaggttgcagtgagctgagatcgcgccactgcactccagcctggcgacacagtgagactgcgtctcaaaaaaataaaaataaaaataaaaataggccaggcgcagtggctcacacctgtaatcccagcactttgggaagccaaggc

SEQ ID NO: 172475 - DNA, 601 bp, Human
tcataacagaaggtctctttaagagcttgctatttaagaccaatatttgaaagataaggaaccaaccatgtaaaaatctgggggcagagcattctagacagtaagaacaatcttgacatgttataaacacaaggacagacgccaggcatggtggctcacacccgtaatcccagcactttgggaggtcgaggcgggtggataacctgaggtcgggagttcgagaccagcctgaccaacatggagaaaccccgtctctactaaaaatacaaaaaattagccaggcttggtggtgcatgcctgyaatcccagctactcaggaggctgaggcagaagaaccgcttgaacccgggaggcggaagttgcagtaagccgagatcgtgccattgcactccagcctgggcaacaagagcaaaactccatctcaaaaaaaaaaaaaaaaaaaaaaaaaaatcaaggacagaccaacaagactatagtgatcaaggggaaggacacaagggccaaatcctgaggggcatggtaagcctcagaaaacagtatggattcagttataagagcggtggaacagtataatggttcgcaaggttaaaaagaggcagaa

SEQ ID NO: 172476 - DNA, 601 bp, Human
ttgcctaagggtagggattacagacatgagcccccacacccagcccattcctaatttcacttggccagggcatggtggctcacaactgtaaccccagcatgttgtgaaaccaaggtgggaggatcgcttgagcccaagagcttgagaccagcctgggaaagatagggagaccctgtctctacaaaaaaaatgttttaattagccaggtgtggtagcacacacctatggccccagctactcgggaggctgagatgggaagattgcttgagcccaggaggtagaggttgcaggctgcagtgarccacagtcatgccaccgcactctggcctgggagacaaatcaagaccgtctcaaaaaaaaagtaaaatattttatttacatataatgatatacataattatcttgtcatttcagttagaatctagaaaaaaatctgaagaaatagaaaactattaatagtggtcattggagtaaagaacacggtgttgagttttgaggaaatatgagggaaaaaaagaaaaattatccatgaaggtggataaggtaataaattgatgttattattattgtgatcatggtaaccagattatttcaatgaaaa

SEQ ID NO: 172477 - DNA, 601 bp, Human
ggggattaaactatacaactgacatgcaatgaaatcccatgcaattattcaaaagaataaggtaaattctctgtacattgacagcaaacatatctaagacttattaagtgaaaaaaagccaatcctttttttttttttttttttgagacagggtctcactccatcgcccaggctggagtgcagtggtgcaatcatggctccctgcagcctcgacctcctgggctcaaacaatcctcccacctcagccccctgagtagctgagacaacagtcatgcaccaccatgcctagctaatttttttttttgtttttggtaaagacaaggtctccctatgttgcccagcaatcctcccgcctctgcttgcctaagggtagggattacagacatgagcccccacacccagcccattcctaatttcacttggccagggcatggtggctcacaactgtaaccccagcatgttgtgaaaccaaggtgggaggatcgcttgagcccaagagcttgagaccagcctgggaaagatagggagaccctgtctctacaaaaaaaatgttttaattagccaggtgtggtagcacacacctatggccccagctactcgg

SEQ ID NO: 172478 - DNA, 601 bp, Human
aaaattaaaacagtctaaacatcaaggggattaaactatacaactgacatgcaatgaaatcccatgcaattattcaaaagaataaggtaaattctctgtacattgacagcaaacatatctaagacttattaagtgaaaaaaagccaatcctttttttttttttttttttgagacagggtctcactccatcgcccaggctggagtgcagtggtgcaatcatggctccctgcagcctcgacctcctgggctcaaacaatcctcccacctcagccccctgagtagctgagacaacagtcatgcaccaccatgcctagctaatttttttgtttgtttttggtaaagacaaggtctccctatgttgcccagcaatcctcccgcctctgcttgcctaagggtagggattacagacatgagcccccacacccagcccattcctaatttcacttggccagggcatggtggctcacaactgtaaccccagcatgttgtgaaaccaaggtgggaggatcgcttgagcccaagagcttgagaccagcctgggaaagatagggagaccctgtctctacaaaaaaaatgttttaattagccaggtgtggtagca

SEQ ID NO: 172479 - DNA, 601 bp, Human
aaaaattaaaacagtctaaacatcaaggggattaaactatacaactgacatgcaatgaaatcccatgcaattattcaaaagaataaggtaaattctctgtacattgacagcaaacatatctaagacttattaagtgaaaaaaagccaatcctttttttttttttttttttgagacagggtctcactccatcgcccaggctggagtgcagtggtgcaatcatggctccctgcagcctcgacctcctgggctcaaacaatcctcccacctcagccccctgagtagctgagacaacagtcatgmaccaccatgcctagctaatttttttgtttgtttttggtaaagacaaggtctccctatgttgcccagcaatcctcccgcctctgcttgcctaagggtagggattacagacatgagcccccacacccagcccattcctaatttcacttggccagggcatggtggctcacaactgtaaccccagcatgttgtgaaaccaaggtgggaggatcgcttgagcccaagagcttgagaccagcctgggaaagatagggagaccctgtctctacaaaaaaaatgttttaattagccaggtgtggtagc

SEQ ID NO: 172480 - DNA, 601 bp, Human
gagagcaactagcaatatccattaatatttaaaatgattttaccttttgacaaaggaatttatcttacagaacaaagacattctgaaagtatgtttgtaaagttgaaaaaaaaattaaaacagtctaaacatcaaggggattaaactatacaactgacatgcaatgaaatcccatgcaattattcaaaagaataaggtaaattctctgtacattgacagcaaacatatctaagacttattaagtgaaaaaaagccaatcctttttttttttttttttttgagacagggtctcactccatcrcccaggctggagtgcagtggtgcaatcatggctccctgcagcctcgacctcctgggctcaaacaatcctcccacctcagccccctgagtagctgagacaacagtcatgcaccaccatgcctagctaatttttttgtttgtttttggtaaagacaaggtctccctatgttgcccagcaatcctcccgcctctgcttgcctaagggtagggattacagacatgagcccccacacccagcccattcctaatttcacttggccagggcatggtggctcacaactgtaaccccagcatgttgtga

SEQ ID NO: 172481 - DNA, 601 bp, Human
attatacctagatggggatgcacttgaggcaacaacaaagggtccgggctgaatgataaaaagttataaaaatgtgaattattttctaatagaatattcatttaatgggtagcagagtttataaagatagcacgctcattcttgagaacctcacagttctcgataaactatctttgatctcgaagttctagcagctgcttatttgtctcaaaaaaggcagaagacctaagagagataattcatgagaactctccactgccacactccatccccttgaagattctaacagtcaccattgacaaaaaaaaaaaaacaggcagttccaggaatacactcttccgaagtatctttatgcctgtgataaattattacattgcttaagaaaacctaaactcgcttcaggctagcatcatcccatcattaactaagaaaaagcaacaaacaaatctaatccaaaggccagaaaactatcagactagttctccagagcctgtcaccatggcaacagttttcattatgcttaaacatgtaaacaccatggaagcaccattgatcctttcaggtatccagacccttaaaaatattaaagacaatgactgaa

SEQ ID NO: 172482 - DNA, 601 bp, Human
gatttaaaggtttctaattatacctagatggggatgcacttgaggcaacaacaaagggtccgggctgaatgataaaaagttataaaaatgtgaattattttctaatagaatattcatttaatgggtagcagagtttataaagatagcacgctcattcttgagaacctcacagttctcgataaactatctttgatctcgaagttctagcagctgcttatttgtctcaaaaaaggcagaagacctaagagagataattcatgagaactctccactgccacactccatccccttgaagattctwacagtcaccattgacaaaaaaaaaaaaacaggcagttccaggaatacactcttccgaagtatctttatgcctgtgataaattattacattgcttaagaaaacctaaactcgcttcaggctagcatcatcccatcattaactaagaaaaagcaacaaacaaatctaatccaaaggccagaaaactatcagactagttctccagagcctgtcaccatggcaacagttttcattatgcttaaacatgtaaacaccatggaagcaccattgatcctttcaggtatccagacccttaaaaatatt

SEQ ID NO: 172483 - DNA, 601 bp, Human
aaagctctcttatctgctgatttaaaggtttctaattatacctagatggggatgcacttgaggcaacaacaaagggtccgggctgaatgataaaaagttataaaaatgtgaattattttctaatagaatattcatttaatgggtagcagagtttataaagatagcacgctcattcttgagaacctcacagttctcgataaactatctttgatctcgaagttctagcagctgcttatttgtctcaaaaaaggcagaagacctaagagagataattcatgagaactctccactgccacactcyatccccttgaagattctaacagtcaccattgacaaaaaaaaaaaaacaggcagttccaggaatacactcttccgaagtatctttatgcctgtgataaattattacattgcttaagaaaacctaaactcgcttcaggctagcatcatcccatcattaactaagaaaaagcaacaaacaaatctaatccaaaggccagaaaactatcagactagttctccagagcctgtcaccatggcaacagttttcattatgcttaaacatgtaaacaccatggaagcaccattgatcctttcaggtatc

SEQ ID NO: 172484 - DNA, 601 bp, Human
ttccatgtacaaaaagcttaaaacttggtaaaaccaatctatggcaagatagtggtttttatctttcacagggagaggataactgggaagatgcaaggaggcatctatggtgctggtaatgtcctgcatcttgatctggatagtggttagacaggtacatttaaaaatttatcaagttgtacaattaaatttcgcactctgttaaaggaaaaaaaatattacttctcagagttacactgaaacctagaggctttctcagagaaaaaaatatataaccaaaaaacccacaaagctctcttayctgctgatttaaaggtttctaattatacctagatggggatgcacttgaggcaacaacaaagggtccgggctgaatgataaaaagttataaaaatgtgaattattttctaatagaatattcatttaatgggtagcagagtttataaagatagcacgctcattcttgagaacctcacagttctcgataaactatctttgatctcgaagttctagcagctgcttatttgtctcaaaaaaggcagaagacctaagagagataattcatgagaactctccactgccacactccatccccttgaag

SEQ ID NO: 172485 - DNA, 601 bp, Human
aagggccaggcacggtggctcactcctgtaatccccgcactttgggaggccaaggtgggtggatcacctaaggtcaggagttcaagaccagcctggccaacatggggaaaccccatctctaataaaaactacagaaattagctgggcatggtggcacgcacctgtaatcccagctactcaggaggctgaggcaggagaatttgcttaaactcaggaggtggaggttgcagtgagccgagattgcgccactgcactccagcctgggcaagagagactccgtctcaaaacaaaacaaaacaaraaagtatatgctatatgattccatgtacaaaaagcttaaaacttggtaaaaccaatctatggcaagatagtggtttttatctttcacagggagaggataactgggaagatgcaaggaggcatctatggtgctggtaatgtcctgcatcttgatctggatagtggttagacaggtacatttaaaaatttatcaagttgtacaattaaatttcgcactctgttaaaggaaaaaaaatattacttctcagagttacactgaaacctagaggctttctcagagaaaaaaatatataaccaaaaa

SEQ ID NO: 172486 - DNA, 601 bp, Human
gtctactaaaaatacaaaattagccgggcatggtggcgcatgcctgtgatcccagttgcttggcaggctgaggcaatgaggcaggagaattggtggaggtggaggtggaggtgagccaagatcgtgccattgcactctagcatgggcaacaagagcgaaactccatctaaaaaaaaaaaaattaaaaaataaaacaagggccaggcacggtggctcactcctgtaatccccgcactttgggaggccaaggtgggtggatcacctaaggtcaggagttcaagaccagcctggccaacatggkgaaaccccatctctaataaaaactacagaaattagctgggcatggtggcacgcacctgtaatcccagctactcaggaggctgaggcaggagaatttgcttaaactcaggaggtggaggttgcagtgagccgagattgcgccactgcactccagcctgggcaagagagactccgtctcaaaacaaaacaaaacaaaaaagtatatgctatatgattccatgtacaaaaagcttaaaacttggtaaaaccaatctatggcaagatagtggtttttatctttcacagggagaggataactggg

SEQ ID NO: 172487 - DNA, 601 bp, Human
ggatagtgatgatgattttacaacaatgtacatgtacttaatgccacagaactatacacttaaaaatggttaaaatggtaaattttgtcatgttttatcttgaccaaaaacaaacaaaaaaaaggccgggcacggtggctcacgcctgtaatcccagcactttgggaggccgaggcaggcggatcacctgaggtcgggagttcaagaccagcctgaccaacatggagaaaccccttgtctactaaaaatacaaaattagccgggcatggtggcgcatgcctgtgatcccagttgcttggcrggctgaggcaatgaggcaggagaattggtggaggtggaggtggaggtgagccaagatcgtgccattgcactctagcatgggcaacaagagcgaaactccatctaaaaaaaaaaaaattaaaaaataaaacaagggccaggcacggtggctcactcctgtaatccccgcactttgggaggccaaggtgggtggatcacctaaggtcaggagttcaagaccagcctggccaacatggggaaaccccatctctaataaaaactacagaaattagctgggcatggtggcacgcacctgtaatcc

SEQ ID NO: 172488 - DNA, 601 bp, Human
gaatttcagttgcggaagacaaaaaagttctggatatggatagtgatgatgattttacaacaatgtacatgtacttaatgccacagaactatacacttaaaaatggttaaaatggtaaattttgtcatgttttatcttgaccaaaaacaaacaaaaaaaaggccgggcacggtggctcacgcctgtaatcccagcactttgggaggccgaggcaggcggatcacctgaggtcgggagttcaagaccagcctgaccaacatggagaaaccccttgtctactaaaaatacaaaattagccggrcatggtggcgcatgcctgtgatcccagttgcttggcaggctgaggcaatgaggcaggagaattggtggaggtggaggtggaggtgagccaagatcgtgccattgcactctagcatgggcaacaagagcgaaactccatctaaaaaaaaaaaaattaaaaaataaaacaagggccaggcacggtggctcactcctgtaatccccgcactttgggaggccaaggtgggtggatcacctaaggtcaggagttcaagaccagcctggccaacatggggaaaccccatctctaataaaaactaca

SEQ ID NO: 172489 - DNA, 601 bp, Human
ggataagcaaagtgtgatgtatacatacaatggaatactcagccttaaaaggaaggaaattctgatacctgctacaacatggctgaatcttgaggacattattttaagtgacataagccatgacaaagggacaaataccatgtggtttcacttatatgacatcaagagtagtcaaactcctagaaacagaaagtggaatggtagatgccagggactgacagagaggaggatgaggagttactgtttaatgggaactgaatttcagttgcggaagacaaaaaagttctggatatggatagtgatgatgattttacaacaatgtacatgtacttaatgccacagaactatacacttaaaaatggttaaaatggtaaattttgtcatgttttatcttgaccaaaaacaaacaaaaaaaaggccgggcacggtggctcacgcctgtaatcccagcactttgggaggccgaggcaggcggatcacctgaggtcgggagttcaagaccagcctgaccaacatggagaaaccccttgtctactaaaaatacaaaattagccgggcatggtggcgcatgcctgtgatcccagttgcttggcaggctgag

SEQ ID NO: 172490 - DNA, 601 bp, Human
aaagtacccctacaatgcaattaacaacaaaataataaccagattttaaaatgggcaaaggacttgaatagacatttccccaaagaagatataggaatggccaacaagcatatgaaaagatgctcaacatcattaatcactagggcaatacaaatcaaaattacaacgagatatcacctcacatctattaggatgtctagtatcaaaaaaacaagagttggcaagaatgcagagaaactgaaacccttgtgcactaacaagtgggaaaatcaaatagggtagccagtgtgaaaaacagtaytgcgtttcctcaaaaaaattaaaaacagaattgccatatcatataatccagcaattccacttctgggtacatatccaaaagaagtgaaagcaggatctcggccaggcacagtggttcacacctgcaatcccagcactttgggaggctgaaccaggcggatcacccgaggtcaggagttcgagaccagcctggccaacatggtgaaaccccgtctctactaaaaatacaaaaattagctgggcgtggtggtaggcgcctgtaatcccagctactagggaagctgaggcagaagaatcgctt

SEQ ID NO: 172491 - DNA, 601 bp, Human
tttaaaacttctgtgataaaggtacaataaagggcacaacagtgaaaaggcacctacggaatggggaaaaatatttgcaaatcacttatctgataaagggttaatatcagaatatattaaagtacccctacaatgcaattaacaacaaaataataaccagattttaaaatgggcaaaggacttgaatagacatttccccaaagaagatataggaatggccaacaagcatatgaaaagatgctcaacatcattaatcactagggcaatacaaatcaaaattacaacgagatatcacctcacrtctattaggatgtctagtatcaaaaaaacaagagttggcaagaatgcagagaaactgaaacccttgtgcactaacaagtgggaaaatcaaatagggtagccagtgtgaaaaacagtactgcgtttcctcaaaaaaattaaaaacagaattgccatatcatataatccagcaattccacttctgggtacatatccaaaagaagtgaaagcaggatctcggccaggcacagtggttcacacctgcaatcccagcactttgggaggctgaaccaggcggatcacccgaggtcaggagttcgag

SEQ ID NO: 172492 - DNA, 601 bp, Human
aagctggacccttaccttataccatatactacaaaaattaactcgaaacggatcaaagacctaaatccgaaatggataaagaccaaaaactaaaaaactcttagaagaaaacagagcaaaagttttatggcattggatttagcaatgatttattggatatgacaccaaaagtacagtcaacaaagtaaaaatagataaattggactatatcaaagtttaaaacttctgtgataaaggtacaataaagggcacaacagtgaaaaggcacctacggaatggggaaaaatatttgcaaatcacwtatctgataaagggttaatatcagaatatattaaagtacccctacaatgcaattaacaacaaaataataaccagattttaaaatgggcaaaggacttgaatagacatttccccaaagaagatataggaatggccaacaagcatatgaaaagatgctcaacatcattaatcactagggcaatacaaatcaaaattacaacgagatatcacctcacatctattaggatgtctagtatcaaaaaaacaagagttggcaagaatgcagagaaactgaaacccttgtgcactaacaagtgggaaa

SEQ ID NO: 172493 - DNA, 601 bp, Human
atattctgggatgcagccacacagagccactgagaactcggcaggagacagggtctggtggtgctgcccaggccggactggaacccaagcgatcctcccacctcagcctcctgagcagctgggaccacaggcacgggtgaacacatctgcctagctccatggtatttttagtgtgaccttctatttagggataatgattcaggttttccattataagtttattttaaaaatacatttactacagttaaaaaatgaatcaatttaattgctttgttttttaagaaacacacaaaaaccctcrtatacaaaatcaaatgattttcaaccaaactgacaaaaccactcaatggggaaacagtcttctcaaccaacgatgctgggaaaactggatatccataggcaaaagaatgaagctggacccttaccttataccatatactacaaaaattaactcgaaacggatcaaagacctaaatccgaaatggataaagaccaaaaactaaaaaactcttagaagaaaacagagcaaaagttttatggcattggatttagcaatgatttattggatatgacaccaaaagtacagtcaacaaagtaaaaa

SEQ ID NO: 172494 - DNA, 601 bp, Human
acttaaaaaatacacactggctggccaaaccagctggaacctggcaggtacccagaggaagccaaagacaaaaaagcccagctcccacacagagaccacagggcagagcctaagtgtatatgctgggggaacaaatgtaccccctcaattagatgaggaatattctgggatgcagccacacagagccactgagaactcggcaggagacagggtctggtggtgctgcccaggccggactggaacccaagcgatcctcccacctcagcctcctgagcagctgggaccacaggcacgggtgaayacatctgcctagctccatggtatttttagtgtgaccttctatttagggataatgattcaggttttccattataagtttattttaaaaatacatttactacagttaaaaaatgaatcaatttaattgctttgttttttaagaaacacacaaaaaccctcgtatacaaaatcaaatgattttcaaccaaactgacaaaaccactcaatggggaaacagtcttctcaaccaacgatgctgggaaaactggatatccataggcaaaagaatgaagctggacccttaccttataccatatactac

SEQ ID NO: 172495 - DNA, 601 bp, Human
tgtgatccacctgcctcggcttcccaaagtgctgggattacaggcatgagccaccgtgcccggacaaaacttaaaaaatacacactggctggccaaaccagctggaacctggcaggtacccagaggaagccaaagacaaaaaagcccagctcccacacagagaccacagggcagagcctaagtgtatatgctgggggaacaaatgtaccccctcaattagatgaggaatattctgggatgcagccacacagagccactgagaactcggcaggagacagggtctggtggtgctgcccaggcyggactggaacccaagcgatcctcccacctcagcctcctgagcagctgggaccacaggcacgggtgaacacatctgcctagctccatggtatttttagtgtgaccttctatttagggataatgattcaggttttccattataagtttattttaaaaatacatttactacagttaaaaaatgaatcaatttaattgctttgttttttaagaaacacacaaaaaccctcgtatacaaaatcaaatgattttcaaccaaactgacaaaaccactcaatggggaaacagtcttctcaaccaacga

SEQ ID NO: 172496 - DNA, 601 bp, Human
tttttagtagagacggggtttcaccatgctgaccaggctggtctcgaactcctgaccttgtgatccacctgcctcggcttcccaaagtgctgggattacaggcatgagccaccgtgcccggacaaaacttaaaaaatacacactggctggccaaaccagctggaacctggcaggtacccagaggaagccaaagacaaaaaagcccagctcccacacagagaccacagggcagagcctaagtgtatatgctgggggaacaaatgtaccccctcaattagatgaggaatattctgggatgcarccacacagagccactgagaactcggcaggagacagggtctggtggtgctgcccaggccggactggaacccaagcgatcctcccacctcagcctcctgagcagctgggaccacaggcacgggtgaacacatctgcctagctccatggtatttttagtgtgaccttctatttagggataatgattcaggttttccattataagtttattttaaaaatacatttactacagttaaaaaatgaatcaatttaattgctttgttttttaagaaacacacaaaaaccctcgtatacaaaatcaaat

SEQ ID NO: 172497 - DNA, 601 bp, Human
tttttgtatttttagtagagacggggtttcaccatgctgaccaggctggtctcgaactcctgaccttgtgatccacctgcctcggcttcccaaagtgctgggattacaggcatgagccaccgtgcccggacaaaacttaaaaaatacacactggctggccaaaccagctggaacctggcaggtacccagaggaagccaaagacaaaaaagcccagctcccacacagagaccacagggcagagcctaagtgtatatgctgggggaacaaatgtaccccctcaattagatgaggaatattctrggatgcagccacacagagccactgagaactcggcaggagacagggtctggtggtgctgcccaggccggactggaacccaagcgatcctcccacctcagcctcctgagcagctgggaccacaggcacgggtgaacacatctgcctagctccatggtatttttagtgtgaccttctatttagggataatgattcaggttttccattataagtttattttaaaaatacatttactacagttaaaaaatgaatcaatttaattgctttgttttttaagaaacacacaaaaaccctcgtatacaa

SEQ ID NO: 172498 - DNA, 601 bp, Human; identical to SEQ ID NO: 21717

SEQ ID NO: 172499 - DNA, 601 bp, Human; identical to SEQ ID NO: 21718

SEQ ID NO: 172500 - DNA, 601 bp, Human; identical to SEQ ID NO: 21719

SEQ ID NO: 172501 - DNA, 601 bp, Human; identical to SEQ ID NO: 21720

SEQ ID NO: 172502 - DNA, 601 bp, Human; identical to SEQ ID NO: 21721

SEQ ID NO: 172503 - DNA, 601 bp, Human; identical to SEQ ID NO: 21722

SEQ ID NO: 172504 - DNA, 601 bp, Human; identical to SEQ ID NO: 21723

SEQ ID NO: 172505 - DNA, 601 bp, Human; identical to SEQ ID NO: 21724

SEQ ID NO: 172506 - DNA, 601 bp, Human; identical to SEQ ID NO: 21725

SEQ ID NO: 172507 - DNA, 601 bp, Human; identical to SEQ ID NO: 21726

SEQ ID NO: 172508 - DNA, 601 bp, Human; identical to SEQ ID NO: 21727

SEQ ID NO: 172509 - DNA, 601 bp, Human; identical to SEQ ID NO: 21728

SEQ ID NO: 172510 - DNA, 601 bp, Human; identical to SEQ ID NO: 21729

SEQ ID NO: 172511 - DNA, 601 bp, Human; identical to SEQ ID NO: 21730

SEQ ID NO: 172512 - DNA, 601 bp, Human; identical to SEQ ID NO: 21731

SEQ ID NO: 172513 - DNA, 601 bp, Human; identical to SEQ ID NO: 21732

SEQ ID NO: 172514 - DNA, 601 bp, Human; identical to SEQ ID NO: 21733

SEQ ID NO: 172515 - DNA, 601 bp, Human; identical to SEQ ID NO: 21734

SEQ ID NO: 172516 - DNA, 601 bp, Human; identical to SEQ ID NO: 21735

SEQ ID NO: 172517 - DNA, 601 bp, Human; identical to SEQ ID NO: 21736

SEQ ID NO: 172518 - DNA, 601 bp, Human; identical to SEQ ID NO: 21737

SEQ ID NO: 172519 - DNA, 601 bp, Human; identical to SEQ ID NO: 21738

SEQ ID NO: 172520 - DNA, 601 bp, Human; identical to SEQ ID NO: 21739

SEQ ID NO: 172521 - DNA, 601 bp, Human; identical to SEQ ID NO: 21740

SEQ ID NO: 172522 - DNA, 601 bp, Human; identical to SEQ ID NO: 21741

SEQ ID NO: 172523 - DNA, 601 bp, Human; identical to SEQ ID NO: 21742

SEQ ID NO: 172524 - DNA, 601 bp, Human; identical to SEQ ID NO: 21743

SEQ ID NO: 172525 - DNA, 601 bp, Human; identical to SEQ ID NO: 21744

SEQ ID NO: 172526 - DNA, 601 bp, Human; identical to SEQ ID NO: 21745

SEQ ID NO: 172527 - DNA, 601 bp, Human; identical to SEQ ID NO: 21746

SEQ ID NO: 172528 - DNA, 601 bp, Human; identical to SEQ ID NO: 21747

SEQ ID NO: 172529 - DNA, 601 bp, Human; identical to SEQ ID NO: 21748

SEQ ID NO: 172530 - DNA, 601 bp, Human; identical to SEQ ID NO: 21749

SEQ ID NO: 172531 - DNA, 601 bp, Human; identical to SEQ ID NO: 21750

SEQ ID NO: 172532 - DNA, 601 bp, Human; identical to SEQ ID NO: 21751

SEQ ID NO: 172533 - DNA, 601 bp, Human; identical to SEQ ID NO: 21752

SEQ ID NO: 172534 - DNA, 601 bp, Human; identical to SEQ ID NO: 21753

SEQ ID NO: 172535 - DNA, 601 bp, Human; identical to SEQ ID NO: 21754

SEQ ID NO: 172536 - DNA, 601 bp, Human; identical to SEQ ID NO: 21755

SEQ ID NO: 172537 - DNA, 601 bp, Human; identical to SEQ ID NO: 21756

SEQ ID NO: 172538 - DNA, 601 bp, Human; identical to SEQ ID NO: 21757

SEQ ID NO: 172539 - DNA, 601 bp, Human; identical to SEQ ID NO: 21758

SEQ ID NO: 172540 - DNA, 601 bp, Human; identical to SEQ ID NO: 21759

SEQ ID NO: 172541 - DNA, 601 bp, Human; identical to SEQ ID NO: 21760

SEQ ID NO: 172542 - DNA, 601 bp, Human; identical to SEQ ID NO: 21761

SEQ ID NO: 172543 - DNA, 601 bp, Human
cttagataccgagtgcgtctagtttctactcaagagggactactatatcaaaagctttttgttacggttttcagaatcctaaggtacatttgtgtaaccaagtgtttttgtaactaaatgcagcaacaccactgaaaaatagttttaattttaaagacctcaatttattagtgtacttactaatctttaccctcatcctccatgctgtggactgtagaactgttactgtgtacttgaagagacttagctattgcatccaatttgtaacattcagtaaggttatatttataatttgaatttrtcaagtgttgatgttttgctgtgtgacagtgaaaagaattttaggaataaagtatgcaaatgaccattcgccacatatggaacttagactgagtatgataaaccttttgtctttatttggacataaagtatattgtaaactttttatgtaattataaatacacatttgaaaaatagacaaaaataaacacaaaactgaataaaagttttgtctaaggtttgtaactttcaaatgtctgaaatttaatataaagccaacatataaaacaatattgaaatcccagtttcaaattatggacat

SEQ ID NO: 172544 - DNA, 601 bp, Human
aaattaaaataaaaagcaatacttaaatgtcttttctcagcatttatgtatcatgttaagagtaacatttatgaactttcttagaattcatggtaaagttttttttttgtataatcatttaaaatgtactcttttttgagtacactttaaaaaacactttccatacttacttgacagtgccactctttaggtaagtcagactgtatggtcaacagttataccctagaagcaggctttgtaattgtcttgtatgatttaaaagttctctgaacttgagaattgactaatttttcacgcagtrttttttgggtttttttgtttttaagacagggtctctttttcacgcttttttttgtttttgttttggttttgtttttgttttcaagacagggtctcgctctgtcacccagactagagtgcagtggcacaatcatggggctcattgcagccctgacctccctgggctcaagtgatcctcccactttaacctctcgtgtaactggactacaggtgtgtaccaccatgcctggctaatttttctattttttgtagagactagcttttgctgtgttgcccaggctggtctcaaactcctgagctc

SEQ ID NO: 172545 - DNA, 601 bp, Human
ttttgagtacactttaaaaaacactttccatacttacttgacagtgccactctttaggtaagtcagactgtatggtcaacagttataccctagaagcaggctttgtaattgtcttgtatgatttaaaagttctctgaacttgagaattgactaatttttcacgcagtattttttgggtttttttgtttttaagacagggtctctttttcacgcttttttttgtttttgttttggttttgtttttgttttcaagacagggtctcgctctgtcacccagactagagtgcagtggcacaatcayggggctcattgcagccctgacctccctgggctcaagtgatcctcccactttaacctctcgtgtaactggactacaggtgtgtaccaccatgcctggctaatttttctattttttgtagagactagcttttgctgtgttgcccaggctggtctcaaactcctgagctcaaacaatccacctgccttggcctcccaaagtgctggaattacaagtgtgaaccaccacgccggacctttcatgcaatataatttaatatttcttccagggcgtatcatgtgaggcctaattttgatatcccaa

SEQ ID NO: 172546 - DNA, 601 bp, Human
ctgaacttgagaattgactaatttttcacgcagtattttttgggtttttttgtttttaagacagggtctctttttcacgcttttttttgtttttgttttggttttgtttttgttttcaagacagggtctcgctctgtcacccagactagagtgcagtggcacaatcatggggctcattgcagccctgacctccctgggctcaagtgatcctcccactttaacctctcgtgtaactggactacaggtgtgtaccaccatgcctggctaatttttctattttttgtagagactagcttttgcygtgttgcccaggctggtctcaaactcctgagctcaaacaatccacctgccttggcctcccaaagtgctggaattacaagtgtgaaccaccacgccggacctttcatgcaatataatttaatatttcttccagggcgtatcatgtgaggcctaattttgatatcccaaactccattccctgcagagtgccatagttttctgtgttaaaacactcatttgcatttcttgatgctcctaattatttttattatagaaatctgagaaatttaaaaatattaatattttagcaattgccttaaac

SEQ ID NO: 172547 - DNA, 601 bp, Human
ctgttccaccagtatacaatgtctagactttgtaggttccaagtggaaaattagttttagatgaatagtctacagctccaaaacaaactgaacaggcccaaaggaaggacaaagacatgtcataatgttcttgtttttaaacacacattttctgtttttagagtccttcaagccttaattcaggcatttttattcctcacgtagtgcacaatttttaaaagtttggtaaccaaatgtaaaaaggactgaaattactcctagagggataagagagttgaaaataagagcagaagaaaaactygaaaagccagatgcaagacattttgtaaaaacagcagtttatagcaacttaatgttatgacaaacatgcgtagaatctttcaagacactttgttttatacatagaatagtatagaaaataatgatctaggatcatgaagaagaggttattggatattagtaaattttgttaataacctcatgtattttggaaaaattccattcaaaatgatacaatttaaaacttttactgtgttaagcttttcttactgggaaggtttgcttaatgaggtaaaatatagtaggtaacagtatttattga

SEQ ID NO: 172548 - DNA, 601 bp, Human
ctacagctccaaaacaaactgaacaggcccaaaggaaggacaaagacatgtcataatgttcttgtttttaaacacacattttctgtttttagagtccttcaagccttaattcaggcatttttattcctcacgtagtgcacaatttttaaaagtttggtaaccaaatgtaaaaaggactgaaattactcctagagggataagagagttgaaaataagagcagaagaaaaactcgaaaagccagatgcaagacattttgtaaaaacagcagtttatagcaacttaatgttatgacaaacatgygtagaatctttcaagacactttgttttatacatagaatagtatagaaaataatgatctaggatcatgaagaagaggttattggatattagtaaattttgttaataacctcatgtattttggaaaaattccattcaaaatgatacaatttaaaacttttactgtgttaagcttttcttactgggaaggtttgcttaatgaggtaaaatatagtaggtaacagtatttattgaacaaaatttaagttgaaacaaataattatctgaaaatactgatcagtgcagtataatatactaccttgt

SEQ ID NO: 172549 - DNA, 601 bp, Human
ttgttttatacatagaatagtatagaaaataatgatctaggatcatgaagaagaggttattggatattagtaaattttgttaataacctcatgtattttggaaaaattccattcaaaatgatacaatttaaaacttttactgtgttaagcttttcttactgggaaggtttgcttaatgaggtaaaatatagtaggtaacagtatttattgaacaaaatttaagttgaaacaaataattatctgaaaatactgatcagtgcagtataatatactaccttgtaatttgtagaggtagatactrtaattactatgtgtttctttgtttactttgctatgaaatatgtaaaattgagtagcaacatttttttcttgacccacttttaatgaaaacaacctgttgcattgataagacaaaataactaagtatttcttcaacttttattctgttaaagaaaataagcttaattccttggcattgcctggttaaccggactgggaaaattaggttgaaagtcatagttctttgctaaaagtatgtggtgtctgacagattgggtgacctgaaatagattatatttaattcagtttgggtttgtatata

SEQ ID NO: 172550 - DNA, 601 bp, Human
aaggtttgcttaatgaggtaaaatatagtaggtaacagtatttattgaacaaaatttaagttgaaacaaataattatctgaaaatactgatcagtgcagtataatatactaccttgtaatttgtagaggtagatactataattactatgtgtttctttgtttactttgctatgaaatatgtaaaattgagtagcaacatttttttcttgacccacttttaatgaaaacaacctgttgcattgataagacaaaataactaagtatttcttcaacttttattctgttaaagaaaataagcttrattccttggcattgcctggttaaccggactgggaaaattaggttgaaagtcatagttctttgctaaaagtatgtggtgtctgacagattgggtgacctgaaatagattatatttaattcagtttgggtttgtatatatctgcgatatagaattcaaaatttcaccagagctttagttctggttcaaataaattacattttattttaatattgtgatctcttgaattctgtgactataaggataggtaggagagctagttattttgctcctaaaacaaatattggtttatctaccatgtgc

SEQ ID NO: 172551 - DNA, 601 bp, Human
ctttttctcaattggaactcaattatacctgatatttgcaggtatatatgtgtattatataaataccataatataacaacaatgatcctgtgccaagatcttgaagatttttgttttatcaaagaaagctgaaattgtttaatataattgaagttttcttatattttgtcatattcaaattctttgaaaattgataatctataaatagtagattgatgtggtaaaaataaaaattgttcattagcacatcttatggccattatccagtttttataactaattatgcaaattgataatattwgagttgcttccaagagcaactaagaatcactaatgtcaacatttttttcttcctggcatgatttaaataatatatcacttgctacctgcaaattactacgtgatttacatgtttgtggtatggaaatttttttcatatcaaagcttctgatgtgggaatcttatttcatatcaaagcttctgatgtgggaatcttattttgagattttctttatctgcttgaactgctataataaaataccatagactgggcggcttaagcaacagtatatatatttcttacagttccgaaggctagaaa

SEQ ID NO: 172552 - DNA, 601 bp, Human
ataactaattatgcaaattgataatatttgagttgcttccaagagcaactaagaatcactaatgtcaacatttttttcttcctggcatgatttaaataatatatcacttgctacctgcaaattactacgtgatttacatgtttgtggtatggaaatttttttcatatcaaagcttctgatgtgggaatcttatttcatatcaaagcttctgatgtgggaatcttattttgagattttctttatctgcttgaactgctataataaaataccatagactgggcggcttaagcaacagtatatrtatttcttacagttccgaaggctagaaagtccgagattgaggtgccagccgtttctgttcagggcgaatgaagagtctcttacaggtcttcctgctgtatcttcagttggcagaaagtgagagagcaagttctctggtctcctcttacaagggcattaatcccattatgaaaaccccacccttgtgacctcatctaaacctaagtacctcccaaaggtcccatcttcaaataccatcacattggaggttatagcttcagcataagaatttgggaaggacacagttcaggacatagcagga

SEQ ID NO: 172553 - DNA, 601 bp, Human
tcccatttgctgctatataaaataaatcagtcccatgtctctccatgtctttccaaaatattttattttgcttccttaccaaggagggaaaaagttgaatgaatgaatttgaagatgctatgagttgtggactcttgacataattctagttaaatggacaagtgtagaacattttatttttgtggacagccgttagcctctatcccctacctcaggttcacttgtgctgcttaaaggtgtgcttttccatttctctgtaaacaataacattcttttgagcatgttaattgtgggtgttttstcattctttggaccaatcttttggtcttctaactttgaaagctcctttttaaactcttaaactgcaaaaatatataggtttacatgatttaggtgggagagctctttctttttatttaaaagaataagaagcctttacatcttaataaataatgggaaatacaattgaaatcttgtcatttttaggtattcatgtcaaaatttgagtgacctggagttaattttaagtaggatataggggaactccatgcatgagatgaaaccttgtttattgttcatttatcatgttattaaaccagta

SEQ ID NO: 172554 - DNA, 601 bp, Human
tgcatgagatgaaaccttgtttattgttcatttatcatgttattaaaccagtatttattgagcatttattttgtgctcaataaaaggttcataatattatgtttagagttatttatagagtaaaaattgctgtctagaatggcagataaagccaaattagcaagtatttattgttctttcaataaatataagtgttatatgtgctaagtattgtcctaagtactagaatacaactgtgaaaaaggcagaagggttcctgttttcccattacctttaaatgagagagtcagacaactaaccygccaagtctaataatagcatgataagtgttctgttaggggaagttttaagtgggaacacagaggaggtggtatgcagaaaggcttttgaataattaggaaaagccttcccagacctctaagctgaggtctgaagagtaagtaggagttagctcagtgaagaattgtaaatctgtgtttctggcagaagaatatagcttgtgcaaagtccttgagacaggagatagaagacgctgccatgggatgtgaaagaagttcatgtgaccatagtgcaagatgggaagtattagagttgtggcaaa

SEQ ID NO: 172555 - DNA, 601 bp, Human
atagagtaaaaattgctgtctagaatggcagataaagccaaattagcaagtatttattgttctttcaataaatataagtgttatatgtgctaagtattgtcctaagtactagaatacaactgtgaaaaaggcagaagggttcctgttttcccattacctttaaatgagagagtcagacaactaacctgccaagtctaataatagcatgataagtgttctgttaggggaagttttaagtgggaacacagaggaggtggtatgcagaaaggcttttgaataattaggaaaagccttcccagayctctaagctgaggtctgaagagtaagtaggagttagctcagtgaagaattgtaaatctgtgtttctggcagaagaatatagcttgtgcaaagtccttgagacaggagatagaagacgctgccatgggatgtgaaagaagttcatgtgaccatagtgcaagatgggaagtattagagttgtggcaaaagtatgcaggggctagatcttcaagacatgtgaattattattaagaaatttgggtttaatcctgaggactcccctcagttcttttaattggacattaacctgattagatttgaa

SEQ ID NO: 172556 - DNA, 601 bp, Human
gttagaaggctattagaagagagaatttggtataccttatagcagggtaatggcagtgagaatgaagagaagccaatggcattgagaaatttggggagaaaaattgataagatttggtgattgtcagaatgtaaacattgaaggggagagagaagtcaggatgacaccacctggattcctagccccctttcaccttttttggttgattcctgcttagatgttatctcttttaagaagcctttcctgattcccctaacctccaaggctaattcaggtgccttccctttgtgcttcaacagcmcttactcgacttttttcttgctttactcacttgtgtataagctttcaggcaaggattgtgctttattgttattgcatggtttgcaccttgcaaagtgcaaggtatactaagtgcattacacttagtataaatgttgaccaaatgaaaatatactttttatatttataaaaatttaaatgtaattggagaaaattggttttctgaactgctaatattcaaaacttgttttacaactttagagtgagtcatatcattccatgtacttctgaatgccacttgtaaaaacagtttatattgtaa

SEQ ID NO: 172557 - DNA, 601 bp, Human
tactctctcacgttttgttggttatataaaaacattatcaggaattgtaacaattacattatattctatagccatagccatagttttagaccaatagttaagtggattcaaatgctcaaagtttgttattttcgatagttttttaaaaatcttttagatggctgaactttatcatcaagtattttcttaaagtttatgaaaactattccttagggttttgcatatttaatgatgttttatgctgggggtaaattcttgagtactctagatattgcttcactgattttttttttttttttttgagtcggagtttcgctattgtcgcccaggttggagtgcaatggcgcgatctcggctcactgcaacctccgcctcctgggttcaagtgattttccagcctcaacctcctgagtagctgggattacaggcgccctccaccctgcccggctaatttttgtattttttttttttagttgagacggggtttcaccatgtggccaggctggtctcaaactcctgaactcaggtgatccgcctgccttggcctcccaaagtgctggtattacaggcgtgagccaccgcacccagcctgcttcactga

SEQ ID NO: 172558 - DNA, 601 bp, Human
gcccaggagatggcctcgaccatcaagcaccaggacctgcacctctgccatcttcggctgccccttgggaaagctgctttttttttttttggtccaatcctgactctgtgtttcagtgatgccaaatgaggtctgtgaaagcttcaaatgtttcaagcaagggactgttgggtttgcttttctgactgtcatgtaatttacagaactgaactaatagttttaagatttgaagatgcaagccatttccctggcttgagctcttctagcatccctctttgccttcactgtatttagtagaccytctcatatgttatggttagggatatgtcttagtttgttgaagaagtagtttgtgtttctgtttctcactctcttctcctagttgttttcagatatttttaagaggaaaagaggggaccataccatctttcaaattagaaatcctaagagctacaggtcagtccagttttgtcagaattaagataactttaagggataaagtatgggctgatgtagttttccgaaagccaaaaatagttcatttacagaggctcttttggataaattttttttattaaacaaaatcacaatttaacatatg

SEQ ID NO: 172559 - DNA, 601 bp, Human
ctgctttttttttttttggtccaatcctgactctgtgtttcagtgatgccaaatgaggtctgtgaaagcttcaaatgtttcaagcaagggactgttgggtttgcttttctgactgtcatgtaatttacagaactgaactaatagttttaagatttgaagatgcaagccatttccctggcttgagctcttctagcatccctctttgccttcactgtatttagtagaccctctcatatgttatggttagggatatgtcttagtttgttgaagaagtagtttgtgtttctgtttctcactctcytctcctagttgttttcagatatttttaagaggaaaagaggggaccataccatctttcaaattagaaatcctaagagctacaggtcagtccagttttgtcagaattaagataactttaagggataaagtatgggctgatgtagttttccgaaagccaaaaatagttcatttacagaggctcttttggataaattttttttattaaacaaaatcacaatttaacatatgagtttgattatatcagtttgtagttatgaagtcttgtgcattaaaaagcattaagaatgaaactagtaagtct

SEQ ID NO: 172560 - DNA, 601 bp, Human
ctaaataagtgtactttgagcagttgaaacactgtgagatattgatagatatttcccaaaaagggttttgtgatccaaataaatttgggatatcttctatgtaatataataatgtactttgcgaagaacgtatagaacactaataatttctacttaaaggaagagtataattagattggaagcacttcttattccaaacctatttgatagtggaactaaatgttgtagaaatacattttgggaaatgctgagaatatattatagaatattttcagatcagtgtgttgttaacggtattccrgtacatgtatttgcatgtcagttgctttttaatagggataaatgataattgctgtcccaggatgtaaatataatcagaacatttaactgtggtagtatgttttctataaatctgagagttttttgacatggaaattttgttaccattgattttccagactaaaagtaatttttgagtgcctcctatgtattaaacatcaaaaattgatcttctttggaactactttctgttaagtcttagcaggaggaattttggaaatcttgtagccctcccgacttatttttcagtaaaaactgaagc

SEQ ID NO: 172561 - DNA, 601 bp, Human
ttagaatgtttggatatgttgaaaaatgattcacacactctttctatagattgaccacacacatttgtctttcttgaggaaagacaaaatagtggtatttgtggtggggttttttttttttttttttgtgacagggtctagctctgttgcccaggctggagtgcagttagcacaatctctactcactgcaacctccatgtcctgcgctcaagcagtccttccacctcggcctcccaagtagctgagacaacaggtacatgccaccatacccaactaatttttaaaatagttggtatttacrttatttttctctccccatctctcactttttttttctaagttgtgataggtgtgtagtgatctgtcattgtgattttaatttgcattttcctattgattaatgatactgaacatcttatttgaacatacttgttttctgtatctcttcttccgtgaaatgtctgcctgagtctttgcccattttctgcttgtattatttcttttattaatgttgagtttttgtttgtttgttttgcattttcctctgttgcccaggctggagtgtagtggcgcgatcttggctcactgcaacctccgcctc

SEQ ID NO: 172562 - DNA, 601 bp, Human
gtttggatatgttgaaaaatgattcacacactctttctatagattgaccacacacatttgtctttcttgaggaaagacaaaatagtggtatttgtggtggggttttttttttttttttttgtgacagggtctagctctgttgcccaggctggagtgcagttagcacaatctctactcactgcaacctccatgtcctgcgctcaagcagtccttccacctcggcctcccaagtagctgagacaacaggtacatgccaccatacccaactaatttttaaaatagttggtatttacgttatttytctctccccatctctcactttttttttctaagttgtgataggtgtgtagtgatctgtcattgtgattttaatttgcattttcctattgattaatgatactgaacatcttatttgaacatacttgttttctgtatctcttcttccgtgaaatgtctgcctgagtctttgcccattttctgcttgtattatttcttttattaatgttgagtttttgtttgtttgttttgcattttcctctgttgcccaggctggagtgtagtggcgcgatcttggctcactgcaacctccgcctcccagact

SEQ ID NO: 172563 - DNA, 601 bp, Human
tttacgttatttttctctccccatctctcactttttttttctaagttgtgataggtgtgtagtgatctgtcattgtgattttaatttgcattttcctattgattaatgatactgaacatcttatttgaacatacttgttttctgtatctcttcttccgtgaaatgtctgcctgagtctttgcccattttctgcttgtattatttcttttattaatgttgagtttttgtttgtttgttttgcattttcctctgttgcccaggctggagtgtagtggcgcgatcttggctcactgcaacctcygcctcccagactcaagtgattctggtgcctcagcctcccgggtagctgggattacaggtatgtgccaccatgcctggctaatttttgtatttttagtagagacagggtttcgccatgttggccaggccagtctcgaactcctggcctcaagtgatccacctgcctcagcctcccaaagtgaggcatgagccactgtgcctggcgtaatgttgagttttgagagttctttttatgtttaaatgtaagacttttgtcgaatacatggtttgcaaatattttctaccagtctatataacctgt

SEQ ID NO: 172564 - DNA, 601 bp, Human
attgtgattttaatttgcattttcctattgattaatgatactgaacatcttatttgaacatacttgttttctgtatctcttcttccgtgaaatgtctgcctgagtctttgcccattttctgcttgtattatttcttttattaatgttgagtttttgtttgtttgttttgcattttcctctgttgcccaggctggagtgtagtggcgcgatcttggctcactgcaacctccgcctcccagactcaagtgattctggtgcctcagcctcccgggtagctgggattacaggtatgtgccaccawgcctggctaatttttgtatttttagtagagacagggtttcgccatgttggccaggccagtctcgaactcctggcctcaagtgatccacctgcctcagcctcccaaagtgaggcatgagccactgtgcctggcgtaatgttgagttttgagagttctttttatgtttaaatgtaagacttttgtcgaatacatggtttgcaaatattttctaccagtctatataacctgtttttttcattctcttaacaggatcatttgtggggcaaaactttttaatttcgatgaagtgcagtgtattga

SEQ ID NO: 172565 - DNA, 601 bp, Human
gcttgtattatttcttttattaatgttgagtttttgtttgtttgttttgcattttcctctgttgcccaggctggagtgtagtggcgcgatcttggctcactgcaacctccgcctcccagactcaagtgattctggtgcctcagcctcccgggtagctgggattacaggtatgtgccaccatgcctggctaatttttgtatttttagtagagacagggtttcgccatgttggccaggccagtctcgaactcctggcctcaagtgatccacctgcctcagcctcccaaagtgaggcatgagcyactgtgcctggcgtaatgttgagttttgagagttctttttatgtttaaatgtaagacttttgtcgaatacatggtttgcaaatattttctaccagtctatataacctgtttttttcattctcttaacaggatcatttgtggggcaaaactttttaatttcgatgaagtgcagtgtattgattcttttcttttatgaaaaaaaatttttttttgcctacgaattactagtatttgaagactttcttgtatgttttcttctcagaattttataggtttacattttacatttaaaaccatgat

SEQ ID NO: 172566 - DNA, 601 bp, Human
agttctacaggcatgttttcctttagttcattgaacattttaaaaatagctaacttacaggagatttgatattaaattttcatttacaacttttacctaagtgaacatgggctatcatgaccttctgtgagcctgtgtcttcaactccagggcgtgatcaataataaatggctgagttgtcctgctggaacactgaaaccttgctaactcactagagaacaaaaagtagtctcaccatgttaaatattaagtgagtaacttgtgtttgtcaaattgagaacctattttcttatatctaaayaaggaagttaatcttgaggcagtaggaatggaattaagcattctggtcacggaaagtcacattggccttctatggatcagttttaacagtctgcattctccttttcttcttggcaacccagaatctttcaaccaactcttttagcacacttcttccacatattatcatttcagatcgtcttttgccccaactttgccccaagtggctgtggattggatttgatctcaccagtctcctctttcttgctcgtctcaaaggaagacctgcctattatctccctgcttttttgttattacagaa

SEQ ID NO: 172567 - DNA, 601 bp, Human
ctgcccacagtggaaaatgaagataatccagatcacaaatgaaaagtatgtatctttgagccaaaaaaaaaaaaaaaaagctgacttagaagtgtttaataagtccaatatctggatttcctcagggacagtttctgttatttgcttttcttcctgtgtatggttcatattttcttgtttctttgcatatcttataattttttgttgaaaattacatttggacattttaaataataaatgatctttgaaataatgtggacattctaaataatataaaaatgtccaaatagtggagacttayaataaaataatttgacaactatgaaaatcacattttgccctctcttcagggtttgttggagtacttgtagttgtttcttcatttaatttcttttgtgaattaattctgcaaactctatttgatgtgtgtgactacctcagtagataattcagtctctagttggttagcttagttgttgctaatgactggacaaagatttctttacatgcctggaaccagtaaatctcctagtctttgccagaggattttgtgtgtgtgtgtcttggggcatgccttcaacactcagctgggtagttggca

SEQ ID NO: 172568 - DNA, 601 bp, Human
agtacttgtagttgtttcttcatttaatttcttttgtgaattaattctgcaaactctatttgatgtgtgtgactacctcagtagataattcagtctctagttggttagcttagttgttgctaatgactggacaaagatttctttacatgcctggaaccagtaaatctcctagtctttgccagaggattttgtgtgtgtgtgtcttggggcatgccttcaacactcagctgggtagttggcaactctgccttgtccttatgtcctgcttgtgcagagcttcaaagcttaggcccttttcagrtcttccttgagcatgtacacagccttaggcatgtgtatgaccttctagattcccagtaatatgtcagagcttttcaaagtctgttacgggtatttcattctcagcttttccttttaagatttaagtctgttgctccaactgttattcactgcctcaagtagatatggtataaaacactttcctgtaatttttttcaatgaatatctccctggggaaaaggcgttttgcattgtgcaagctctgagtcaggtcacatacggtcagcattgcaaatagggtcttcctggaaacaagactgct

SEQ ID NO: 172569 - DNA, 601 bp, Human
aaatgatgcattgaagaggataggaactacagttgcacattaattgtttcaccccttcccaagcctgtgcagcacagtatggagatagatgccctccaagtggaggaaggagagtcaagtgagcccctaactttactgtgaaccccagcactagaaccacctcagtgaaccccagtgccaggctggcacccatggacccaggcaccaggccagatcccacagaaccagtctccagacccatccttgcggatccagtaactgaggctagcctgctggagaagtcaggcagcaagcctgctcrtggactatgccagccatgctgtccggaatctctggacaggctgactggtaaagggcttcctatgttaaagctcctctgtaaagactggagaggtgactacttcttcaaatatgcagacaccagtgcaagtccataaggatctcaaatgatcagggaaacgtgacaccatcaaaggaacaaaataaagctttagctatgataatttgttgataaatatataatctaaaaagatataagttgtgtcctcaataatgtaaacttggagagggtgtggagaagttaagagtttttgtatgtgat

SEQ ID NO: 172570 - DNA, 601 bp, Human
aattaaatttttatcagcttaacaacagactattataactacaagatgtcttatatacatttcgtggagaaaaacccctgtaaatacacaaaagataaagagaaagcaaataagtaccaaaaaaaaaaaaaaaatcaaatcgcaaaggaaaacattaagagaagatgaaagaaatagaggagctacaagatagtcagaaaacaacaaaatgacaatgttaagactttatccacaattacttttaatgtaaatggattaagttctctaatcaaaaggcagagttttttaaaatatatttttyaaaagatcctacagtattatgcctaaaagagattcattttagcattaaggacacacataggctgaaaatgaagaaatggaaaaagatatttcacgcaaatggtaaccagaagagaatggggtggctatatttatgtaagataaaatagacttcaagtcaaaaactgtcataagagacaaagtcattatacaatgataaagaaggcagttcatccagaagatataatagttgtaaatatatatacactcaacatcagagcaccaaaatattttttataatgagaaagccaagattctaaaa

SEQ ID NO: 172571 - DNA, 601 bp, Human
tgttggccaagctggtcttgaactcctgacctcaagtgatccgcccgcctcaggctcttaaattactgggattacaggtgtgagccaccacgcctggcctaataatgtcttttcaattgattaaaacttacaggcacagggctgtttttatttttgatttaggacagacttaagaggtcatctgtagattgttacagacaatgaaactactagtttctcttaaatattgccctctttcacactagttaaccttaattttttgcctttttacgttttgtttttttcagcttttaataaagcrgtaatttaagtgattttttccagttaaatttttaaaatatagtcttcacttttagataaattttaggttcatagcaaaattgagttggaagtacagagttcccgtatattcccttttccaccctacaagcgaagtcttccctgccaccaccatcttgcatcagagtaagcacattcattattattgatgaacttgcattaacatattatcacagaaagtgcatagtttacattagggtttttactgttgtaggttcaatggattttgacaaatgtgtaatgacatataactatcactata

SEQ ID NO: 172572 - DNA, 601 bp, Human
agaatagaaattgaaatatttgaattaattacatgttttattttctgattatacattttttaacatgagagaggcagcttggttagggtggcaggagtatattgactatggaatcagaagacttggtcatctagaatcatctcattcactacctagttatatgataaatgtttatgttagcatcaaaataaaggggtagtatcagctagcttctttgcagcagattctcaagtcactttgaaattaaaagtgcctttgaaattaaagtttaaatgttttgttattttaatatgggtcttatctactataaaacaggaactgataaagatgctaacagtatatttgtgaacaagacagacaaggtcccttatcttatggaaggaagtcttacagagcttacattcttgcagggaaatgggatgtatcataagcaaataaacataaaagagtaaagtaatttcatatactaataaatgttatgaagaaaataaaacaggatagatggtcagagaaggctttatttaaggggtgaagcttgaggtgagtcctaaatattataaagagtcagccatgtgaagactggggaagaacattccaggca

SEQ ID NO: 172573 - DNA, 601 bp, Human
agggggaaaatagaatcttttaaccaagaaatacataatgtgactttgtgtcattgctctgttttctataatttttgtttcaaccaaaatattataatttcttttttactaaagtacattgtcctagagtagaaattgaaatatgagacttaattacatgttttattttctgatattacaatgttcattcaacactgaacaaagttcctgttctcgttgaagagttaggaggaaggaagggtataaagacataaggaacaattaagcaaataaaataattttagataatttaaaggtcatkgtcatcaaaattggaagatatgacagagttgtaagtgatggaaacttattaaatatatgctttttaattacatgggtcacacaacccaaatatatggctatgtatgggtagcacatgcaccaacatatgtagagaattatagactttgcagagtcacctgtaatagcttcctctggtatctgcatgtgcctaattgcctgaaatgactcctgtggatccaacaggttttttacatttcatgtctttttttttttgagacggagtttcgctcttgtcacccaggctggagtgcaatggcgc

SEQ ID NO: 172574 - DNA, 601 bp, Human
agtagctgggattacaggtgcgcgccagcacacctgggtaattttttttggtattattagtagagactgggtttcaccatgttggccaagctggtctcaaactcctgactacatttcataccttaagaccactctgcttctttggatatagctgcttgcaattctgctgctttgcctaatgtcctgtgatactttgctgctttttaaaaaacctttgtttttcacagcagtgctccttgtcctaaaatatgttgaaattgtggaataaaaagtttaagacttttccagtttgaaaactctycttacatgttaaaaaatgatagtcttgtataaaatgaatgttttaaatcttacatttatcttgatctgcttgggtttagattgtctgcctctgttaccttatataatcattgtgtttttcatgtttatgagaaataaaagaaaaaataaatgattgggccctaggaaaaatcctttttttttttaaataacaaagtattccgtttaatgttccttttaatatattgccagtgaaatatctcgtaagtagcttcttcttgtaagaaagttagctatatttgtagcctctttaattgaaaga

SEQ ID NO: 172575 - DNA, 601 bp, Human
tgtggaataaaaagtttaagacttttccagtttgaaaactcttcttacatgttaaaaaatgatagtcttgtataaaatgaatgttttaaatcttacatttatcttgatctgcttgggtttagattgtctgcctctgttaccttatataatcattgtgtttttcatgtttatgagaaataaaagaaaaaataaatgattgggccctaggaaaaatcctttttttttttaaataacaaagtattccgtttaatgttccttttaatatattgccagtgaaatatctcgtaagtagcttcttctwgtaagaaagttagctatatttgtagcctctttaattgaaagaaaaggttctagctgacctgcagaattagacatcagggtaccttttctggtgaacctggagctttgttcagagatcaagaaaacaagctctttattgggcatttgccctaaggcaacattaacttaatagatattttcttcctgtaatttgctgatctttgtatttaagtttggaaatagcaatattcataaatgggtacctttggttgtagtattgttccatgctttcataccatttaaatggttcatcaagataaaa

SEQ ID NO: 172576 - DNA, 601 bp, Human
attccttttacttctttcatcaaccccttagcaaactttgcctttcatgttctcaacagattaatttgcttctgtttcaccaaacaaatatgattctgtatgtaactggagatgataatcccacttaactctcttattcctcctcccttcaaacaaacttgtctgtagctgaatccattctcattttttaattgaaaggaaaaaagatccgtcttctctaaggctaagttttctgccagtatgctacatatttttgactactccttccttctaaaatttaaatagatgaactggctgctgytttgacaataccctttcctagtttatgtgtacctctgtttctctttgaggcctttgtcttccatccatttctttctttcttttttttttttttaagacggagtcttgctctgttgccaggctggagtgcagtggtgcgatcttggctcactgcaacctctgtctcccagttcaagcgattcttctgcctcagcctcctgagtagctgggactacaggtgtgcaccaccacgcccagctaatttttgtatttttaatagagacggggtttcaccatgttggccaggatggtctcaatctcc

SEQ ID NO: 172577 - DNA, 601 bp, Human
ctagtttatgtgtacctctgtttctctttgaggcctttgtcttccatccatttctttctttcttttttttttttttaagacggagtcttgctctgttgccaggctggagtgcagtggtgcgatcttggctcactgcaacctctgtctcccagttcaagcgattcttctgcctcagcctcctgagtagctgggactacaggtgtgcaccaccacgcccagctaatttttgtatttttaatagagacggggtttcaccatgttggccaggatggtctcaatctcctgacctcctgatccgtcygcctcagcctcccaagatgctaggattacaggcgtgagccactgcacttggcccatccatccatttctaaatatttatcttccccagagtaccagtatcatcttctacatgcgttttgtggatagtctcatctgaaacctttgctgttgacaccaaagctgtatctttatttctagcccagacctccctcctttattctaaaatcacattttcaagtgtggactagactagaatctaagtataaatttgttcaaaattttactaattttctttttttttttgttccctgtcttgaataat

SEQ ID NO: 172578 - DNA, 601 bp, Human
atcatgctgcctccacctgatttaagccggctactcagacattaccctgaatcccttccttctccctactcctgttcatccccaactgctttctgtttctagaattattcctatattttcctagtacctttgtagtttaaaccaattgttctcaagtacatcagacctaatatcccatttatgcaacattctgtaacacttccttactcttaaaatgatagtaacctacattatttttaaaaatctatgtaatttcttaaaggagatatataagaaaaatattgtacattttatatgttaygtaaatgcttaggcacaatgatattagaaaaaaatgaagaatttattatacattttatgtttcagtatttaagtgttcaggcacaataccagaaagcaatgaagagcaaaagtttgtacatatgtcctcatgaatgtgattgttagaagtgcaaactgatatagacgtgttatatttttgactcggataccaagatcagtatgagtatcagtgatcatcagaaataacaaataactcttaaagaatagtgcaaaaatattgcagtttttgtgtaaaatggaattaggtgctcaaaattat

SEQ ID NO: 172579 - DNA, 601 bp, Human
cagtatgagtatcagtgatcatcagaaataacaaataactcttaaagaatagtgcaaaaatattgcagtttttgtgtaaaatggaattaggtgctcaaaattataaacaggtatttcacctagttatatatctggtaggtatttgaaggttgtacagtatgcaaggatagttctcatctccagacctggcccattaaatgccagtagcatttctctaaacattgagacaacctaaagtgaacctacaaaattccaaaatactgtagctaaaaatagttagattgtacctttatcatgtttrgcatggactgttgcagtggcttccaaattcggctctacatagaatcacctggaaaactctttaaacatacagcttactgttccctaccacagatatttattttgttagcattcttggattaggggttaggatttctaagctcgccagatgattcttgctgaaaatgtctggcaatgattgaacattagggaattcttgctgaaaatgtctggcactgattaaacacgaaattattactgctttttaaattttctgccttccttctgaagtcctgactgtttacagtcattctaaacattg

SEQ ID NO: 172580 - DNA, 601 bp, Human
gctaggattacagacgtgaaccaccacgcctggccaaatttgtagtgtttttgtttggggtcactaatggttaagtgtattcaagggagctaacatatcaagtgcttcatatgcggtagttattaggtggaggtgaataaaagagtcctctggggtagtaaagatccctgtataaaaacctccttgccagcctcagcttaattattgttgcaattttatgcttttatcactagatttcaagcattttgagactgggtactgtgtattctattacctaaatgagtgcaagattcaaattttrtgcaaatatagccttcccccaaaacatagtggagttgaagtgattaaaaaacaactattaaataaataacttatttccaagaaacatgaaagattactctcaatatgttttcttatctaaaacgtttgacagtgtcacctgattcaggtctgaactagatccagaacttaatttttgactgtcagataatttgttagttctcttggccaaaaatatttttactggatgtgaaaaatttttagttaatagctaggtctggctggttagttaattcccttaagtaaagcatagtaattttgt

SEQ ID NO: 172581 - DNA, 601 bp, Human
tattctattacctaaatgagtgcaagattcaaattttatgcaaatatagccttcccccaaaacatagtggagttgaagtgattaaaaaacaactattaaataaataacttatttccaagaaacatgaaagattactctcaatatgttttcttatctaaaacgtttgacagtgtcacctgattcaggtctgaactagatccagaacttaatttttgactgtcagataatttgttagttctcttggccaaaaatatttttactggatgtgaaaaatttttagttaatagctaggtctggctggttagttaattcccttaagtaaagcatagtaattttgtcaaggtcaaaagctttattctctgactagttatatttcttatgagctattattgaactatatatatcagcaaatctcattaggtacaagtgctacaggatgagtttgggggtcactagttcaaattcatcaccactgcagtaaacccatcagacagttcaagtatcagtctgaatttcagatacagtggctagtattatggattatgggaagtccttttagatttcaatgggaactttattaataacttatattttcattaat

SEQ ID NO: 172582 - DNA, 601 bp, Human
ttttcttatctaaaacgtttgacagtgtcacctgattcaggtctgaactagatccagaacttaatttttgactgtcagataatttgttagttctcttggccaaaaatatttttactggatgtgaaaaatttttagttaatagctaggtctggctggttagttaattcccttaagtaaagcatagtaattttgtcaaggtcaaaagctttattctctgactagttatatttcttatgagctattattgaactatatatatcagcaaatctcattaggtacaagtgctacaggatgagtttgkgggtcactagttcaaattcatcaccactgcagtaaacccatcagacagttcaagtatcagtctgaatttcagatacagtggctagtattatggattatgggaagtccttttagatttcaatgggaactttattaataacttatattttcattaatacagtttctttcttgacccacccattaccttcaaccttcattgttttttaattatatttgaaaaatataatattaaatatactggtgttcagatcttacatttggtcatatcatgtgtttcccgaacttgataagcttttgttga

SEQ ID NO: 172583 - DNA, 601 bp, Human
caagtctcatcaaggttgtagcatgtatcagtacttcattcctttttattgctgaataatatttcattatatgagtataccacattttatttatgcatttatcagttgtcagacatttgggttgtttttgctttctgactgttatgagtatagtttctgtatttgtgtacaagtttttgtgtggacatttgttttcacttctcttgagtatatacctagtagaattgttgagtcatatggtaactctatgtttaacctttttgagggattactagactgttttccaaagggactgcaataktttacattcctaccagcagtgtttgagggttccaatttctctgcatcctcagtaaccttgttattatccgtcttttcttattataaccattctatcgtgtgaattggtatctcattgtagttttgttttgcagttccctgatcactatatatttgtttttaattcttgagagctatcttttattgtaacggaaagacagaaatagttattttctgtgatgtagatcttgctttaatgggtttttaatttaaaagaagttctgagctccttggagaatgtttataaaataagacctgtgct

SEQ ID NO: 172584 - DNA, 601 bp, Human
tattgtaacggaaagacagaaatagttattttctgtgatgtagatcttgctttaatgggtttttaatttaaaagaagttctgagctccttggagaatgtttataaaataagacctgtgctcaatgatcaagtaaaatggaaatttgacattttttaaagtgttaaacacctttaatgtaatttgacttactgcagaaacccataacagggaatttttaattcaaaatatatgctaattataattttgttaaactttcatttatgcatattagagctacattatttataaatatatattaamtttatattatattagatgcttattcttcttgtttgaataaatatatcactttaaatcatgccatccagtttttattcagcagtatatttgaggaatataagtttttagctgggcactgtgactcacacctcaaatctcaactactgggaagactgaggcaggaggatccttgagcccaggagttggctgggcagtcagctatgattgcgccaccggacttcagcctgtgcaacagagctagaccctatctctaaaaaataaaataatttttttaaaattaggagttttcgaaatagagcc

SEQ ID NO: 172585 - DNA, 601 bp, Human
ctgttcagagccagagatctatcagaaagtagctaagaaaacttttcatttagtaatgttcatttacttttctccttttgtatgttaaggcatagacaaataaagtaagtgtcccttctttttgggttaagtagacaaattgaaaccttagtcattgctttcttttatagatcagtgttccattcttcctgtcattccttctttctccatttctaatcttgaaaaagactcttcactctatacaaagacagtcaagaacccatgttttcagagggaaaacaggaaataagcacttttttayctcctttcccaactgattggttcctttgagtttcttgtaaaagatgtgcttttgtatattctctgtttatgagtggattagagcaggggccaccagatagacagtttgtataacgaatctatttattcaggcaactctagacagtgaagttttaaaggattttatttttctgggaaggaaatcgttgctcattgaaaccaggtataaacttcattttgtattttgctaatattcctgtgatttcttttctctctgaattgtgggtttaggatttcttctctttctttaaagtttccctta

SEQ ID NO: 172586 - DNA, 601 bp, Human
ctaagtaacttactttagcaggaatgataaatcagtaaagggaattcatagttgttaataaataacttcttttgactgggaaccagcaagaaacattagaaacctacaaatgaactctttacttattactgttaggaaattgtgattttcactaaacaacaaaaacccagagaagttattattgctaaaggaggcaaaaaaacaacaacacagaatagcactttgggaggccaaggcaggtggattacttgagcccaggagtttgaaaccagcctgggcaacatggcaaaaccccgtctcyacaaaaaattagctgggcatgctggcacacacccacagtcccagctactcatgaggttgaggtgggagagtcacctgagtccggtaggttgaggctgcagtgagctgtgatctcgccactgtagtccagcctgggtggcagagaccctgtctcaggagaaaaaaaaatggaacacagaaaaatagtacttgaactgttttagaaggacttgataggatcaaaggagacagtttactttccatgtggctgaggtatgggaaagagagggaggcagacattgtaccgtaaagacagcatgtt

SEQ ID NO: 172587 - DNA, 601 bp, Human
aaaacttgcttagaagagcccctgaagtcgtctttgcaatgaaaaggaataattaagcttttaagacaagtataaataatgttctggtataaattctgacctctctaaatctgttcaaacttgtgggacaagtgtttccaactctttttaattatatagttttacgaatgtattttaataagatttgctctgatttttatagagctgaactctgaatatttgaaaaatatccctataaagaacaagagttattttagaatataagaatcctaaatgtgagtcaaataagagtaaaggaaartttataaccgtgaaacaaacctaaattactcatttaccaatctttgattgcctactaggtacattttcaaagggcctttttatatatttctggatttaatttactaaaattttgttaaggattttttttgtctgtattcatcatagatattgatctgtaattttattttcttttttaaaaattttgatcatggtttggtatcagggtaatactgtcctcatatcatagaatgagttgagacatgtttcttcctcttttatattctagaagggtttgtgcagaattagtattatttcctcc

SEQ ID NO: 172588 - DNA, 601 bp, Human
tatagtgatcagaaccaagaaattaacagtgatacaatacaataaactaaactacaaattttagttaatttcatcagtttttccactaacgtccattttctgttctagaatcccatgttactttttttttttttttgagatggagtctcgctctgtcgcccaggctggagtgcagtggcgcagtcttggctcactgcaagctccgccttctgggttcacgccattctcctgcctcagtctccccagtagctgggactacaggtgcctgtgaccacgcccggctaattttttgtgtttttartaaagacggggtttcaccgtgtctcgatctcctgacctcgtgatctgcctgcctcggcctcccaaagtgctgggattacaggcgtgagccactgcgcccggcctatgttacatttttaatagtcatgtgtccatagtatcctctgatctttgacagtctgaaagcaaagactgaaaggctttccttttctttcatggctttgatacttttgcagagtactcttcaaatgttttatagcatatcactcatttttcctttgtttaatttttttttcacgactagtttgagtttggttttttt

SEQ ID NO: 172589 - DNA, 601 bp, Human
ctttgttctggcatacagttaaatttttctgtagtcagtttaatcctttcgtggcttgcttttaagctttgttatggtagttttagtagccttttgtctacatctaatttaaccccactactaaggtaataaattttgatgactccctgataaactatatattatgaggtctttttgtggctggtaggaattcacactattcacaaccttgtgtgactgctgggaattgtttgggttgctgctgctaggtctttgcctagcctttggtagtctgtttgtacctaatgcagataagaatttwggcaaacactgcataagactttcttgcagattgcacaaatctatttgctgctctcttctgtctccagttctgcctcccaaattctaaccatcttggctttcctagactaaaatcgtttgccctaacttagtaataactattggcccttgttctatattccttccctgctttttctgtgacctggaacctgcctccaggcagtaacctggggcaatcatgggacttctgttgttttcctgtgatacaagggaatacagtcatatatggctgttgtctgcagtctgcaaaccattttctcaa

SEQ ID NO: 172590 - DNA, 601 bp, Human
tctctcacaaggtttttcagttatagtgttagccagggcttgggaagactcatctgggaaaggatacacatcccaactcatgtagtttttgttaggacttagttcctagcaggttgctggagagagggcttcaatttcttgctgttggctggagactgctcttagttccttttcacatgggtcttttcaacatggcagcttgccttatcaaagcgtgtaagctaagacatcaataaagtgctagcaaggtggaagtcagaatcttttgtaactgaatcacaaatgtgacatcccatcaccyttgccatattctgttggtaagaagcaagtcactaagtttagcccacactcaaggggaggggtaattatataacgtatacaattattcatgaggcagggccattgggggttatcttagaagtctgcctattacagttctcttcttttaagggtaaattccctctagttttaactttggtctccctgtatgcctttaagtattttatccacagttttaaattatcaacacgacttcaccacccttagccagagctcagtgtttgcagatgttaaatccagctttctcttaggacaaaaatgt

SEQ ID NO: 172591 - DNA, 601 bp, Human
gacatcaataaagtgctagcaaggtggaagtcagaatcttttgtaactgaatcacaaatgtgacatcccatcacccttgccatattctgttggtaagaagcaagtcactaagtttagcccacactcaaggggaggggtaattatataacgtatacaattattcatgaggcagggccattgggggttatcttagaagtctgcctattacagttctcttcttttaagggtaaattccctctagttttaactttggtctccctgtatgcctttaagtattttatccacagttttaaattatcarcacgacttcaccacccttagccagagctcagtgtttgcagatgttaaatccagctttctcttaggacaaaaatgttctaccatgataacattttcttcatctttttcccccatagttagccactaaatattttacgtagatgtctcactgatatcttaaattcttcatgaccaaactgtaacttcagctcaacttttcttccttgtggattccattcctctctcataattgcatcttatcttctctatcaacccaagctcagtatcttcggatcagagaattttgttgttgttgttctga

SEQ ID NO: 172592 - DNA, 601 bp, Human
taaagtgctagcaaggtggaagtcagaatcttttgtaactgaatcacaaatgtgacatcccatcacccttgccatattctgttggtaagaagcaagtcactaagtttagcccacactcaaggggaggggtaattatataacgtatacaattattcatgaggcagggccattgggggttatcttagaagtctgcctattacagttctcttcttttaagggtaaattccctctagttttaactttggtctccctgtatgcctttaagtattttatccacagttttaaattatcaacacgactycaccacccttagccagagctcagtgtttgcagatgttaaatccagctttctcttaggacaaaaatgttctaccatgataacattttcttcatctttttcccccatagttagccactaaatattttacgtagatgtctcactgatatcttaaattcttcatgaccaaactgtaacttcagctcaacttttcttccttgtggattccattcctctctcataattgcatcttatcttctctatcaacccaagctcagtatcttcggatcagagaattttgttgttgttgttctgattctagtc

SEQ ID NO: 172593 - DNA, 601 bp, Human
tttttccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaattttctaatattttgttgagaatttttgtgtcttaagttcctgacatagaaatctcatgagagacattgrtttatagttttcttttttgtactgtctttgattttaatatcaaggtaatacctcataaaatgagtttgaaattgtttcctctattttttggaagacattgcataaaatcggtgttaattcatttctaagcatttggtaaaagtctgcagtgaagccatctggacctagaatttcttttttgaaaaacttcttagttacaaatatttatttaatggcagtagtactattcaggttttctgtttcatcttgattgagttttggtagtttgtggctttgaaataattaggttatatcttataa

SEQ ID NO: 172594 - DNA, 601 bp, Human
acttgggttgtttccacattttgattattgtaaataatgctgccatgaacattggtgtacaattacctgtttgtgtccctgctttcagttcttttcgatatataccttgaagttgaattgctggattatatggtaattttatgtttaattttttgaagaaccactgtacagtttttcacagcaactgtaccatttcccaacagcaatgcacaaaggttccgatttctccacatcctcactagtacttgttattttctattttttgataatagccatcccagtgggtatgaagtggtatctygttgtgatttgcatttccctagtgattactgatgttgagcgtcttttcatgtgtttattgcccacttgtatatcgttagagaaatatctattgaagtccattgcccattttaaaattggcttctttgaggttttttgtggtggtcttgttttattgtagttctttatatatttttggatattaatccattatgagatatatgatttgcatatattttctcccactatataggttgccttttcactcttcatagtatcctctgatgcactaaagttttaaattttgataaaatctaacatc

SEQ ID NO: 172595 - DNA, 601 bp, Human
ctaaagttttaaattttgataaaatctaacatcgatttttctttttttattatgtatagcttaaaaatgtgttccacacccattcttcagagttctgtagtttgtgcttttctgtatctccaacctctgccttaaaaaataataataaatagaaaaatcttgacaagaccaattaaaaatgaaaaggttttttaaagctcagtaacactgcaagtaatttaaattgccaatacagagctttcaaccagaatggaaagggagaaatataccttattttctgttcttttagagtcctagtaarttgagaagcagtttttatttgtaaatgtcaatttatgcatttatataacatcagaacacatgcatatttgaaagcatatatgagatttcatatttgaaagctggatgtagctcacaatcaacttgaacaccttccaaaggagactgaaaacagtacacagataaccaactttggcaacacagtgaactgctagacctcctagatactataggcatgagaggaaaaagaagatactgatagctattaatagctaactggatattaagaagattatcttgatccattttggtagtgaaaatt

SEQ ID NO: 172596 - DNA, 601 bp, Human
cagataaccaaccttgacttgcagcacaatgaactgctagacctcccagatactataggtatgagaggagaaaggagatattgatagctgttaatagctaactggatattaataggactatttttgatccatttggtaatgaaaattcaggagtaaaattcacaattaccaaagttgtaaaacttttaagataatattttaaaatcatttttcatttccttttcttggcaaagaaaataggttttaggaaatgagcccaatgggattataaaagagagagaatattgagttacatgtatayatattctgtcatagtttgaattgcaaaatgggtggctttttctatttctgcttatttctgagttgcatgttattatactgggtgtggtcctttctttgctaaagtattccatactgaaaaataaaaccattgctatttagttttttaaacatggccaatatactttaaagtttgtttatctgtaatactaaggggataagcaaggagatgacttgaagttcaaaatatgttttatagacttagccaaattgcaaaaaattgaattgagctgtgatatgttttgtgtttatgtagtcttat

SEQ ID NO: 172597 - DNA, 601 bp, Human
tgttggccaggctggtcttgaactcctgacctcaggtgatctgcctgcctctgcctcccaaattgctgggattacaggccttagccaccgtgcttggtccagtcatgaatattttagaggcatgattactaaatcatttgaggcctgtgatgatgttatctttctccagaagagtttttgtctgcctctgttgggtacctagtagagaggggatcacttcaatcaattcgtgttcaaggcttgagatgtgtgtggtcccccaagtgattaaaagttttgctgcaggctaactggatgactmttttatttccagttcacccttactggtagggtgcagctctagagggtcccagttgaggttgatgactagagtccccacccttggcaggccctagattttgactcttgctggaaaaataacttagccttttagctgcatcttccagttagggctgtgttcttaggacagaattatctccattgttttgcttgtatctgggttcccagcttgtttctgttctggtgcttagtcattacgttgttaactctctgattttggttttggaagatgtttttatttatttatttttttattgggaga

SEQ ID NO: 172598 - DNA, 601 bp, Human
atgatatattattgacttctaatttacctccattgtggtcaagaacattcctgataggacttgaattctttcatcatggtaaaagtattccatgtgcagtttaatgtgtattctacttttgttgggtggagtgatccataaatatgaatcatggtacagatgaggcaatcaatgagtttattctactttctgccgtttctggaggagtctctttttcttcttatttttgttaactgcattgtcagcataggtaacataccttgttgtactaattcccatttttgttttagtcttaatgttyatcagcagtcctgttgccatagttgcctcagtcatttcttggttggctgaagtcaatctggttggtagtcatttgctcaaaaatggttcatgggagcagtattctcctatagttcttgcatgtgtgtagcttttataatttaagaacaatttagatagatacaaaataattggatcaaactgcctttccttgaggatctcagtagaacttgttaacaggtagttctaccttcttctggaattgaatgtacaaaaataagaggccagtccattttcttttttccccatgataagtgactta

SEQ ID NO: 172599 - DNA, 601 bp, Human
ctggtggggacgtggagaacctttatgtctagctcagggattgtaaatacaccaatcagcaccctgtgtttagctcaaggtttgtgagtgcaccaatcaacactctgtatctagctgctctggtggggccttggagaacctgtgtgtcgaaactctgtatctaactaatctgatggggacgtggagaacctttgtatctagctcagggattgtaaacgcaccaatcagcgccctgacaaaacaggccactcggctctaccaatcagcaggacgtgggtggggccagataagagaataaaarcaggctgccggagccagcattggcaacccactcgggtccccttccacactgtggaagctttgttctttcgctctttgcaataaatcttgctactgctcaaaaaaaacaaaaacaaaaaacaaaaaaaaacacaacaaaatgttgctttactctactgcaaatcagacaggagaaccaaaatttaagatacttgaaatgttatgaagtgattttcttatccctctcattgatgtttagtcactatgtatatcttaggatattaaacatgctagacattttattgtttcttgaacatatcag

SEQ ID NO: 172600 - DNA, 601 bp, Human
aaatacaccaatcagcaccctgtgtttagctcaaggtttgtgagtgcaccaatcaacactctgtatctagctgctctggtggggccttggagaacctgtgtgtcgaaactctgtatctaactaatctgatggggacgtggagaacctttgtatctagctcagggattgtaaacgcaccaatcagcgccctgacaaaacaggccactcggctctaccaatcagcaggacgtgggtggggccagataagagaataaaagcaggctgccggagccagcattggcaacccactcgggtccccttscacactgtggaagctttgttctttcgctctttgcaataaatcttgctactgctcaaaaaaaacaaaaacaaaaaacaaaaaaaaacacaacaaaatgttgctttactctactgcaaatcagacaggagaaccaaaatttaagatacttgaaatgttatgaagtgattttcttatccctctcattgatgtttagtcactatgtatatcttaggatattaaacatgctagacattttattgtttcttgaacatatcaggtaaattctagccttgagatctttgtgcttcccatctctctgtt

SEQ ID NO: 172601 - DNA, 601 bp, Human
gttagtctgccttgttgaataaaaaaagtattattttatatgaatattttctcattcagaaattagctatgaacagaagaaaatattaagctttattccaacagttattttgttttaaagtatgaacctgatgttttttaaagccttctggtacctctggtagttttatgtaatccagggaagaaacagtccgaagtaggaaaaaatactttactttgtatttcttctcaaaatgagattaggagagaactgtgccacaaaaccttgccttcaaggctggagtgcagaacaattcacagargcctttttgttgcactgggctctgaagaaatgttacattaattatggttatatcaacaagtagcattttagtcattttagtaattgggttttaggtaattacagtgcagcgtatgtataacaactttactagttttctttttaatggtggtgttctttgggtttttaacattcaggaatttctgtgttgcttacttttcagtttgctttcagtttaatgtttctgaaaaaataatggtacctttgacatttcatccttccaaccctgagtctttcctactattttttttgctactttgtt

SEQ ID NO: 172602 - DNA, 601 bp, Human
tacattatttttattttgtaatttttaaattctaggaacctactctggttttaaaagtgagaaacttaagagttatttggttttggatgagaaatttcaagaatctggttctatttactaggcttttgagttgacaaacatttagaatttggttcccctactaacctttgttaccacagaaagttttttagttttcagtgagaataaaaaacatttaaaatattgtatttatctaccatgatactgtaaagggttattgaatgaggcatgtcagttgatggagtaagatcatggagacttytctctgttaataaattctcccctcttatggcagacttcaaagaccccttggtgaaagattcagccattttgttacaatggatcaactttcttccatagggaaagcagtgatgtaaaggagaaaaagggatggtcttgtttacttccatttttttttttaaaggttagctgcctcattttatctgcagctgcatacaggaaattaaaattttatcagaaggttttgaagttctttgtaatcagacatgatcactacttggaggaaaatgttcacttctgctggccttgctgtagcagtggc

SEQ ID NO: 172603 - DNA, 601 bp, Human
gtggagagaagtatagcaaagctcctcacttactgggttttcagtctggtgagggagataactaatccatgaaacagttaacataagaccaaatataattaattgccaacttacggtgaaaacagtgtgctggtatatccagtttacagagaggtcggtaagagcttgataaaatgactaagaatggctcaatgaacaaatgcattggactcagtatggaagaaaaatgcagtccatgagcacaacagtgaggacagtcaaacagcatgaaggtgagaatgagcacagcatggttctgtgwcaaggaaacaagctaagtggagcaaagtcaatgaagatcttgaaggcagatttgttgatagggagccaaccaagttggattcaccaactagctggtgactgtgacaagttacttcacaaatgttatggtaaagtccctgctgattaccctcagatggctcttactgctgcttcctaggtatctttttcatttctttttatcaaatgtcacaggatggctatctaaaacttaaaaccaccatactcatttttttcacaatttagcttatgtgttctctttatggagaagatgacccttaca

SEQ ID NO: 172604 - DNA, 601 bp, Human
ttttcagtctggtgagggagataactaatccatgaaacagttaacataagaccaaatataattaattgccaacttacggtgaaaacagtgtgctggtatatccagtttacagagaggtcggtaagagcttgataaaatgactaagaatggctcaatgaacaaatgcattggactcagtatggaagaaaaatgcagtccatgagcacaacagtgaggacagtcaaacagcatgaaggtgagaatgagcacagcatggttctgtgacaaggaaacaagctaagtggagcaaagtcaatgaagmtcttgaaggcagatttgttgatagggagccaaccaagttggattcaccaactagctggtgactgtgacaagttacttcacaaatgttatggtaaagtccctgctgattaccctcagatggctcttactgctgcttcctaggtatctttttcatttctttttatcaaatgtcacaggatggctatctaaaacttaaaaccaccatactcatttttttcacaatttagcttatgtgttctctttatggagaagatgacccttacagtgtaaagtgcccagacttcttacttctacatttatt

SEQ ID NO: 172605 - DNA, 601 bp, Human
aggcagatttgttgatagggagccaaccaagttggattcaccaactagctggtgactgtgacaagttacttcacaaatgttatggtaaagtccctgctgattaccctcagatggctcttactgctgcttcctaggtatctttttcatttctttttatcaaatgtcacaggatggctatctaaaacttaaaaccaccatactcatttttttcacaatttagcttatgtgttctctttatggagaagatgacccttacagtgtaaagtgcccagacttcttacttctacatttattttccctytttgcttatcttttgttcattctctcctgttcctagagacagagatgttccttctttctaagattaactttttcactttctttataaagccagctttgatcctttgtgttggaagttgtctcccccatctctaaacattcagagattttgttcatacttcttttagggtattatcatagtcaactaagtattatagttatttgtgaaaatataccactgtactgtaagcctcttgagagaagagactatgtcttgtgtggcactatgcaattatacagcagttaaacaataagtagctag

SEQ ID NO: 172606 - DNA, 601 bp, Human
atctctgtaatgtaaaatattcatccaaaagaaaaaggatagtggaaggatgtcacaattttttaaaaaattaaaatgactttagaactatagctctattcttatcaaaatgtttttaaattttaaaatatagaaaattaggaaaaatgtagacaaaatgaaacaaatttttaattgttcttccataattctgccatgcagagataacaattagttttgatacattttctttccctttttttgcatgcctgtttcttacgttgttgaaatcatacaaaatgcacaattttatcatgctttyccccccccaacttaacatcatacctgaaagtctttcacatcttaaaactttttataacataactttagtatgtacagaatattgcagaatatagacatactacagaatgaaaattatatattgaacatctattatgtatctgttagtcatggtgctaagtatcttacgcacgttatatctaacccctagagctaccctgtcaggtatgtggcattatttccactttatggataaggaacagacacagagaggttaagtaacttgcccatggacatataaatgatataaaatactttggtt

SEQ ID NO: 172607 - DNA, 601 bp, Human
aattattttctgccaacccagcttttaagtaacatttttattatagtctttttttttttttttaatgagacaaagccttgctgtgtcacccaggctggagtgcaatggcacaatctgagctcacggcaaacctccacgtcctgggttcaagccattctccttcctgagcctcccaagtagctgggactataggcacacaccaccatgcccggataattttgtatttttagtagagatggggtttcaccatgttgaccagactggtctcgaactcctgacctcaggtgatccgcttgcctcsacctcccaaagtgctgggattacaggtgtgagccaccatgcctggcctaacgcagtgatagcaatagtgaatattctcgttcgtatttctaacctctaaattttctggggctttggaaagtcactcaatttttttttttctcctgaggaattgacacgtctcaccagagtgtcatcagaaagacactgatgaagtcactaagtgaagcatccttagttaatttacaaagctttttaaagactaaattaacttgtctttgctaagtggtagttttttattgttgcttttgtactccacttt

SEQ ID NO: 172608 - DNA, 601 bp, Human
tacatatagaaaaggaactaataatttgaaccacatattcccaaggcttgagtctagttgctctacatgtattgtctcatttaatctttatcataaacctactagttattggagtatcctcatcaaacagatagcgaaataaggcttaagagaggttatatttttggccaaatttgttactttaaatatttttctggaagtatggtaagaggtatattgattatctaattaatccaccaaagttgacaaaacttagtagaaggtgtaaaatagaagcctagatgtgtctcattctaacaataaaaaaaaatgataagcaacccctgcttcacaatgtgactaagaaatgagagcttgaagagctggcttcttgttgccccttctcaaatatactcagtattaacattttatcataagagtcaattcaataaagtaagtcagttgtaagaataaaaagaatcacattttttgccatgaggctcagtaaaactcctttattttcaatcgtgtagcctgtagagatttttcctgaattgactgccatgcagttttcttgccactgttttacctctgttgttccttttgtttctgtacaacaata

SEQ ID NO: 172609 - DNA, 601 bp, Human
gtagcttcttaaggtacagtataaagaacaagtttcagttctctgtatagttatatcctcaattatatagttacttcattccttcagatggctttgccaattatactgtcacctcaagtactaagttttcaatttgctgatggtggacaactgaagtttgaacattattttaaaaacatacatacctcatacagtgcttgcttctccctgcttgtgcttttactttgaatctagagtgtttcttctatttctctgagtattttaaaatgttttcatccttcaagatctagctcactgtcarctttcatcctatttttccagttattccagttttccttgctttgaatttaaatagagaaaggacttaaaatttaagcacttacttcctactaggtattgttaacttatttatgtattttatcgcttttagtcttcactatggcccataaaatatcattatttaaaaaatgatacactaggttcggaaaaataacttgccaaagtcacaagctatttaaagatagagtcaggattcaaaacagtttatagcctgtacaggatttctcagatgttaatgagcatgcagatcacctgggaatct

SEQ ID NO: 172610 - DNA, 601 bp, Human
tctagagtgtttcttctatttctctgagtattttaaaatgttttcatccttcaagatctagctcactgtcagctttcatcctatttttccagttattccagttttccttgctttgaatttaaatagagaaaggacttaaaatttaagcacttacttcctactaggtattgttaacttatttatgtattttatcgcttttagtcttcactatggcccataaaatatcattatttaaaaaatgatacactaggttcggaaaaataacttgccaaagtcacaagctatttaaagatagagtcargattcaaaacagtttatagcctgtacaggatttctcagatgttaatgagcatgcagatcacctgggaatcttgttaaaatgcatattatgattcagtgggagtggggcccaagagtctgcatttctcacgagctcccaggggatgctgatattgctcttccttggcccagactttgaatagcaagagcctattatatataattgattattgattatatacggtcgtatattattttctaattatttcttacctatgtacttctataaatagagcttaatcttctttaccgcagagattct

SEQ ID NO: 172611 - DNA, 601 bp, Human
ttcctactaggtattgttaacttatttatgtattttatcgcttttagtcttcactatggcccataaaatatcattatttaaaaaatgatacactaggttcggaaaaataacttgccaaagtcacaagctatttaaagatagagtcaggattcaaaacagtttatagcctgtacaggatttctcagatgttaatgagcatgcagatcacctgggaatcttgttaaaatgcatattatgattcagtgggagtggggcccaagagtctgcatttctcacgagctcccaggggatgctgatattkctcttccttggcccagactttgaatagcaagagcctattatatataattgattattgattatatacggtcgtatattattttctaattatttcttacctatgtacttctataaatagagcttaatcttctttaccgcagagattctttggtaatacctgaatattttaatactttggttaaatggtgagaggctaaagtagggcaagatggggttatgtgctaagtaaatacttgtttaatgggtacatatatgccctcagaaattttaccatatagaaaagcggtgtattatacagtat

SEQ ID NO: 172612 - DNA, 601 bp, Human
gactgctgttctataaaaaatgagtctcatcacagttctaattcttatgtttatttcattttttttacagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggtaagcatatatttgtttactagggaaaggaattgctttaaytggtacttccactaatatttatgttttctctaattgtgtggggagtgggtacttgtaccttgctgatgggtctaaactgatcataagacatgtcagggtactttgtatcagataacaaatatcttagaactgagcatacccttaggattttgtcctaaagaaatcattgtccagctcagtggctgatgcacctgtaatcccagtgctttggaaggctaaggtgggaggatccctggaggctaggagttcaggaccagcttgggcaatatagtgagaccttgtctcgcaaaaattttttaa

SEQ ID NO: 172613 - DNA, 601 bp, Human
tgtatctagaatgccctcttctcatccccttagtttttttcttttagtatgtttttccataattaaagatccatcttattttcacctcttcagttaaggatgatttctcctgcttctgagttcctagagttttcatccctttgatgaaaatgcttactaatagtaaatatattgctttttaaaatttccttcatatccatgttttttaaaggtctaatttttaaattatttaataaggtgaaatagtatggtttaatggctaaaaacatgggctttgaagtcaaacaaagctgagtgtaawtatctctgtatatttatgtacttaacttgcccaagcttcagtttcttaagctgtgaaatggggataataagagtatctaccttgtagagttgtagttaggattaaatgcaataatgcacataatgcattcagtacagtgccttgcaaatagtaaaatcaagtggtgactgctgtaattattttctccatcttactgtatatatttattatgggtggtgtaacattagggaaaataaatgaacataaaaacttacccagaaccttacgtatctgttttacctattgctctttctcccaacc

SEQ ID NO: 172614 - DNA, 601 bp, Human
tatcttctctgccattttaacccccttcagtatcttccaggatgctttcagtgtaataagaacaccacagataataaatagagtggattgatatagcaagtttagaaggtagcttttaccttccttaagtaatggtttgtaagggattttgaataaatagtttcctattagataaacatttgtaactattgagcatttttttgaaatttcattaaaattaaattgcttcttttgttttcattagttttgatataatcaaataaaatctcttttctaataactatggtgtttttttagaaamgtaagttaaatattttatatgttatataattgaacatcacccttaatattcactgtttggaaaattagcattgcttaatagattttaagccacacaatgacagtatataatttcatttcatgatttcctaaacattatcaataatttctcattaggttcttatcttatcaaacaatcttctaaagaagcttccccatggtcttggaaaccttaggaagttaagagagttggatctagaagagaacaaattggaatccttgccaaatgaaattgcatatcttaaggatttacaggtaaaca

SEQ ID NO: 172615 - DNA, 601 bp, Human
ccaaactatcccaaacagaatctctggagatggggcatatgtattttcaaaaacctctccaagcttgaagacctaccataaaggaggaggttctaatttagtttgtatgaagtgtgacctggacatataggagtttaaaaagtcttccaagttgatttgaatatgcagcaaaatttgagatccatggttgtagagttttaaagctaagaaaggagaataaaaggaaatgtgtgttcagtatatgtaatgaccagaacagcatcatgcccagttgaacttttaaaatagcaactaatttttwaaaaaaaattgattttttttttaaacaggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctata

SEQ ID NO: 172616 - DNA, 601 bp, Human; identical to SEQ ID NO: 104176

SEQ ID NO: 172617 - DNA, 601 bp, Human
tccttgtattgtcattccagttctgctgtggatctacaaaacattcctggagccatacatataccatctgatttctgcttttgttagtcatatatggcctagaaaagctacacaagaatccaataattcccaggtgcggttgctcacacctgtaatcccagcactttgggaggccaaggcaggtggatcacttgagcccaggagttcaagaccaacctgggcaaaatagtgagactccatctctacgaaaaatttaaaaattagtcagatgtggtggcacatgcctgtggtcccagctacytgggggactgaggtaggtcaatcgctcaagcccaggaggtggagactgccgtgagctgtgacggcaccactgcactccagcctgggcaacaaagtaaggcaccctgtctcaaaaaaaaaaaaaaaaaaaaaaaaaaaaatccaatgatacaaataaagacaaagtggactataagggtgcagacactaatggattatcaccaacagaaatcttagaagaaaagaaacactaaagcattttcccaaaggagctcatcattttaaaaatggacttgacaatatgaagcgccttctttgtaac

SEQ ID NO: 172618 - DNA, 601 bp, Human
tctgaaatcctccagttggtgcaacattgaaccacttacttctctgtctggtagtagagcatccctcgttggaagtaagccactgccaagtgcttgtctcggttaatgcttctggtaaaggcctgaggagagaagggtccagacatggccatgatgcaaggcagtgaggaggtgtgagatgagccacggctcacagagccctagctccctgtggtgcccagctctgctgtctgccctcgtcggcacctcgaggcccaccctgtgctctcacggtgcaccccacttcgctctcacatttagragctgaagtctgggacaatggtgtgcattccttgtattgtcattccagttctgctgtggatctacaaaacattcctggagccatacatataccatctgatttctgcttttgttagtcatatatggcctagaaaagctacacaagaatccaataattcccaggtgcggttgctcacacctgtaatcccagcactttgggaggccaaggcaggtggatcacttgagcccaggagttcaagaccaacctgggcaaaatagtgagactccatctctacgaaaaatttaaaaattagtcagatgt

SEQ ID NO: 172619 - DNA, 601 bp, Human
ttctctcaggtgtaactattaatattaccaatcacagattaattgaatcctgggtcttacttttagaagtttccaagatctttctaatcactcaaaaccgtggccttccagatcctgggactcacgggcattttttggaggaaattctttctgggagccttcactcttttgccagttgtatctcttctttatagactattagaggtcactaaggaatgaccttagagtttgcgttttgagatttaagatcggctgaaggatttgttgttaggcctccctgcatattctatagtctggagayggggtaagggggagtgagaaagagaaggatgttaagagcggggacaggcagttagaggcaagacgtcggtcaagataaacacctgctgtaccaaaatatctcatgtgtcccataaatatatacacctactgcatacccacaaacattaaaataaaaaattaaaattaaaaaaagaatttataaagtcacaataaatatgtcacactaaatatggggggaagagagagctaaatgcctggatatcttctcccaatcccaggctctctttctccccagattgccattgtgtctgtggttttt

SEQ ID NO: 172620 - DNA, 601 bp, Human
tcaagatgtctacagaggcccggtgcagtggctcgtgccggtaatcccagcattttgggaggccaaggcaggcggatcacttgaggtcaggggttcgagaccagcctggccaacatggtgaaaccccgtctctactaaaaatatttaaaaattagccgggcgtggtggtgcgtgcctatagttccagctactcaggagggtgaggcaggagaatcacttgaacccaggaggtggaggttgaaatgagccaaaaccatgccactgcactccagcctggttgacagagcgagactccaactcaaaaaaaaaaaaaaggtgtctacagatttgggcctggtaggagagagagagaaagaactgacaaattattcagagggtttgctttgttttaaagacagggtggacccgcctaggcaatatggagaaaccccacctctactaaaagtacaaaaaattagccaggcatagtggtacgtgcctgtagtcccagctacccgggaagctgaggttggagaatcacctgagcccaggaagtcaagactgcagtgagacatgattgcaccactccactccagcctggacgacagaatgaaatcctgac

SEQ ID NO: 172621 - DNA, 601 bp, Human
aagaggaagaaggtacccagaagtacgccagaaatcaggttccgctttctaagccagaaggtggggtaactagcttcaattcactgagcctcttccatcgcgaagaggacaggcagaagcagaggtttcctgtttcctggcagctgcaatttccactgtgttctattgcctgtttgggagctcgctgaaggtctcagagggcacacactttaactgccgtcagcatcaacctaccaacgtgccttcctccctgctgagttggctaagcagatggatttcagctgggaagtgacaccacctkggtctatctggcattgcatgagcccagcaaaatcctcctaataattccctagcccatcaagatgtctacagaggcccggtgcagtggctcgtgccggtaatcccagcattttgggaggccaaggcaggcggatcacttgaggtcaggggttcgagaccagcctggccaacatggtgaaaccccgtctctactaaaaatatttaaaaattagccgggcgtggtggtgcgtgcctatagttccagctactcaggagggtgaggcaggagaatcacttgaacccaggaggtggaggttgaaat

SEQ ID NO: 172622 - DNA, 601 bp, Human
acctcacaggcaaacagcttgaactggagccccaggatcttatagtctatcagctggttccctcgaagctgaatcaaggcttctttaaggtctttgatagccaaatcatatctgcaggacagagggagaaaatacagcagtctagtggatggagaaataaatgcagcataaaatgtgagtctgcttctcccttccccatctatttcactgggacaagaagcctttcagttccttttgacctgttctagttttcagcaaccctgagtccaagtattctatacaactccttgggaatggtgtyccccccagggctgtgcctcaaagcaaccctgagtgcctcgtcttggacagtcacagggagtttcttctctattgactgcatacaactgtcacctttctgacaacctgacttgtcgctttccgatgcagctctcattctctcttgagagctccaagcagagccagcacctgccccctgcctgtgtccctgcagagtgttcagagctgatttggaatactgctcactcctggctcccaccatcaggccaggccagcctggcacagcttggaggggccccttcttatagctgccaccatcacc

SEQ ID NO: 172623 - DNA, 601 bp, Human
cacgacctaaaatcaaggacaggagggtgtgaggctctgccagcactgtttccattcttctgggtctccctctttgctcatgccctagacctgttcttacgtgagcctggtttcagacgtggacagtaactaaggattagattcctgagcctctggattaggatttcagcaactgaagaaacgagcattcaccccacccctgctaacacaggcttgctttcttctctcttaaaaaagaaatgtttttattgaggtgcaatttgtataacatcaaattatcttttttttttttttttttttktgagacggagtcacgctctgttacccagactggagtgcagtggcgtgatctcagctcactgcaacctctgccttccaggttcaagtgattctcctgcctcagcctcccgagtagctgatattacaggcacccgccactgtgcccggctaatttttgtattttcagtagagacaggttttcaccatgttggccaggctggtctcaaacttctgacctcaggtgatctacccatccagcctcccaaagtgctgggattataggcatgagccaccacgcccagcccaaattaatcattttaaa

SEQ ID NO: 172624 - DNA, 601 bp, Human
aatcaaataacgcatttctgactgatgagaacactgtctaggaagagggcacagtcaccctgactaaacactgggaaataacacctcccaccagctccccaggtacaggtttcactagcacagcaattcattttgagccagagctagtttctggaggttagcagtcacacagcaacatggtgtcacaagaatgctttgaccttgagctctgtccttttcccaggacagtttccaaaagctctgttctgtaattaatgtctactatgtcacatgacacttctgagtatttttaaattaattwaaaaaaaattttttttgagatggagtttcactctgtcgcccaggctggagtgcagtggcgcgatcttggctcactgcaacctctgcctccctcattgaggtgattctcctgcctcagcctcccatgttgctagaattacaggcatgtgccaccacaccctgctaatttttgtatttttagtagggacaggggtttcaccatgttggccaggctggtctggaactcctggcctcaagtgatctgctcacctcagcctcccaaaatggtgggattataggcgtgagccactgtgcctggcca

SEQ ID NO: 172625 - DNA, 601 bp, Human
tcctgatctcaagtgatccgcccacctcagtctcccaaagtgctgtgatttcaggcatgagccacacacctggccaatcactttttaaaacctcctttttgggtgggaggaccaggcttgcttcatcactttgagagaattcttaagaaagctgtaggttatgtcaccctttgtttttcatcttacagaagaaggacttccttttcttcagtccttcctctttacttcttcagaaagcatgtgccgatagggagtggaaaacatccacacaggaaaaaggacgtcattctagattcctgaytccagagagctctggcctgcccccgtcagaggcgactgcagccagtgcgaaaccgatctccaacctgaggtcagcatcctggtccccagggtagctatgttccacaggacaccactgcccctcagcaacaaccccttgccatgtgggtggctgtgcacgtggacagagggccaatgggacaccacgtagctgcagccaggccctgatggccagccccaccacagtcaagactcccatccccatcatatcattcctttctagcctgacattctagaagacattcttctaggcattcctttc

SEQ ID NO: 172626 - DNA, 601 bp, Human
acacattgactactcttccacgtgaagcagacacacttgggaagacctaacccactcatatactgtaggctttgcttcccaagtgacttctgaccaggaagagtcacagaggtgggtgggcccaatgggacctacagatgcctccaacttagcacatctgggcttttttcccctcattcccaggttcagctctgggtagctggtgccatctcaaggcgggctcaagactagtgaatctttctccaggggtcctgacaacacctcttttacactgcttttctcccctccagggagagatccytaaagggtgagaggaaatgggtcaggccttggcatcacattacctggggctgctgctgagggtggatccgcagctcaactggttcaaggtagttgcagggaacaagccccttctgcagtgcagcaccacagaatcagaaaggaaaaaataaagatgtgctcatcagtacccacaccacagaacagcccagagtcctggggaagggatgacgaacagacaaaagaacttggctggtctgcaaagaaggcagcagatactgctccacagagactgcatttgctgccaggatcccatgcccat

SEQ ID NO: 172627 - DNA, 601 bp, Human
gaaggcagggagagagggcactgatttcatgtttggggtgggtggtgcaggaaagggggattctggggctgcgtggtcattagctgagtgacatgttgggagaagaagaaaccagaatttcctggaaggcagggagaggaactcaggaagcagcctggcatgctgctgcacccagacctaggctgtggctccaggaccactcacctggtgacagctggggtcttccaggggctttggaactaggaggagctgggatgtcggactgcggagagctttcctcctgaaggcaacagggagcgayggtcagaaccttcattcaaagttcccaggcaggggtggatgtggggaaacacccctacagagaccccatgtaaaggagccacatgcagataacgtcctaaaagttggaatggtagtgacatttggggaagacgaaggaaatgttggccaaaagaggaggtggagttggcctgatgaaaatgaaaatcacagtagaaagaagaatcctaacccgctaaaacgcccttgccgctttagcaactctttcagccatattggaaatccactggccgtggggcaggactgagctcttgtctccact

SEQ ID NO: 172628 - DNA, 601 bp, Human
aacatttccatttcacatctgcccattggttctttgttcatcctcagggctccacagagcaatttcttttccagatacagtgcctcagacatttgaaaacagccactccatgcccctcagagataagcaggtatagttacttcaacttttcttcctgagacatggtttccctacctaatgatcaaggggtttggtgactacgtgagtcactcaggaaccagctgcattcacccaagccccgtgagtgttctgcagaaggcagggagagagggcactgatttcatgtttggggtgggtggtkcaggaaagggggattctggggctgcgtggtcattagctgagtgacatgttgggagaagaagaaaccagaatttcctggaaggcagggagaggaactcaggaagcagcctggcatgctgctgcacccagacctaggctgtggctccaggaccactcacctggtgacagctggggtcttccaggggctttggaactaggaggagctgggatgtcggactgcggagagctttcctcctgaaggcaacagggagcgacggtcagaaccttcattcaaagttcccaggcaggggtggatgtgggg

SEQ ID NO: 172629 - DNA, 601 bp, Human
atcaagcaatctaatattaatctaatttatgtaagagtagcatgcataaagatatttactatagggggtacatgatcagagaaggccactgatctcaaacctagctgatcattagaatcacatgggaagtttttttctaaaatacaaattcccgagccccattccagtcctaaaatatcagagccagtagcctaggactctgtattcacaaaatcatcctaggtttatatgtgatccttgatgagcctctagacaaaagataacaacaaaaaacctgtcaaggacattgagcaggagcaaygggagaaatttgaatatggaatatacattatataatactatcatatgaatgtttagtgtcctagataccatgattctattgtgattatgcaggagactgcgtttttgcagctgtgtagggtgaagtgtcacgagtctgtaacttttcaactggctcgggggagaaaaatagaatggagcagggcgagttcatggtgcaaaatgttaacaattggtgagtttaagtgaaagatattctgatgtttattgtattctactgtcagcttttctgtaggttggacatttttcaaaataaaaatgg

SEQ ID NO: 172630 - DNA, 601 bp, Human
agaggtttcagtgagccaagatcacacccagcttgggcgacagagtgagactccatctcaaaaaaaaaaaaaaaaggtgaagaatggctatgagctgagccttaagctatgatatgacttcattccaaccttgcttgacagtaatggatgggatgtttgacacagtcaggcagggagctgatggaggggcaggaggctttctgtgagctcctgccctgctgggcctgctgttctcttgtgggaaactctctccctgctgcaaatggggtgaggatgcaggtaaaagggaggcagagctgtracttattacacaccatatccccaacaccacatatagtgcctagtacacagaaggtgcttgataaatttcaaattgttgaggaagtggctcagtggaaatgtaactttagatgcccctcattgcactcaccactgtgttctcacaccacagagtcaggcagtagtttttcacctggccccaggcatccttcatgctgtcttctgaaaggggcaccagctcattgctgtcccgaggccgatagctgggtggggataatgagtaagaatccagtcaaagaacatcatcacaaaaaccatcctc

SEQ ID NO: 172631 - DNA, 601 bp, Human
taccttaaacagctttatacactgcccttttctaggctcattctctttcactcttcttctcccagctcatgtctgtaatcccagcactttgggaggccgaggcaggtggatcacaaggtcaggagttcaaaaccagcctggccaagatggtgaaaccccgtctctactaaaaatacaaaaattagctgggtgcagtggcaggtgcctgtaatcccagctactcaggaggctgaggcaggagaatttcttgaacctgggcggcagaggtttcagtgagccaagatcacacccagcttgggcracagagtgagactccatctcaaaaaaaaaaaaaaaaggtgaagaatggctatgagctgagccttaagctatgatatgacttcattccaaccttgcttgacagtaatggatgggatgtttgacacagtcaggcagggagctgatggaggggcaggaggctttctgtgagctcctgccctgctgggcctgctgttctcttgtgggaaactctctccctgctgcaaatggggtgaggatgcaggtaaaagggaggcagagctgtgacttattacacaccatatccccaacaccacatatagtg

SEQ ID NO: 172632 - DNA, 601 bp, Human
actgcacccggcctatttttattttttttaagacagagtctcgctctgtcacccaggctggagggcagtggtgcaatctcggctcactgcaacctccactcccgggttcaagcgattctcttgcctcagcctccctagcagctgggactacagatgtgcatcaccacgcccagctaatttttacatttttagtagagatggggtttcaccatgttggccaggttggtcttcaactcctggcctcaagtgatccaccacctcagcctcccaaagtgctgggattacaggtgtgagccaccasgcccagcctaccctcattaactttaaaatttccccctctctttgtctgttggattttctgttataattgatggtagtttttcactgctttgcattggtagtgcacagactcagcgtatgagcagggcttttatgatgggacttttttgtgtcgaggtagagaattaggctggcaaaccacgagttggaatggtgcttcttaagagtgtaggcagtagaccagcatcacctggaaacttggtagaaatgcaagttggtgggccccaccccagacctgaatcagaatctctggagggtgggc

SEQ ID NO: 172633 - DNA, 601 bp, Human
cactgagttaccattctctcttgttggaacactctgcttctatattactactactcatatttttttttttgagacagaatctcactctgttgcccagactggggtgcaaaggtgcaatcttgactcactgcaagctccatgtccctagttcaagtgattctcctgcctcagcctcccaaggagctggaactacaagtgcacgccaccacgcctggctaatttttttatttttagtagagatggggtttcaccatgttggccaggctggtctcaaatcctgaccccaagtgatccactcacyttggcctcccaaagtgctggggttaccagcatgagccaccacgcccagcctatactactcatatttttaattaattgctacacacttgttgtatactctctctacccccattaactttttttttaattttaatttttttgtttttgtttttgttttttttttgagactgagtctcactctgtaacccaggctggagtgcagtggcacaatctcagctcactgcaacctcctcctcctgggttcaagagattgtcctgcctcagcctcctgaatagctgggattacaagcacctaccacta

SEQ ID NO: 172634 - DNA, 601 bp, Human
catactggcttctctccatatctacccaaaaggttgttttagtgtgttctttcattgtattcctgctccctctcccaaactccagacaattgagctggttggttgatttaggcacctttaaagtggcacttggaggtgttcaacccagttcttcccactgagttaccattctctcttgttggaacactctgcttctatattactactactcatatttttttttttgagacagaatctcactctgttgcccagactggggtgcaaaggtgcaatcttgactcactgcaagctccatgtcccyagttcaagtgattctcctgcctcagcctcccaaggagctggaactacaagtgcacgccaccacgcctggctaatttttttatttttagtagagatggggtttcaccatgttggccaggctggtctcaaatcctgaccccaagtgatccactcaccttggcctcccaaagtgctggggttaccagcatgagccaccacgcccagcctatactactcatatttttaattaattgctacacacttgttgtatactctctctacccccattaactttttttttaattttaatttttttgttttt

SEQ ID NO: 172635 - DNA, 601 bp, Human; identical to SEQ ID NO: 86676

SEQ ID NO: 172636 - DNA, 601 bp, Human; identical to SEQ ID NO: 86677

SEQ ID NO: 172637 - DNA, 601 bp, Human; identical to SEQ ID NO: 86678

SEQ ID NO: 172638 - DNA, 601 bp, Human; identical to SEQ ID NO: 86679

SEQ ID NO: 172639 - DNA, 601 bp, Human; identical to SEQ ID NO: 86680

SEQ ID NO: 172640 - DNA, 601 bp, Human; identical to SEQ ID NO: 86681

SEQ ID NO: 172641 - DNA, 601 bp, Human; identical to SEQ ID NO: 86682

SEQ ID NO: 172642 - DNA, 601 bp, Human; identical to SEQ ID NO: 86683

SEQ ID NO: 172643 - DNA, 601 bp, Human; identical to SEQ ID NO: 23652

SEQ ID NO: 172644 - DNA, 601 bp, Human; identical to SEQ ID NO: 23653

SEQ ID NO: 172645 - DNA, 601 bp, Human; identical to SEQ ID NO: 23654

SEQ ID NO: 172646 - DNA, 601 bp, Human; identical to SEQ ID NO: 23655

SEQ ID NO: 172647 - DNA, 601 bp, Human; identical to SEQ ID NO: 23656

SEQ ID NO: 172648 - DNA, 601 bp, Human; identical to SEQ ID NO: 23657

SEQ ID NO: 172649 - DNA, 601 bp, Human; identical to SEQ ID NO: 23658

SEQ ID NO: 172650 - DNA, 601 bp, Human; identical to SEQ ID NO: 23659

SEQ ID NO: 172651 - DNA, 601 bp, Human; identical to SEQ ID NO: 23660

SEQ ID NO: 172652 - DNA, 601 bp, Human; identical to SEQ ID NO: 23661

SEQ ID NO: 172653 - DNA, 601 bp, Human; identical to SEQ ID NO: 23662

SEQ ID NO: 172654 - DNA, 601 bp, Human; identical to SEQ ID NO: 23663

SEQ ID NO: 172655 - DNA, 601 bp, Human; identical to SEQ ID NO: 23664

SEQ ID NO: 172656 - DNA, 601 bp, Human; identical to SEQ ID NO: 23665

SEQ ID NO: 172657 - DNA, 601 bp, Human; identical to SEQ ID NO: 23666

SEQ ID NO: 172658 - DNA, 601 bp, Human; identical to SEQ ID NO: 23667

SEQ ID NO: 172659 - DNA, 601 bp, Human; identical to SEQ ID NO: 23668

SEQ ID NO: 172660 - DNA, 601 bp, Human; identical to SEQ ID NO: 86720

SEQ ID NO: 172661 - DNA, 601 bp, Human; identical to SEQ ID NO: 86721

SEQ ID NO: 172662 - DNA, 601 bp, Human; identical to SEQ ID NO: 86722

SEQ ID NO: 172663 - DNA, 601 bp, Human; identical to SEQ ID NO: 86723

SEQ ID NO: 172664 - DNA, 601 bp, Human; identical to SEQ ID NO: 86724

SEQ ID NO: 172665 - DNA, 601 bp, Human; identical to SEQ ID NO: 86725

SEQ ID NO: 172666 - DNA, 601 bp, Human; identical to SEQ ID NO: 86726

SEQ ID NO: 172667 - DNA, 601 bp, Human; identical to SEQ ID NO: 86727

SEQ ID NO: 172668 - DNA, 601 bp, Human; identical to SEQ ID NO: 23669

SEQ ID NO: 172669 - DNA, 601 bp, Human; identical to SEQ ID NO: 86729

SEQ ID NO: 172670 - DNA, 601 bp, Human; identical to SEQ ID NO: 86730

SEQ ID NO: 172671 - DNA, 601 bp, Human; identical to SEQ ID NO: 86731

SEQ ID NO: 172672 - DNA, 601 bp, Human; identical to SEQ ID NO: 86732

SEQ ID NO: 172673 - DNA, 601 bp, Human; identical to SEQ ID NO: 86733

SEQ ID NO: 172674 - DNA, 601 bp, Human; identical to SEQ ID NO: 86734

SEQ ID NO: 172675 - DNA, 601 bp, Human; identical to SEQ ID NO: 86735

SEQ ID NO: 172676 - DNA, 601 bp, Human; identical to SEQ ID NO: 86736

SEQ ID NO: 172677 - DNA, 601 bp, Human; identical to SEQ ID NO: 86737

SEQ ID NO: 172678 - DNA, 601 bp, Human; identical to SEQ ID NO: 86738

SEQ ID NO: 172679 - DNA, 601 bp, Human; identical to SEQ ID NO: 86739

SEQ ID NO: 172680 - DNA, 601 bp, Human
tggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtrtggtatgaatttctgaaattctggcttcctatgactcctagttgtgacctaaccagtttttttctcatttaatcaatgtagctattcctatattcagtaacacttacttctatagccttaaatagataattttttttcttctatttttttttttttttttgtagagatggggtcttgctatgttgcctgggctggtattgaactcctggcctcaagcaatcaatcctcttgcctcagcttcccagagggctgggattacaggcctgggccacccacacccaaacagaggtttaaagagct

SEQ ID NO: 172681 - DNA, 601 bp, Human; identical to SEQ ID NO: 22711

SEQ ID NO: 172682 - DNA, 601 bp, Human; identical to SEQ ID NO: 22710

SEQ ID NO: 172683 - DNA, 601 bp, Human; identical to SEQ ID NO: 22709

SEQ ID NO: 172684 - DNA, 601 bp, Human; identical to SEQ ID NO: 22708

SEQ ID NO: 172685 - DNA, 601 bp, Human; identical to SEQ ID NO: 22707

SEQ ID NO: 172686 - DNA, 601 bp, Human; identical to SEQ ID NO: 22706

SEQ ID NO: 172687 - DNA, 601 bp, Human; identical to SEQ ID NO: 22705

SEQ ID NO: 172688 - DNA, 601 bp, Human; identical to SEQ ID NO: 22704

SEQ ID NO: 172689 - DNA, 601 bp, Human; identical to SEQ ID NO: 22703

SEQ ID NO: 172690 - DNA, 601 bp, Human; identical to SEQ ID NO: 22702

SEQ ID NO: 172691 - DNA, 601 bp, Human; identical to SEQ ID NO: 22701

SEQ ID NO: 172692 - DNA, 601 bp, Human; identical to SEQ ID NO: 22700

SEQ ID NO: 172693 - DNA, 601 bp, Human; identical to SEQ ID NO: 22699

SEQ ID NO: 172694 - DNA, 601 bp, Human; identical to SEQ ID NO: 22698

SEQ ID NO: 172695 - DNA, 601 bp, Human; identical to SEQ ID NO: 22697

SEQ ID NO: 172696 - DNA, 601 bp, Human; identical to SEQ ID NO: 22696

SEQ ID NO: 172697 - DNA, 601 bp, Human; identical to SEQ ID NO: 22695

SEQ ID NO: 172698 - DNA, 601 bp, Human; identical to SEQ ID NO: 22694

SEQ ID NO: 172699 - DNA, 601 bp, Human; identical to SEQ ID NO: 22693

SEQ ID NO: 172700 - DNA, 601 bp, Human; identical to SEQ ID NO: 22692

SEQ ID NO: 172701 - DNA, 601 bp, Human; identical to SEQ ID NO: 22691

SEQ ID NO: 172702 - DNA, 601 bp, Human; identical to SEQ ID NO: 22690

SEQ ID NO: 172703 - DNA, 601 bp, Human; identical to SEQ ID NO: 22689

SEQ ID NO: 172704 - DNA, 601 bp, Human; identical to SEQ ID NO: 22688

SEQ ID NO: 172705 - DNA, 601 bp, Human; identical to SEQ ID NO: 22687

SEQ ID NO: 172706 - DNA, 601 bp, Human; identical to SEQ ID NO: 22686

SEQ ID NO: 172707 - DNA, 601 bp, Human; identical to SEQ ID NO: 22685

SEQ ID NO: 172708 - DNA, 601 bp, Human; identical to SEQ ID NO: 22684

SEQ ID NO: 172709 - DNA, 601 bp, Human; identical to SEQ ID NO: 22683

SEQ ID NO: 172710 - DNA, 601 bp, Human; identical to SEQ ID NO: 22682

SEQ ID NO: 172711 - DNA, 601 bp, Human; identical to SEQ ID NO: 22681

SEQ ID NO: 172712 - DNA, 601 bp, Human; identical to SEQ ID NO: 22680

SEQ ID NO: 172713 - DNA, 601 bp, Human; identical to SEQ ID NO: 22679

SEQ ID NO: 172714 - DNA, 601 bp, Human; identical to SEQ ID NO: 22678

SEQ ID NO: 172715 - DNA, 601 bp, Human; identical to SEQ ID NO: 22677

SEQ ID NO: 172716 - DNA, 601 bp, Human; identical to SEQ ID NO: 22676

SEQ ID NO: 172717 - DNA, 601 bp, Human; identical to SEQ ID NO: 22675

SEQ ID NO: 172718 - DNA, 601 bp, Human; identical to SEQ ID NO: 22674

SEQ ID NO: 172719 - DNA, 601 bp, Human; identical to SEQ ID NO: 22673

SEQ ID NO: 172720 - DNA, 601 bp, Human; identical to SEQ ID NO: 22672

SEQ ID NO: 172721 - DNA, 601 bp, Human; identical to SEQ ID NO: 22671

SEQ ID NO: 172722 - DNA, 601 bp, Human; identical to SEQ ID NO: 22670

SEQ ID NO: 172723 - DNA, 601 bp, Human; identical to SEQ ID NO: 22669

SEQ ID NO: 172724 - DNA, 601 bp, Human; identical to SEQ ID NO: 22668

SEQ ID NO: 172725 - DNA, 601 bp, Human; identical to SEQ ID NO: 22667

SEQ ID NO: 172726 - DNA, 601 bp, Human; identical to SEQ ID NO: 22666

SEQ ID NO: 172727 - DNA, 601 bp, Human; identical to SEQ ID NO: 22665

SEQ ID NO: 172728 - DNA, 601 bp, Human; identical to SEQ ID NO: 22664

SEQ ID NO: 172729 - DNA, 601 bp, Human; identical to SEQ ID NO: 22663

SEQ ID NO: 172730 - DNA, 601 bp, Human; identical to SEQ ID NO: 22662

SEQ ID NO: 172731 - DNA, 601 bp, Human; identical to SEQ ID NO: 22661

SEQ ID NO: 172732 - DNA, 601 bp, Human; identical to SEQ ID NO: 22660

SEQ ID NO: 172733 - DNA, 601 bp, Human; identical to SEQ ID NO: 22659

SEQ ID NO: 172734 - DNA, 601 bp, Human; identical to SEQ ID NO: 22658

SEQ ID NO: 172735 - DNA, 601 bp, Human; identical to SEQ ID NO: 22657

SEQ ID NO: 172736 - DNA, 601 bp, Human; identical to SEQ ID NO: 22656

SEQ ID NO: 172737 - DNA, 601 bp, Human; identical to SEQ ID NO: 22655

SEQ ID NO: 172738 - DNA, 601 bp, Human; identical to SEQ ID NO: 22654

SEQ ID NO: 172739 - DNA, 601 bp, Human; identical to SEQ ID NO: 22653

SEQ ID NO: 172740 - DNA, 601 bp, Human; identical to SEQ ID NO: 22652

SEQ ID NO: 172741 - DNA, 601 bp, Human; identical to SEQ ID NO: 22651

SEQ ID NO: 172742 - DNA, 601 bp, Human; identical to SEQ ID NO: 22650

SEQ ID NO: 172743 - DNA, 601 bp, Human; identical to SEQ ID NO: 22649

SEQ ID NO: 172744 - DNA, 601 bp, Human; identical to SEQ ID NO: 22648

SEQ ID NO: 172745 - DNA, 601 bp, Human; identical to SEQ ID NO: 22647

SEQ ID NO: 172746 - DNA, 601 bp, Human; identical to SEQ ID NO: 22646

SEQ ID NO: 172747 - DNA, 601 bp, Human; identical to SEQ ID NO: 22645

SEQ ID NO: 172748 - DNA, 601 bp, Human; identical to SEQ ID NO: 22644

SEQ ID NO: 172749 - DNA, 601 bp, Human; identical to SEQ ID NO: 22643

SEQ ID NO: 172750 - DNA, 601 bp, Human
aaagatgggaagatgactgcgtgtagaggggcccttagctgggatatgttaggagttgtggtgacagccatcttccttctgacagcccaggagagaacccagtgctatccgaggtgctgaacagaggacttctcggggttcccgaattcccagggttaaaacaaacttggtttgtgcggcgacaccgctacccttaccggtccccagatagtcgcggatccccgaagctaagagccagggcaggacttcagtcagtgttccaggaacagctgagacacccaggtcaccacgggctcgcgcygctgcggctccgacccggtgcgaaccgccatacgcgccgcgcggtgggccggaggcagtccgcgtactgttgcggaaactctgtctcacaaggtgcgcaacactcgccgcgcgcaacactcaccaggaagttgatgtcggccgggcgcactaggcggtagctgcacgtcgcgcaatcctggctgcattcggcccgcacggtcgccaggagcccggggccgagcaacagcagccaagtgcaaagtgtcaggaaccgcgccatggactgcgaggagagagggacgcgtgcttcgagcctgcc

SEQ ID NO: 172751 - DNA, 601 bp, Human
catagccaaattaaactgttgttttagttactattacaaagggcagttgaaacagaagttgaattccagcatcactggctagtgagacagtttgaactctttcctgtctacggttatttcgccttcctctccccgtaccccttttccatccctttgctctctcctatttacaggtgagggtagggaatgagggacctgaggttaagagagctggggaacataaatctaaagaaaggcaccgaaatgtcactaacaaaaaattacattatttgtgggaaagatgggaagatgactgcgtgtrgaggggcccttagctgggatatgttaggagttgtggtgacagccatcttccttctgacagcccaggagagaacccagtgctatccgaggtgctgaacagaggacttctcggggttcccgaattcccagggttaaaacaaacttggtttgtgcggcgacaccgctacccttaccggtccccagatagtcgcggatccccgaagctaagagccagggcaggacttcagtcagtgttccaggaacagctgagacacccaggtcaccacgggctcgcgccgctgcggctccgacccggtgcgaa

SEQ ID NO: 172752 - DNA, 601 bp, Human
aagaagaaagatgggtgaaggggattgtttctcctattgaagatgaaacatttttctcatagtttaaatatacaaccttcctatgtgtcttctctttaatgccaagttagcacaggtcaaagaaacaaacatttaacctgaaatatataccacagatatttggaaactgttccttggttttctccccatttcaaacatctacataaggtaaaatttcctcaattccaggtggaacccaaagcagcttggatgaatacattattctctatgagctttttaagtcaccataaaatttcaacaratttcaaaagcaatgcaaaggaattgtcaggggagctggtaaaagtgaagctacctgagtctcgaggttggagattcagactcagtagagcaccagaggtgattcgacagcccatggggaaccatgatcagaatgaaagttattttgtcctcagctttttctttccccaaccccctgtagtgcagtgtatctttggactgttgtcacccattggacactggccacttctcttgttcctttctcatagccaaattaaactgttgttttagttactattacaaagggcagttgaaacagaag

SEQ ID NO: 172753 - DNA, 601 bp, Human
ttatacaaatgcaagtgcacaaattattcatgtttattttcttcacatttagtcactgttgtacagaaaaagtatttttcaatggaaatcatggtgtttggtaaaataggaatcatcagcatacattctttcctttttcttatataaatattaaatataaaatcattgtaagtctatacattcgaatgatcttaagtttttttctatttaacacatcacttgggtatgataaagagagtactaatatgtgaacatttacaaaacatgcatgatatttcttagcatttcaggagttttttayagccctctgaagtctttcttggtattattaaaaatatactggtatattaagtgatgttaaatacacatatattattttcacaatgaaagaaagcattttattagtgcaacaaaatcttgaaggcacgtatttagtaagctcttaatgagtatttaagcttcgtgtctgagaagattaaatatataactacgtaagaatctaaagatgatccattaataattaaaatgtcttattttattcctgacatatgatgaacaaataaaaacaccattagaagcttaagatatttaaggagcaata

SEQ ID NO: 172754 - DNA, 601 bp, Human
ggcagtttaccttcacattccattacgcaagcctgggaaaacaatttgatgtaatgataaaaagaagcttctgtgatttcattaagcaaatgaacttttgtggaccaaaatatgcttgctttgacatcataacttccttattataataaggtcatctccaatttcttatcacgacttttcataaggctgagcatgcaaatgaaacaaataaaatttggaaaggtgaaagtggaggggttcactgaatccagttaggaatctgcctttggattttaaacccatagaaattttaaagaatttwaaaaaaaattttccatgcagttttaacttagattgactgctttcacaatctaatttcactggataattttccacttctgatataattttgtttgagatttttctaaccaaaaaggagaaatttttatttacctaatcagggatatttcctcaaaattccttttatcttcttgtcttagagataaaatcaatattaataacctaagggtcatttgctttcttgtgttaatattttacctaaaatggtatcgagtattcctgcaaatactttcaatcttcaaagaaaaacaacaatttaaaa

SEQ ID NO: 172755 - DNA, 601 bp, Human
cgtgctttggagaaccaagaggagacagtatcgattgtggatcggatgagttcctttgtatgaaactttcagagtagcaggggagtcttaagggactaaagcaggaggaaacacaactgaaaatgacaaggggaaatcttaccagcatgaaagcaaagttctgcgtttaagtttaaaggaagatgaaccctgtgaagccaggacacactgcggggaaggggacaagaatgcaattgaaagcccctaacggagaaaaaaaaaagcccatatgtttgttttgttttgttttgtttttgagacrgagtctcgctctgtcgccaggctggagtgcagtggcgctatctcagctcactgcaccctccacctccctggttcaaacgtttctcttgcctcagcctcctgagacgctgggattacgggcatgcatcaccatgcccggctaatttctgtatttttagtagagacagggtttcaccatgttggccagtatggtctgaatttcctgacctcatgatctgcctgcttcagcctcccaaagtgctaggattacaggcgtgagccaccacgcccggcccaaaaaacccatatgtttagcatacgc

SEQ ID NO: 172756 - DNA, 601 bp, Human
tacagcaagaactctacaaagctgttcatcaagatacagttggctctgtgagaacccttattttgaacctgccaactttgctccaacaccatcaacataccagggagtgattctgctataatgctaaggtcgtatttggttacatatagaaacagcaagtgaacgccgcagatgaatgcagaaaactgcactcagctgactcaggtgttgaaggaatgcacaaaacacacaggcacacacctctgacatccatcaaccacctctgagccacacccatgtgcatctgccatcagattgcacrcacacctccttccacagctccctacgctgctgccttcccagcacccacatccacccatgtggtgcatcttttttcaggtaaaatgcctacttaccgcagcatgtgcgtatttcttctccacgtaacttgcgtaaaactgtactactggattttagattctgaactttttttaaaagacgccactgatgaagtttttaagtgctgtgccctcaaccccattcttcccataaggcctctggtttttactgcatgattttgcatagctctgtgatttttacgaagggataattgtcttctatt

SEQ ID NO: 172757 - DNA, 601 bp, Human
cccagctactcaggaggctgaggcaggagaatcacttgaacccaggaagcagaggtttcagtgagctgagattgcaccactgcattccagcctgggcaacagagtgagactctgtctaaagtaaaataaaataacatacagcaagaactctacaaagctgttcatcaagatacagttggctctgtgagaacccttattttgaacctgccaactttgctccaacaccatcaacataccagggagtgattctgctataatgctaaggtcgtatttggttacatatagaaacagcaagtgaacrccgcagatgaatgcagaaaactgcactcagctgactcaggtgttgaaggaatgcacaaaacacacaggcacacacctctgacatccatcaaccacctctgagccacacccatgtgcatctgccatcagattgcacacacacctccttccacagctccctacgctgctgccttcccagcacccacatccacccatgtggtgcatcttttttcaggtaaaatgcctacttaccgcagcatgtgcgtatttcttctccacgtaacttgcgtaaaactgtactactggattttagattctgaac

SEQ ID NO: 172758 - DNA, 601 bp, Human
ggtggcgcacacctgtaatcccagctactcaggaggctgaggcaggagaatcacttgaacccaggaagcagaggtttcagtgagctgagattgcaccactgcattccagcctgggcaacagagtgagactctgtctaaagtaaaataaaataacatacagcaagaactctacaaagctgttcatcaagatacagttggctctgtgagaacccttattttgaacctgccaactttgctccaacaccatcaacataccagggagtgattctgctataatgctaaggtcgtatttggttacatrtagaaacagcaagtgaacgccgcagatgaatgcagaaaactgcactcagctgactcaggtgttgaaggaatgcacaaaacacacaggcacacacctctgacatccatcaaccacctctgagccacacccatgtgcatctgccatcagattgcacacacacctccttccacagctccctacgctgctgccttcccagcacccacatccacccatgtggtgcatcttttttcaggtaaaatgcctacttaccgcagcatgtgcgtatttcttctccacgtaacttgcgtaaaactgtactac

SEQ ID NO: 172759 - DNA, 601 bp, Human
aatcccagcagtttgggaggccgaggcgggcagatcaccagaagtcaggagttcaagaccagcctggccaacatggcaaaatctcgtctctactaaaaaatacaaaaattagctgggcatggtggcgggcgcctgtaatcccagctacttgagaggccaaggcaggagaatcacttgaacctgggaggcggaggttgcagtaagccgagttcgtgccactgcactccagcctgggcgacagagcaagacttcgtctcaaaaaagaaagtctagcctaaaaggtaaattaaaatacagcaayggccaggtgcagtggctcacgcctgtaatcccagcactttgggaggccgaggcaggcggatcacttgaggtcaggagttcaagaccagcctggccaacatggtgaaaccccgtctctactaaaaatacaacaacaacaaaaaaaaaaaacattagccgggcgtggtggcgcacacctgtaatcccagctactcaggaggctgaggcaggagaatcacttgaacccaggaagcagaggtttcagtgagctgagattgcaccactgcattccagcctgggcaacagagtgagactctgtcta

SEQ ID NO: 172760 - DNA, 601 bp, Human
atagcaagagacaaaggggacctgtattaatttatctcattttatttttaaaatcaccctcaaataggcatatgctttgacctagtaattccctttgaaagtccggcctaggccgggcgtggtggctcacgcctgtaatcccagcagtttgggaggccgaggcgggcagatcaccagaagtcaggagttcaagaccagcctggccaacatggcaaaatctcgtctctactaaaaaatacaaaaattagctgggcatggtggcgggcgcctgtaatcccagctacttgagaggccaaggcargagaatcacttgaacctgggaggcggaggttgcagtaagccgagttcgtgccactgcactccagcctgggcgacagagcaagacttcgtctcaaaaaagaaagtctagcctaaaaggtaaattaaaatacagcaacggccaggtgcagtggctcacgcctgtaatcccagcactttgggaggccgaggcaggcggatcacttgaggtcaggagttcaagaccagcctggccaacatggtgaaaccccgtctctactaaaaatacaacaacaacaaaaaaaaaaaacattagccgggcgtg

SEQ ID NO: 172761 - DNA, 601 bp, Human
ctgccaaggccccctgtgcacttgaggggtctaagaggacttgggaattggctctcagcaatagcaagagacaaaggggacctgtattaatttatctcattttatttttaaaatcaccctcaaataggcatatgctttgacctagtaattccctttgaaagtccggcctaggccgggcgtggtggctcacgcctgtaatcccagcagtttgggaggccgaggcgggcagatcaccagaagtcaggagttcaagaccagcctggccaacatggcaaaatctcgtctctactaaaaaatacaraaattagctgggcatggtggcgggcgcctgtaatcccagctacttgagaggccaaggcaggagaatcacttgaacctgggaggcggaggttgcagtaagccgagttcgtgccactgcactccagcctgggcgacagagcaagacttcgtctcaaaaaagaaagtctagcctaaaaggtaaattaaaatacagcaacggccaggtgcagtggctcacgcctgtaatcccagcactttgggaggccgaggcaggcggatcacttgaggtcaggagttcaagaccagcctggccaacatggtg

SEQ ID NO: 172762 - DNA, 601 bp, Human
ccccactgtactcatggggaagctgagggaggctgagacaagccacttgcctgaaaggacacagtggctaaatggcacagccgggatgcaaaccctggcttctctgactgaaagacccaactctctcattgcacacccagagacctgacagaggaggtcaacaaataccgtctgccgggctgaataaaggaacgctcgtctgcacaagacagtggttctcagctggagccattatgcctccctcccccatggagcatgtggcaacgtctggggacacttttggttgccacaactgcaaggwggtgttctggcatccagtgggctgaagccagggatcctgtggaacaccctataatgtacgtaacagctccataacaaagaacgaccccacccaaaatgccagtagtgccaggtgaggaagcgctggtatgagggctatgctatcaacaccgaggtattcctgccttgtccctaaagtcatagtgacaggtcaggagcttctccatctgacaccaagagcagcaatcataacacctcatcgtcatttcctgagcccttcctgggtgagaatcagatgctaaacacatcacctcctcaactc

SEQ ID NO: 172763 - DNA, 601 bp, Human
ccatcctcaggccacatcaggccgctacatcaggctcaacggccagcagtcagcaacctcgggccactcatgggccggcctctctcctggcctggacttccttccctccaccttatcaccatcccgcctgccgtaccaggtggaagcttccccgctctcggctggctgcctgcttgtccctgtacaactctcatctcaggcagcacctttcggtctcctcccccatgacacactggaagcagcaggggaggccgccttcttatcctgagcacctacggtggctaactggatacccgctgtrtgagctactcaggcaattctcacaatagctcccgcaggtgtagtcagccccactgtactcatggggaagctgagggaggctgagacaagccacttgcctgaaaggacacagtggctaaatggcacagccgggatgcaaaccctggcttctctgactgaaagacccaactctctcattgcacacccagagacctgacagaggaggtcaacaaataccgtctgccgggctgaataaaggaacgctcgtctgcacaagacagtggttctcagctggagccattatgcctccctcccccatgga

SEQ ID NO: 172764 - DNA, 601 bp, Human
tctgggattttctgtgaaatctcttcatttaaaaatactggcaatcaagtcaaatttggttcaacccgcgtgggggccacaccgtgtggccccatcctcaggccacatcaggccgctacatcaggctcaacggccagcagtcagcaacctcgggccactcatgggccggcctctctcctggcctggacttccttccctccaccttatcaccatcccgcctgccgtaccaggtggaagcttccccgctctcggctggctgcctgcttgtccctgtacaactctcatctcaggcagcaccttycggtctcctcccccatgacacactggaagcagcaggggaggccgccttcttatcctgagcacctacggtggctaactggatacccgctgtatgagctactcaggcaattctcacaatagctcccgcaggtgtagtcagccccactgtactcatggggaagctgagggaggctgagacaagccacttgcctgaaaggacacagtggctaaatggcacagccgggatgcaaaccctggcttctctgactgaaagacccaactctctcattgcacacccagagacctgacagaggaggtcaac

SEQ ID NO: 172765 - DNA, 601 bp, Human
tcctctggtttgaatgaggtgactaggaaacctgccattgcctgtatagcctgcgtaacactcccttggacagcatcattagcccagagacagaagggaccaacttacctgtttttgttttgttttgttttgttgagacagagtcttgctctgttgcccaggctggagtgcaatggcgctttctcagctcactgcaacctctgcctcccaggtttcaggtgattttcctgcctcagcctcccaagtagctgggactacaggcatgagccaccacacccagctaattttgtatttttagtasagatgaagtttcaccatgttggccaggctggtctcgaactcctgacctcaggtgatccacccacctcggcctcccaaagtgctgggattacaggtgtgagccaccgcgcccagcccaggatcaaattatctgatacttacagagaagaccgaaatctgggattttctgtgaaatctcttcatttaaaaatactggcaatcaagtcaaatttggttcaacccgcgtgggggccacaccgtgtggccccatcctcaggccacatcaggccgctacatcaggctcaacggccagcagtcagca

SEQ ID NO: 172766 - DNA, 601 bp, Human
agaatacaacacattgctttaattctgcatttattacatgctgaagtgataaatataccattaaaattcatttccctatttttcctctggtttgaatgaggtgactaggaaacctgccattgcctgtatagcctgcgtaacactcccttggacagcatcattagcccagagacagaagggaccaacttacctgtttttgttttgttttgttttgttgagacagagtcttgctctgttgcccaggctggagtgcaatggcgctttctcagctcactgcaacctctgcctcccaggtttcagrtgattttcctgcctcagcctcccaagtagctgggactacaggcatgagccaccacacccagctaattttgtatttttagtacagatgaagtttcaccatgttggccaggctggtctcgaactcctgacctcaggtgatccacccacctcggcctcccaaagtgctgggattacaggtgtgagccaccgcgcccagcccaggatcaaattatctgatacttacagagaagaccgaaatctgggattttctgtgaaatctcttcatttaaaaatactggcaatcaagtcaaatttggttcaa

SEQ ID NO: 172767 - DNA, 601 bp, Human
ccagatctgtcgtgcccaacatggcagtcactagccacatgtcactatcgagcacctgacatgtggctggtgcagatggagatgtgccataagtgcaacacccaccaatttcaaagacttcgcatgaaaaagaatacaacacattgctttaattctgcatttattacatgctgaagtgataaatataccattaaaattcatttccctatttttcctctggtttgaatgaggtgactaggaaacctgccattgcctgtatagcctgcgtaacactcccttggacagcatcattagcccagasacagaagggaccaacttacctgtttttgttttgttttgttttgttgagacagagtcttgctctgttgcccaggctggagtgcaatggcgctttctcagctcactgcaacctctgcctcccaggtttcaggtgattttcctgcctcagcctcccaagtagctgggactacaggcatgagccaccacacccagctaattttgtatttttagtacagatgaagtttcaccatgttggccaggctggtctcgaactcctgacctcaggtgatccacccacctcggcctcccaaagtgctgggat

SEQ ID NO: 172768 - DNA, 601 bp, Human
aaatgctattgcagatctggcctggccctggcccatgcccacttcccaaatccagtgaccactgggtttgaggaggcaacagtagaggccagatctgtcgtgcccaacatggcagtcactagccacatgtcactatcgagcacctgacatgtggctggtgcagatggagatgtgccataagtgcaacacccaccaatttcaaagacttcgcatgaaaaagaatacaacacattgctttaattctgcatttattacatgctgaagtgataaatataccattaaaattcatttccctattttycctctggtttgaatgaggtgactaggaaacctgccattgcctgtatagcctgcgtaacactcccttggacagcatcattagcccagagacagaagggaccaacttacctgtttttgttttgttttgttttgttgagacagagtcttgctctgttgcccaggctggagtgcaatggcgctttctcagctcactgcaacctctgcctcccaggtttcaggtgattttcctgcctcagcctcccaagtagctgggactacaggcatgagccaccacacccagctaattttgtatttttagtac

SEQ ID NO: 172769 - DNA, 601 bp, Human
cccactatgtgaggtcacagcgagaaggcaccatctatgaagcagagcaggccctcgttagacaccaactctgtgggagccttgatcttggacttcccagcctccaaactatgtgaaataaaatgtttattgtttgcaagccatccagcctatggtattttgtcacggcagcccgaatgagccacgcccccaaatgctattgcagatctggcctggccctggcccatgcccacttcccaaatccagtgaccactgggtttgaggaggcaacagtagaggccagatctgtcgtgcccaacayggcagtcactagccacatgtcactatcgagcacctgacatgtggctggtgcagatggagatgtgccataagtgcaacacccaccaatttcaaagacttcgcatgaaaaagaatacaacacattgctttaattctgcatttattacatgctgaagtgataaatataccattaaaattcatttccctatttttcctctggtttgaatgaggtgactaggaaacctgccattgcctgtatagcctgcgtaacactcccttggacagcatcattagcccagagacagaagggaccaacttacct

SEQ ID NO: 172770 - DNA, 601 bp, Human
gaccccagaggccggtgcggtggctcacgcctgtaatcccagcactctgggaggccgaggcgagtggatcacttgaagccaggagtttgagaccagactggccaacatggtaaaacgccatctctactaaaaatacaaaaattagccagatgtggtggtgcacgcctgtgatcccagctactctggaggctgaggcacaagaatcacttgaacccaggaggcgatcatgccgccagtgagccgcgatcatgccactgcactccagcctggatgaaggagtgcagtctttaaaaaaaaaaaraaaagaccctagaaggctagctgtccttctgtccctcccactatgtgaggtcacagcgagaaggcaccatctatgaagcagagcaggccctcgttagacaccaactctgtgggagccttgatcttggacttcccagcctccaaactatgtgaaataaaatgtttattgtttgcaagccatccagcctatggtattttgtcacggcagcccgaatgagccacgcccccaaatgctattgcagatctggcctggccctggcccatgcccacttcccaaatccagtgaccactgggtttgagg

SEQ ID NO: 172771 - DNA, 601 bp, Human
gacagtccttctctaatgttacatgggctgacctgatcaggccctgggggacttaaggcaggcaggacattttttgagatcaaaactgccaagtctaaattcattggcttagcattcaaagctctcttgacttggtccctgctatggtccgagtgtctgtgtccctacaaaattcttatgttgaaatcccaacctccaaggtgatagcattagaaggaggggccttttgggaaatgattaggtcttaatgagattagtgttcttgtaaaacagaccccagaggccggtgcggtggctcacrcctgtaatcccagcactctgggaggccgaggcgagtggatcacttgaagccaggagtttgagaccagactggccaacatggtaaaacgccatctctactaaaaatacaaaaattagccagatgtggtggtgcacgcctgtgatcccagctactctggaggctgaggcacaagaatcacttgaacccaggaggcgatcatgccgccagtgagccgcgatcatgccactgcactccagcctggatgaaggagtgcagtctttaaaaaaaaaaagaaaagaccctagaaggctagctgtcctt

SEQ ID NO: 172772 - DNA, 601 bp, Human
actaagtggtttccatgggttgtctcatttcatcttccaacagccctatgtgattgtaccattaccatcaccatttcacagcttaagaaactgaggcagagataagtaaattcctcagcatcacacagcctgcaagaggtagagccaggcttgaactgcaggaattcctccaggttcccagacaacctctgatccgcagcagacacaagcttgccttcctgtctcatcctctctgctctctttccatctcctaagatgccctagactctttcatgcctcctgtctcacaaacatcttctcrggctggtcacctctcacctgtcacctcactccctcagctctgattcgggttccaactacagctctggccttccctcccacacccacctggttcggtcaccagggtcggtcactctggcccagcctccattcagcatggaccaccttagttttgggcagccaggaatcctggctctggcaccctgcaattgtgtcgcctctctggtcatggcctcctcccccatcaaaagacagtccttctctaatgttacatgggctgacctgatcaggccctgggggacttaaggcaggcaggacattt

SEQ ID NO: 172773 - DNA, 601 bp, Human
tccatcgccatccagctgaggcacgcttgcaaagaagggtgacattcctgggcacagagaccacaaggccaagagtagacaccgcactgaagcgaccgtggactgcccaacaagcccgtttgtctttctctctgtgctatgcaagagaaaagagacacgctcctggccagaaagatctggatgcaagtcccagccctgccataaaaaagctatgtgaccctgagtaagtcactgtacctctctgggtctctgcttcatcaggtgtggagtgaggatatccccctacctttcatggggatamgagaagaataaatgatggacatgtaggaactgagcaaaagtcaactccctactcatctatcttgttcactttggaacccacagggcctggcacaagtaggtgctcaataaacaatctagagctaacacttacatgacttcttccagtgtcctagactaagtggtttccatgggttgtctcatttcatcttccaacagccctatgtgattgtaccattaccatcaccatttcacagcttaagaaactgaggcagagataagtaaattcctcagcatcacacagcctgcaagaggtagagcc

SEQ ID NO: 172774 - DNA, 601 bp, Human
ctcagcttccccgccctgacacccgcccttttcccctgccacttcctgtgctagtcctgcctgcacccctcaccacttcctctgcatgagaggccaccatccatcgccatccagctgaggcacgcttgcaaagaagggtgacattcctgggcacagagaccacaaggccaagagtagacaccgcactgaagcgaccgtggactgcccaacaagcccgtttgtctttctctctgtgctatgcaagagaaaagagacacgctcctggccagaaagatctggatgcaagtcccagccctgccawaaaaaagctatgtgaccctgagtaagtcactgtacctctctgggtctctgcttcatcaggtgtggagtgaggatatccccctacctttcatggggataagagaagaataaatgatggacatgtaggaactgagcaaaagtcaactccctactcatctatcttgttcactttggaacccacagggcctggcacaagtaggtgctcaataaacaatctagagctaacacttacatgacttcttccagtgtcctagactaagtggtttccatgggttgtctcatttcatcttccaacagccct

SEQ ID NO: 172775 - DNA, 601 bp, Human
ttgttgtttaatttttttttgagacggcgtttcactcttgttgaccaggctggagtgcagtggcgcaatctcagctcactgcaacctccgcctttcgggttcaagctattctcctgcctcagcctcctgagtagctgggattacaggcgcgcaccatcacgcccagccaatttttgtatttttaatagagatggcgtttcaccatattggccaggctggtctcgaactcttgacctcagatgatccacccgcctcggcctcccaaagtgctgggattacaggtatgagcgagccactgcaygcctgcagctcagcagttatgaactgaacatctaccctccgcgggccctgttccaaatgcaggggacacaaagatcactccttgtcctcagggacttcacatctgctggaggggacagaaaataaagaaggagaaacacaagagaatcccagtttgtaacaacagccctgaaggaaatctacaggcagctgccaccatggtcagggagcggtggtcgggacaggcctctctgaggagggaatctgagttgagacccggagaatgaggaggagccagctgtacagagtcacaggtagactg

SEQ ID NO: 172776 - DNA, 601 bp, Human
caacaggcagggaagctaggaggaagctcagaactgattccagcgccacatcataaccacaatgcggcctcccgagtgtagccacgtcataaccacaatgcggggcctgtccagggagaggcaacaagcgaggcccggcattcactcactcatcctttcaattgctcagcaggtattttttgttgttgttgttgtttaatttttttttgagacggcgtttcactcttgttgaccaggctggagtgcagtggcgcaatctcagctcactgcaacctccgcctttcgggttcaagctattctyctgcctcagcctcctgagtagctgggattacaggcgcgcaccatcacgcccagccaatttttgtatttttaatagagatggcgtttcaccatattggccaggctggtctcgaactcttgacctcagatgatccacccgcctcggcctcccaaagtgctgggattacaggtatgagcgagccactgcatgcctgcagctcagcagttatgaactgaacatctaccctccgcgggccctgttccaaatgcaggggacacaaagatcactccttgtcctcagggacttcacatctgctggagg

SEQ ID NO: 172777 - DNA, 601 bp, Human
agaatcgcttgaacccaggaagcggaggttgcagtgagtcgagatcgcgtcactgcactccagcctgggtgacagagcaagactctgtcaaaaaaaagaaaaaaaaaagcctctgaggcgaggagacccgcgtggggtgggctggggtcttcaggggtcctctcctagccactgtagatggtcctgcagccagaccagaggccagcaccagtgtctggagctccagtttcctcattaacagaggcgccccagtcacctctccccagctcaaagatgggtttcctatcacctcaaagtggcrgttgtggggagggcagtgagggcccccaaaaagaaggggtcttgagagggagctcaggcttccccaaccccgtatcagggccctctaagatgcaaagcaagggtagaaagaatctcagggctgaccagggaggttcgccagctctgacaagggtcattgcctcagggtgacaatgctggctctgacagtggcaactgcctcatagggccaagcgttgggcctgggctcccagacaagactgtgtggagctttccaggaaggagagtgaagggaagccaggcatcagcattagcttctttc

SEQ ID NO: 172778 - DNA, 601 bp, Human
ttcccagccttttatacctttacataatgaagatgtaaccgctcctcctccagaagctgttgtgagcatttaatgagttatacgtgaaaggcgcttagaagaggctgggtccttggctgcgcatggtggctcaaatgtgtaatcccagcactttgggaggctgagacaggtggatcacctgaggtcagaaattcaaaaccagtctggccaacagagtgaaactccatctctactaaaaatacaaaaattagccgggcatggtggcacactcctgtagtcccagctacttgaggaagctgargcaggagaatcacttggacccgtgaggcagaggttgcagtaagccaagatcgcgttactgcactccaacctgagcgacagagtgaaactcttgtcttaaaataaaataaaatgaatagaatagaatagaatagaatagaataggctgggtccagagtgaaagtctagaaatattcactcattatactctctctggccacaaatatattcttccatactttacaaaattgggattaaactgtatacactggtcattcttactttcacttaacagtatagcatggctggacacagtggctca

SEQ ID NO: 172779 - DNA, 601 bp, Human
ttcttgaactgtttcccaatcccagctctaacacttcccagctgtgtgcccctgaggggacttctttgtcctcacttcccagccttttatacctttacataatgaagatgtaaccgctcctcctccagaagctgttgtgagcatttaatgagttatacgtgaaaggcgcttagaagaggctgggtccttggctgcgcatggtggctcaaatgtgtaatcccagcactttgggaggctgagacaggtggatcacctgaggtcagaaattcaaaaccagtctggccaacagagtgaaactccrtctctactaaaaatacaaaaattagccgggcatggtggcacactcctgtagtcccagctacttgaggaagctgaagcaggagaatcacttggacccgtgaggcagaggttgcagtaagccaagatcgcgttactgcactccaacctgagcgacagagtgaaactcttgtcttaaaataaaataaaatgaatagaatagaatagaatagaatagaataggctgggtccagagtgaaagtctagaaatattcactcattatactctctctggccacaaatatattcttccatactttacaaa

SEQ ID NO: 172780 - DNA, 601 bp, Human
ctgtttattccatcaacagtccttgtggtgctgaagtaacatctgtgcgttaaagacaatcttaaaaatataatggtacaaggaagaaaatcaaagcttttcataatccaagggactcgcctttggtattctgcggtgggacgttcttgaactgtttcccaatcccagctctaacacttcccagctgtgtgcccctgaggggacttctttgtcctcacttcccagccttttatacctttacataatgaagatgtaaccgctcctcctccagaagctgttgtgagcatttaatgagttataygtgaaaggcgcttagaagaggctgggtccttggctgcgcatggtggctcaaatgtgtaatcccagcactttgggaggctgagacaggtggatcacctgaggtcagaaattcaaaaccagtctggccaacagagtgaaactccatctctactaaaaatacaaaaattagccgggcatggtggcacactcctgtagtcccagctacttgaggaagctgaagcaggagaatcacttggacccgtgaggcagaggttgcagtaagccaagatcgcgttactgcactccaacctgagcgacagag

SEQ ID NO: 172781 - DNA, 601 bp, Human
gacagtgagactcaatgcggagttgcagaggggagaggactccggggtccacagaggaggaggaagtgaggaaggaagcactttatggagggccacctatgccccctgcctgcatgtgtttaagacactcatttaatcttcaccacaaccttgggggtcgtgtccattcatgaactctgttttagagacagtatcaaacctcagagaggttaagtcggcctgtttattccatcaacagtccttgtggtgctgaagtaacatctgtgcgttaaagacaatcttaaaaatataatggtacaargaagaaaatcaaagcttttcataatccaagggactcgcctttggtattctgcggtgggacgttcttgaactgtttcccaatcccagctctaacacttcccagctgtgtgcccctgaggggacttctttgtcctcacttcccagccttttatacctttacataatgaagatgtaaccgctcctcctccagaagctgttgtgagcatttaatgagttatacgtgaaaggcgcttagaagaggctgggtccttggctgcgcatggtggctcaaatgtgtaatcccagcactttgggaggctga

SEQ ID NO: 172782 - DNA, 601 bp, Human
cacataagagaggaaaggaaagtgataagaagtcgactttctccataacatatttctatttctgaatctctggctgttctccagttttgaaagatggcacctctttaccttgcaggagccaaagccttcgactgggccaggatgtacacagctgagtcctgccaagcagagagaaaccacttcccaatcaatcatcaccatgccaagtttcagctcaacgacaagtgagatggccaagtttcagaacaagtgacatgtaaggatggcaaagatcatgaagcccaaaagcagaatgacgtgrctttcaaagacgtgccttgaacactgtctccctcagggaggggaagcctggccagccaccctggcacagctcagggaaatgttgagccgcaaaagttcttgtgaaccagcaaataaaatacggaaacccaaacgggattggcccaaagataccaagtcttggccttggctgaaaacgggagcaacctgtccaacttggctggggatgtgggagccctcagatgttagctctccaaaaccaatggggaatccaacccacctatcactgataaaggaggcgtgaaaggtgcccatgggctct

SEQ ID NO: 172783 - DNA, 601 bp, Human
ctccacataagagaggaaaggaaagtgataagaagtcgactttctccataacatatttctatttctgaatctctggctgttctccagttttgaaagatggcacctctttaccttgcaggagccaaagccttcgactgggccaggatgtacacagctgagtcctgccaagcagagagaaaccacttcccaatcaatcatcaccatgccaagtttcagctcaacgacaagtgagatggccaagtttcagaacaagtgacatgtaaggatggcaaagatcatgaagcccaaaagcagaatgacrtggctttcaaagacgtgccttgaacactgtctccctcagggaggggaagcctggccagccaccctggcacagctcagggaaatgttgagccgcaaaagttcttgtgaaccagcaaataaaatacggaaacccaaacgggattggcccaaagataccaagtcttggccttggctgaaaacgggagcaacctgtccaacttggctggggatgtgggagccctcagatgttagctctccaaaaccaatggggaatccaacccacctatcactgataaaggaggcgtgaaaggtgcccatgggc

SEQ ID NO: 172784 - DNA, 601 bp, Human
aggtcctccacataagagaggaaaggaaagtgataagaagtcgactttctccataacatatttctatttctgaatctctggctgttctccagttttgaaagatggcacctctttaccttgcaggagccaaagccttcgactgggccaggatgtacacagctgagtcctgccaagcagagagaaaccacttcccaatcaatcatcaccatgccaagtttcagctcaacgacaagtgagatggccaagtttcagaacaagtgacatgtaaggatggcaaagatcatgaagcccaaaagcagartgacgtggctttcaaagacgtgccttgaacactgtctccctcagggaggggaagcctggccagccaccctggcacagctcagggaaatgttgagccgcaaaagttcttgtgaaccagcaaataaaatacggaaacccaaacgggattggcccaaagataccaagtcttggccttggctgaaaacgggagcaacctgtccaacttggctggggatgtgggagccctcagatgttagctctccaaaaccaatggggaatccaacccacctatcactgataaaggaggcgtgaaaggtgccca

SEQ ID NO: 172785 - DNA, 601 bp, Human
tgggtatgagagggataaaggaatgacatgtatgtccagggagtagacaattatcatcttcccttctttccaaaaggcacttgagcccacccttgctgggttctatgaacatcagcctctctccttccttcaatcctgtagccaataaagttattgttacaggaatcgaccccgctccctccgatgtccccatcttggcaaacttagaaatgagcaaatttctatcgagcaatttgtggaaacagcgcaggacctaagctcaagtcccaactctactacttactagctaagtgtgcttgcrgaagccaggacaccaggccttcgtttcctgatgaagacataaacaatttcagtgacgcacgggaaaatcaataaaccactatgggttagccagttgactattggttgttactgttctctcttggaactgtgtattttttgtttttgaaagcctaaaaacatgtttattttgttcaccaatgtatctattactctggtcatggcagacactcagtatgtatccttttttttttttttttcagtatgtattcttaaatgactaaggaatgaatgaataaaactggtgtttgtgcctccctgc

SEQ ID NO: 172786 - DNA, 601 bp, Human
catagtgaaaccccgtctctactaaaaatacaaaaattagccaggcaagatggcgcgcacctgtagtcccagctactcgggaggctggggcagaagaatcacttgaacctgggaggcagaggttgtggtgagctgagatcgtgccactgcactccagcctgggaacagagcaagaatctgtctcaaaaaaaaaaaaagaaaaaaaagaaaggcaacaaaagaaatgtactaggatcatgttcagtttatattagtccataataatagaaaaaaggtgaaatcactaaagacaatggttaamttaacttaatgggatattaagtaacccttaaatgataaacaagaagataatacagtaatgagaaaaaatccttaagccataatagtaaataacaaaataggataatgaaattgtaactaggctacaattttcctttgggaaaactgcatgtgcctatggacagggacgagctaaaacacagcataatgaagtcaagcgatttataaagatgattttcacccagtgacatctggcaattatccacaggggtcccagcgagggcagactgggactggtgcaaataagcctcccacatagaga

SEQ ID NO: 172787 - DNA, 601 bp, Human
agcaactatggaattcttctgccaaaagaatcttcctccaaaaaagtggaaaggatcattttacacttaataaattagcaaaaacatgcaattgtgacaacccagcactggagacgatgtagtaaaatgggtgaacgcattactgacaagaatagaaactgattcaatctttcaaagacaacaattggaaataggttttaaaagccatgaaaataccttttcagcctattatccctcattcctgggaatttaaggccaggaaatacttttaaaaagacaacaggccaggcacggtggctcrtgcctgtaatcccagcactttgaggggctgaggcgggcggatcagaaagtcagaagttcgaggccaggctgaccaacatagtgaaaccccgtctctactaaaaatacaaaaattagccaggcaagatggcgcgcacctgtagtcccagctactcgggaggctggggcagaagaatcacttgaacctgggaggcagaggttgtggtgagctgagatcgtgccactgcactccagcctgggaacagagcaagaatctgtctcaaaaaaaaaaaaagaaaaaaaagaaaggcaacaaaagaaa

SEQ ID NO: 172788 - DNA, 601 bp, Human
gagatgcctgggcatggtcccaaggcaggccaacagggtcgtgcctgggtggctctttaaatttgtttttggttgtttgcttttttttttttttttgagacggagtttccctctttgttgcccaggctggagtgcaatggtgcgatcttggctcactgcaacctccacctcccggattcaagtgattctcctgcctcagcctcccgagtagctgggattacaggcatgcgccaccacgcccggctgtttttgtatttttagtggcgacggggtttctccatgttggtcaggctggtctcgractcccgacctcaagtgatccgcccgccttggcctcccaaagcgctgggattacaggcgtgagccactgcgctcggccagttgtttgcatttttgctgaagttatcaggacagcagctttttctttctctggcgctgctaaatcggtagaatgaaaggctgaagggtcttgtagcccatcttgccactccttcagagtggctgccggagggtgaggccaagatggcagaagcagggctcacaaatggagtgctactggctctgtggaacacctggagacagctgtacctgaaggcggact

SEQ ID NO: 172789 - DNA, 601 bp, Human
gatgaggcccacgtgggagttggcaggcaaggaatagcataaagaacaagcggctgtctgtggcctccgatgtccctctctcccagcggctgaagcaaggccgggttccggcgcacgatgaggggagccttggcccagccttccactgctggctggcagtgactaacgcctcagcccacacccttgcgagcagatacacagtggccacttgtgttttctggcccaagcacctctgtgggaacaatcctcccccttgtacccgcaaggggcccagcctggaggaggtggggataaccctccmagccggggacactgcttcacccaaggggcccagccagcccagtcaggggctgggggcttcctgagagtcagctgcacaaaggccagcaggggacccacccccaggccctccccttccctcccggctgcccactgatcagtgtgttgctcccaccgcttcccgggaaatagctgatatcacagacctcaggacagtgagaaaacattagccacccctccttaactccagctccccaacccccctctgcagatgaggaagctgagtccaccaaggcgaatgcagagaccagggtcccatctg

SEQ ID NO: 172790 - DNA, 601 bp, Human
ctcatctgggcctcagtctcccccctatatgggggaggatggatggtgaaatgatgtccaactctctccatgctctgatgagagccgtcttagggagtgggtgagtcttggaaagctaagggtggtccaagtagatgaggcccacgtgggagttggcaggcaaggaatagcataaagaacaagcggctgtctgtggcctccgatgtccctctctcccagcggctgaagcaaggccgggttccggcgcacgatgaggggagccttggcccagccttccactgctggctggcagtgactaacrcctcagcccacacccttgcgagcagatacacagtggccacttgtgttttctggcccaagcacctctgtgggaacaatcctcccccttgtacccgcaaggggcccagcctggaggaggtggggataaccctcccagccggggacactgcttcacccaaggggcccagccagcccagtcaggggctgggggcttcctgagagtcagctgcacaaaggccagcaggggacccacccccaggccctccccttccctcccggctgcccactgatcagtgtgttgctcccaccgcttcccgggaaa

SEQ ID NO: 172791 - DNA, 601 bp, Human
gactgtgagctgtcacagtggcctcctgactcccggcctagtgttcactacaccacactgccaggaagcagcttattccctagtcattcattcaaccactatttacttggctaaattctaatgaacaagacaagcaattttctgcctaggaaaatttgcatgagggaatcactgccctcccatatcataattcacccttccccgatttttcttcagcagggaccaacctgccctcatttccagtccctaaaatacaatatctagaagtgggtagggactcatcttggccaatcagaatacygcgctccctctggccacagtgattggctcaagaataggcacgtggccaggcgcggtggctgacccctgtgatcccagcactttgggaagcctaggcaggtggatcacctgaggtcaggagtttgagaccagcctggccaacatggtgaaaccccacctctactaaaaatacaaaaattagctgggcgtgatggtgcatgcctgtaatcccagctactcgggaggctgaggcaggagaatcacttgaacccgggaggcggaggttgcagtgagccaagatagcgccattgcactccagccc

SEQ ID NO: 172792 - DNA, 601 bp, Human
ccagaagagaggttacaccagctctgctcctttcctgagaggaaggttgaaggcttagtggagtggctagagccagggccagtgaccaaggcaaccaccttgaccatgctgagctggccaagggccccccttcaatcactcatctttcagtcctgaaagctggcaaagaaggccgcatgtcacctttacctgggtttcctgaaaagggatgttgtctcctgatggtggaggaggcccaggtggggaccattttccaggagtgcacaaaccttgccttgcccaccatcctgaaaggcagcaytgaccagacggccaggcctcagccagtaccagtgtcaacacaaggcacgcccgctacccagcacctcactcagattccatggagaccagaacctgccagacagaggttagtaggaaccacggaccaaaaagtgacttggccaaaattaaattctttcaaagcctcgttgaggcagcaatccatcaccttgaggccacaggagatgtaatacggctgatgataaaaacagctaacactgactgagcactctctgtgttccaggacaggacttaaacggaatttctcacttcatcctccatc

SEQ ID NO: 172793 - DNA, 601 bp, Human
acctgaagtcaggagttcaagaccagcctggccaacatggtgaaaccctgtctctactaaaaagtacaaaaactagccaagtgtggtggcacatgcctgtaatctcagctactcaagaggctgatgtgggagaactgcttgaacctgggaggtggaggttgcagtgagccgagatcgcaccactgcactccagcctgggtgacagagtgagatgccatctcaaaaaaaaaaaaggcccctaaaagcacgctgctcatctggagaccttaaacagcaatctattgcaaagcacagggaaaasgagctcctctggactgaatgaacatattatagcttagtctccaccgtggcaccttcctaaggataatattgatcacgctccacccttgccttccataacaactctggaacctgactgcaccggaaattccggctggccaagttattcctgcacatctagcaccctatggatgacaatgagcattcattcctgtcatcacagggacccgaggcttggagtttcccccattccacagacggacgtgcaagtccaggtttagaggggaaatgtgattggaactaggggagtggcaccagaatt

SEQ ID NO: 172794 - DNA, 601 bp, Human
aattgcttgaacccggaaggcagaggttgcagtgagccaagatggcaccactgcaccccagactagacaacaaagcaaaactctgtctcaaaaaaaataaataaataaaaaagaaagaaaaaggccgggcgcagtggctcatgcctgtaatcccagcactttgggaggccaaggtgggcggatcacaaggtcaggagtttgagaccatcctgaccaacatggtgaaaccccatctctactaaaaatacaaaaattagctgggcgtggtggcagacgcctgtaatcccagctacttaggaasctgaggcaggagaactgcttgaactcgggagacggagattgcagtgagccgagattgcaccacggcactccagcttgggcgacagagtgagactctgtctcaaaaaaaaaagaaagaaaaaaaaaccacaaacacatttccctacaaaatggcccctagccaggtgcggtggttcatgcctgtaatcccagcattttgggaggccaaggtaggtggatcacctgaagtcaggagttcaagaccagcctggccaacatggtgaaaccctgtctctactaaaaagtacaaaaactagccaag

SEQ ID NO: 172795 - DNA, 601 bp, Human
ttgccactgcactccagcctgggtgacaggaaaaaaagaaaacagccgggcacagtggctcatgcctgtaatcctagcactttgggaggccgagacaggcggattgcctgagctcagaaattcgagaccagcctaggcaagatggtgaaacctcatttctactaaaataccaaaaaatcagctgggcatggtggtaagcacctgtaatcccagctactcaggaggctgaggcacaagaattgcttgaacccggaaggcagaggttgcagtgagccaagatggcaccactgcaccccagackagacaacaaagcaaaactctgtctcaaaaaaaataaataaataaaaaagaaagaaaaaggccgggcgcagtggctcatgcctgtaatcccagcactttgggaggccaaggtgggcggatcacaaggtcaggagtttgagaccatcctgaccaacatggtgaaaccccatctctactaaaaatacaaaaattagctgggcgtggtggcagacgcctgtaatcccagctacttaggaagctgaggcaggagaactgcttgaactcgggagacggagattgcagtgagccgagattgcaccac

SEQ ID NO: 172796 - DNA, 601 bp, Human
tggctacacagctgtgaactgatttaatgccactaaatttacacttaaaattggccaaaatgataaatatgatgttctgtatattttaccacaattcaaaagagagagaaataatcatgtaaatggagcaagcaatcccaccccattgcacacaaggagctagtgtctgggaaatgggaggtgaggacccacagctccccaaggatcctgcgaggacgttggtggggaatgctgcagcaaacatctcacccaccctgctgcatggggttccggtgttgaacaagtacacatggccaggcayggtggctcacgcctacaatcccagcatttgggaatccgaggcgggtggcttgcttgagtccatgagtttaagaatagcccaggcaacagagcgaaatcccgcctctacaaaaaaaaatgcaaaaactagccaggcatgatggcatgcacctgtagtcccagctgcttgagaggctgaggcgggaggatcacttgagcccaggagacggaggctgcagtgagctgagatcttgccactgcactccagcctgggtgacaggaaaaaaagaaaacagccgggcacagtggctcatgcctgtaa

SEQ ID NO: 172797 - DNA, 601 bp, Human
tgaaaattttgaggtgtagacagcagtgatggctacacagctgtgaactgatttaatgccactaaatttacacttaaaattggccaaaatgataaatatgatgttctgtatattttaccacaattcaaaagagagagaaataatcatgtaaatggagcaagcaatcccaccccattgcacacaaggagctagtgtctgggaaatgggaggtgaggacccacagctccccaaggatcctgcgaggacgttggtggggaatgctgcagcaaacatctcacccaccctgctgcatggggttccrgtgttgaacaagtacacatggccaggcacggtggctcacgcctacaatcccagcatttgggaatccgaggcgggtggcttgcttgagtccatgagtttaagaatagcccaggcaacagagcgaaatcccgcctctacaaaaaaaaatgcaaaaactagccaggcatgatggcatgcacctgtagtcccagctgcttgagaggctgaggcgggaggatcacttgagcccaggagacggaggctgcagtgagctgagatcttgccactgcactccagcctgggtgacaggaaaaaaagaaaa

SEQ ID NO: 172798 - DNA, 601 bp, Human
acacaggagatagaggttgtggtgagctgaaatcgcgccattgcactccagcctgggcaacaggagcaaaactccatctcaaaaagaaagaaagaaagaaagaaagaaagaaatgtaaaatgatgcatgtggctcacattatagttctactggtctagagcattttggcttgtttttctccaacttgcaccatttgatattcaaaagcagaagtagtgataaggaagcacagacggattttgccatgattacaaattctgaacaaaaatgagctaatcttgtcaaattgcacatggggtgrtgtggtgaatgacctccaccccactcgggggaaagtctgtccctgtctgccatggctacagaagggacctaagacacttggggaacagccagtttctcatcccaaagtccctgagagcagaccccaggtccagaactggttttgtcaaagatatccacatggaaaagtgggctcctaaagccacaggggcccaggcctggtcacaagatgcgcctgagaaccatcacacagaaggaaatatcaaagggttggtgcatccttcaacctgtatctctggacttctcccttctacacttttgc

SEQ ID NO: 172799 - DNA, 601 bp, Human
ccgtccaatatgggagacactaacacatgtgctactgagtgttcgaaatgtggcgacggtagagacctaaatgtattattccattctcttctaattcatttaaatttgaaaactgagacttggttcagttactgggaaacgtttaagaatgttggaacaacttgggtgtgtgaatctacctttctcaactgtaaattttatgacatctaaacacagatcaaggacttctgatgaaaatttagctcccaaatttagatgtgttaaaagtgtaaaatatacactggacttgaagacttagaawgaaaaaaagtaaaatagctcaataactctttcaatggatcacatgtcaaaatgatcatatttttatacactgggttaaataaattatattattgaaactaatttcatctgtttctttttgctcttttggatgtggctgttagaaatgtaaaattatacatataggccaggtgcagtgactcatgcctgtaatcccagcactttgggaggctgaggcaggcagatcacctgaggtcgggagttcaagaccagcctgaccaacatggagaaaccccatctctactaaaaatacaaaattagc

SEQ ID NO: 172800 - DNA, 601 bp, Human
gtcactcattttgggccctgggagtcatctagagcttcactgtctatgccgtccaatatgggagacactaacacatgtgctactgagtgttcgaaatgtggcgacggtagagacctaaatgtattattccattctcttctaattcatttaaatttgaaaactgagacttggttcagttactgggaaacgtttaagaatgttggaacaacttgggtgtgtgaatctacctttctcaactgtaaattttatgacatctaaacacagatcaaggacttctgatgaaaatttagctcccaaattkagatgtgttaaaagtgtaaaatatacactggacttgaagacttagaatgaaaaaaagtaaaatagctcaataactctttcaatggatcacatgtcaaaatgatcatatttttatacactgggttaaataaattatattattgaaactaatttcatctgtttctttttgctcttttggatgtggctgttagaaatgtaaaattatacatataggccaggtgcagtgactcatgcctgtaatcccagcactttgggaggctgaggcaggcagatcacctgaggtcgggagttcaagaccagc

SEQ ID NO: 172801 - DNA, 601 bp, Human
atgggccaaatgccagacaccagagcttttcttcccaaagaactcactcttgctcctgtaatacatgttggaaaagagatcccccggccattgaaagatttgcccagagaccaaaatctggctcagggctgggggtggaggatgggggtagctattagcagaggacattcacgaggtcagcccaggccttcttgcagtcactcattttgggccctgggagtcatctagagcttcactgtctatgccgtccaatatgggagacactaacacatgtgctactgagtgttcgaaatgtggcgasggtagagacctaaatgtattattccattctcttctaattcatttaaatttgaaaactgagacttggttcagttactgggaaacgtttaagaatgttggaacaacttgggtgtgtgaatctacctttctcaactgtaaattttatgacatctaaacacagatcaaggacttctgatgaaaatttagctcccaaatttagatgtgttaaaagtgtaaaatatacactggacttgaagacttagaatgaaaaaaagtaaaatagctcaataactctttcaatggatcacatgtcaaaatgatc

SEQ ID NO: 172802 - DNA, 601 bp, Human
ctagactttgagctccgtgaggccagaggccttcccaactctgttaatgacatcgagttggtagcttgaaactgatcaggtggacatatgtgcattcagaaatgggccaaatgccagacaccagagcttttcttcccaaagaactcactcttgctcctgtaatacatgttggaaaagagatcccccggccattgaaagatttgcccagagaccaaaatctggctcagggctgggggtggaggatgggggtagctattagcagaggacattcacgaggtcagcccaggccttcttgcagtcrctcattttgggccctgggagtcatctagagcttcactgtctatgccgtccaatatgggagacactaacacatgtgctactgagtgttcgaaatgtggcgacggtagagacctaaatgtattattccattctcttctaattcatttaaatttgaaaactgagacttggttcagttactgggaaacgtttaagaatgttggaacaacttgggtgtgtgaatctacctttctcaactgtaaattttatgacatctaaacacagatcaaggacttctgatgaaaatttagctcccaaatttaga

SEQ ID NO: 172803 - DNA, 601 bp, Human
actagactttgagctccgtgaggccagaggccttcccaactctgttaatgacatcgagttggtagcttgaaactgatcaggtggacatatgtgcattcagaaatgggccaaatgccagacaccagagcttttcttcccaaagaactcactcttgctcctgtaatacatgttggaaaagagatcccccggccattgaaagatttgcccagagaccaaaatctggctcagggctgggggtggaggatgggggtagctattagcagaggacattcacgaggtcagcccaggccttcttgcagtsactcattttgggccctgggagtcatctagagcttcactgtctatgccgtccaatatgggagacactaacacatgtgctactgagtgttcgaaatgtggcgacggtagagacctaaatgtattattccattctcttctaattcatttaaatttgaaaactgagacttggttcagttactgggaaacgtttaagaatgttggaacaacttgggtgtgtgaatctacctttctcaactgtaaattttatgacatctaaacacagatcaaggacttctgatgaaaatttagctcccaaatttag

SEQ ID NO: 172804 - DNA, 601 bp, Human
atcactgctggagttatgtgttcatgcgctgttagttgtctcccacatgtagactggaggctccatgaggatgaggaccgtttccctcttgctcactgatgaatccccagtccccaccatggggccttccacttagtagctgctcagcagcatgtgctgcagacagtctagcctcggttcacgttactctgccgctctccctccaccacgcgccagccgcaacaccttctgtggggtcctctgcagactcctgcctcagggcctgcgcacttctgattccctctacctggcactttctgcycccacacatttggaggtctgcctccatctggtcttttggctctcagctaaaatgtcacctcatgagagaggctttctctgtccatcgtgtttacagcacctgctcctgaccctacccaggaatgcctactgcatttccccactgatttttcttccactcacttgtcacttgcccaagtcctctcatctacttcttcactggccttcataccgtctgtttctgccactagactttgagctccgtgaggccagaggccttcccaactctgttaatgacatcgagttggtagcttgaaactga

SEQ ID NO: 172805 - DNA, 601 bp, Human
gttcttgggctgggccaccccaaagggactttggctgctcgcgacagacccctgccccaccaagggcaggcacgtcctgtctcctttcatctccccagtgcatatctaccatggacagatttcacaccaggccccgtgccggggaccaaagagaacagaaagtgaaggagaggcacgatgaaggtgacagctgatacttaccgaagtttctgtgtgcccagccctgttatagaccttttctatttgtaaacaactattagctcaattattcctacaggcactactgtgaagatccccattytacagttgagaaaactgaggcacaaggacagaaggaattggctctggtctcacagtaagtggcaggcaggagacggattgcgaacctgcaggcttcagaggccgacctttgcgtttttcttgtttttctttttcttttttttttttaattgagtcagagtctcactcttgtcacccaggctggagtgcaatggcacaatctttggctcattgcaacctccacctcccgggttcaagtaattctcctgcctcaccctcctgagtagctgggattacaggcacacgccaccacgcccggcta

SEQ ID NO: 172806 - DNA, 601 bp, Human
acagaactgtgaggatttggtgagatagtcaggaaacagcccacccggcacaggcctagcacagaaaacattcctgacgaggccaactatccacatcatcatgttgctgcctccttccttttgttaccaccccctgcctcctgattcaccctctaggccaaggagctgccagcctcctcccccactttccctccctgagccttagggtgtctgtcccctctgtaaaatgggcatgtcgatacagtaataatacacccacctccagggctgcaaagcctgtgcagactttaaagtgctttamaaagtgctcgtgtgtgtgtgtgtgtgtgtgtgtctgtgtgtgtgtgtgtgtgtgtcccaacaaccgggtgccccaaaggcccaatccagagagagggcaggggttggtgagtgccagggagcccgaggaagaccaggtccccacagcaaatggaaagggttctggcacccaaaactgccaaaaagggctgccccaggccaggtgaccacagatccagacttcagaactgcagagatacaagggccaggataaaatgggcagactccgttgaaagacctccttgggccgggcgcggtggct

SEQ ID NO: 172807 - DNA, 601 bp, Human
agcaatacaaaagcaaacaaacaaaactcaatcccacagaactgtgaggatttggtgagatagtcaggaaacagcccacccggcacaggcctagcacagaaaacattcctgacgaggccaactatccacatcatcatgttgctgcctccttccttttgttaccaccccctgcctcctgattcaccctctaggccaaggagctgccagcctcctcccccactttccctccctgagccttagggtgtctgtcccctctgtaaaatgggcatgtcgatacagtaataatacacccacctccagrgctgcaaagcctgtgcagactttaaagtgctttacaaagtgctcgtgtgtgtgtgtgtgtgtgtgtgtctgtgtgtgtgtgtgtgtgtgtcccaacaaccgggtgccccaaaggcccaatccagagagagggcaggggttggtgagtgccagggagcccgaggaagaccaggtccccacagcaaatggaaagggttctggcacccaaaactgccaaaaagggctgccccaggccaggtgaccacagatccagacttcagaactgcagagatacaagggccaggataaaatgggcagactc

SEQ ID NO: 172808 - DNA, 601 bp, Human
actgcgccctccaccccacataccagttgcacgtcgaggcctctggaccttctgagatactggcttccagttggggttcccacgaaccctgctttgaatttggttaatttgctggaactggctcacagaactcatggaaacatttacttatgtttactgattcattatagaagatattacaaaagatacagatgaagggatgtgtatggtgaggctgggggaaggggcaaggggcttccatgccctccctgggtacaccaccctccaggaagctccacctggtcagctgtccagaggttcyctgaaccctatcctcttgggattttatgaagacttcgttacacaggcatgactgacaaccgtgtacagagacgtgattggaaaaaaaagtgcacggtctaaacccagcaagacctgctgctcagacttttctttctttctttttttttttttgagacagagtcttgctctgtcgtccaggctggagggcagtggcacaatctcggctctctgcaacctctgcctcccgggttcacgccattctcctgcctcagcctcccgaatagctgggaccacaggcacatgtcaccatgcccagcta

SEQ ID NO: 172809 - DNA, 601 bp, Human
ttttcctctgttctcacaccacaatcatcaacacagaagacatctgtgaccaaatgtgggggttttccccacacacaggcagtggacaccagctgtgtgtattccgattcaattccgacactatctaccgggagacagcgtcagatctcacaggctgagggctcaggccccgagactgcgccctccaccccacataccagttgcacgtcgaggcctctggaccttctgagatactggcttccagttggggttcccacgaaccctgctttgaatttggttaatttgctggaactggctcacrgaactcatggaaacatttacttatgtttactgattcattatagaagatattacaaaagatacagatgaagggatgtgtatggtgaggctgggggaaggggcaaggggcttccatgccctccctgggtacaccaccctccaggaagctccacctggtcagctgtccagaggttccctgaaccctatcctcttgggattttatgaagacttcgttacacaggcatgactgacaaccgtgtacagagacgtgattggaaaaaaaagtgcacggtctaaacccagcaagacctgctgctcagac

SEQ ID NO: 172810 - DNA, 601 bp, Human
tacaaaaagcttgctgttgaggaataactttcaaaccttgtttttcctctgttctcacaccacaatcatcaacacagaagacatctgtgaccaaatgtgggggttttccccacacacaggcagtggacaccagctgtgtgtattccgattcaattccgacactatctaccgggagacagcgtcagatctcacaggctgagggctcaggccccgagactgcgccctccaccccacataccagttgcacgtcgaggcctctggaccttctgagatactggcttccagttggggttcccacgamccctgctttgaatttggttaatttgctggaactggctcacagaactcatggaaacatttacttatgtttactgattcattatagaagatattacaaaagatacagatgaagggatgtgtatggtgaggctgggggaaggggcaaggggcttccatgccctccctgggtacaccaccctccaggaagctccacctggtcagctgtccagaggttccctgaaccctatcctcttgggattttatgaagacttcgttacacaggcatgactgacaaccgtgtacagagacgtgattggaaaaa

SEQ ID NO: 172811 - DNA, 601 bp, Human
agggcccgtggggccaagtcagatgtctggattcttatatgaaaggtgtggatgtataaagggccacaccaattcaaatagtacaaaaagcttgctgttgaggaataactttcaaaccttgtttttcctctgttctcacaccacaatcatcaacacagaagacatctgtgaccaaatgtgggggttttccccacacacaggcagtggacaccagctgtgtgtattccgattcaattccgacactatctaccgggagacagcgtcagatctcacaggctgagggctcaggccccgagactgygccctccaccccacataccagttgcacgtcgaggcctctggaccttctgagatactggcttccagttggggttcccacgaaccctgctttgaatttggttaatttgctggaactggctcacagaactcatggaaacatttacttatgtttactgattcattatagaagatattacaaaagatacagatgaagggatgtgtatggtgaggctgggggaaggggcaaggggcttccatgccctccctgggtacaccaccctccaggaagctccacctggtcagctgtccagaggttccctga

SEQ ID NO: 172812 - DNA, 601 bp, Human
gtgaaccaaggtgagcactgggtttccactctggagccagacacacctgggtcccaattatggccggacactaacagaatgaccttgggacaagtaacttcggagatccaagcctcagtatgctcatctgtaaagtgggggtgatggtagaggctgcctccctggttgtgatcacatgggatcacacagggaaagcctgtagctcagaacctggtgtccagtgagtacagcacagccattagtagcatgtccatgctgtgtccgtgctgtgtccatgctggaaaccgaaatcaccatccayagagacagccctgcaccagcgcctgccccgtgcaaggctggagaaacaacaggtgtcctgggcaagctcacacctcccacaggacagtaaaacactgcgcacacacacacactgtgtggcgtccatctgttgtccacagcacacgtcaccaactcacgtcaccaactcacatactatacgccttacttttattgtctgttgtctgcctccccctcctccctgccccctgtagaatgtaaatttccagagggcaggccttcgtgtctgtgcgccagcacctaaactgccgggcccacagcc

SEQ ID NO: 172813 - DNA, 601 bp, Human
cccccaaggaggaggtcaggagatggactcacaaatcccaggacaagggtaagaagggacagggaaaagcacaccagctgttggaaggcggcacattcaactcaaattgctaaatgttttgtaacctttcagttggtccttgagggacaggtaggagtcaaaccaaggcggcgggggtggggcagtgtggggcggtggccactgcaggcagagcacgcgctggcccgctcagagcctgctcagaaagccagggaagaagcacttccctaagggcaacccccagccttcccggattcattaktcaagggacatatgtctccaaagaaccaaagctcccacgtgaaccaaggtgagcactgggtttccactctggagccagacacacctgggtcccaattatggccggacactaacagaatgaccttgggacaagtaacttcggagatccaagcctcagtatgctcatctgtaaagtgggggtgatggtagaggctgcctccctggttgtgatcacatgggatcacacagggaaagcctgtagctcagaacctggtgtccagtgagtacagcacagccattagtagcatgtccatgctgtgtc

SEQ ID NO: 172814 - DNA, 601 bp, Human
atgaggagactcaggtggttgcacacctaactacgcgtgcccaagtcccaaggcacctcaggatggaaccaaggcgactcaatttcaggggacctaactccctcaggtactatctggcccacaggtcgcaagcactggctctggggtcaaagtcccctgagcttgagtccatcccatcttccagaaatgccaagatcagggctaagatcagactctgtgcagatgctaaccggacttcagccctagcggagagacaaaggcagttctgtgtctgcagggacatttttcatccatttgaccrtctgtctctctggccactgttctctaaagccagctctgctaaggacagtgctggacacaaaggggaaggagccaggcccatgcccctgccctgaggaaagtgacccccaaggaggaggtcaggagatggactcacaaatcccaggacaagggtaagaagggacagggaaaagcacaccagctgttggaaggcggcacattcaactcaaattgctaaatgttttgtaacctttcagttggtccttgagggacaggtaggagtcaaaccaaggcggcgggggtggggcagtgtggggcggtg

SEQ ID NO: 172815 - DNA, 601 bp, Human
cctggaggcagacaccaaaaaacgcaacagtcaacacagaaatgtccttagcatatcagcagccagctgctgtgggtggagtcccagaatctccccatctctgagctccaggccaaacaatgctgccatttactaggcagcctacacccccaggcctcccaggaacgctgggccaggcgtgttcctccacccccagcctcacccaccacattcgaaggaagcctggggaaggaattaggactgcccttgagcagggtgaactgagttcacccatgggcaagggcatctggaacagagggartgaccttgaggttcctaagcgtgtacgtgccatggggccgggtggagggagtcctgccgaggcaaaggggagggaacatctaagggatgacttagataccccccacccccttttacagatgaggagactcaggtggttgcacacctaactacgcgtgcccaagtcccaaggcacctcaggatggaaccaaggcgactcaatttcaggggacctaactccctcaggtactatctggcccacaggtcgcaagcactggctctggggtcaaagtcccctgagcttgagtccatcccatcttcc

SEQ ID NO: 172816 - DNA, 601 bp, Human
caaggtcagtctgactccaagacacacggacagcctagctgtgtagccacgggcaagctgctttccctctctaggcttgtttcttcctgcggaagcagaggtaggcatgaccatcagccccccaggcctccctgcactgagagatgctgtcagtggggcggtgctgggaacctccttagcctctccaatacagcacagaagacaaaagttatccaaccaaggcctctgcctgagaagcaagtccctggaggcagacaccaaaaaacgcaacagtcaacacagaaatgtccttagcatatcwgcagccagctgctgtgggtggagtcccagaatctccccatctctgagctccaggccaaacaatgctgccatttactaggcagcctacacccccaggcctcccaggaacgctgggccaggcgtgttcctccacccccagcctcacccaccacattcgaaggaagcctggggaaggaattaggactgcccttgagcagggtgaactgagttcacccatgggcaagggcatctggaacagagggagtgaccttgaggttcctaagcgtgtacgtgccatggggccgggtggagggagtcctgc

SEQ ID NO: 172817 - DNA, 601 bp, Human
agtagccttaagatgcccagaaatcaggggcagaacagccaaaagatggctaacagagatgacagccagattgtgcaaacgaagcaggacaaaggcaagccagtccctccctctactgccaaccaagagagaagagatgatggctgccattactgagccgctagtgcatacgtggcatggcgctaagtgtttgataagcattccttcacttaatttcataagcaatacaaatattcctgttttacagatggggaaactgaggtttggtgggggaaggggcttccccaaagccactcagctrataagtgacagaaccagagtatagaccaaggtcagtctgactccaagacacacggacagcctagctgtgtagccacgggcaagctgctttccctctctaggcttgtttcttcctgcggaagcagaggtaggcatgaccatcagccccccaggcctccctgcactgagagatgctgtcagtggggcggtgctgggaacctccttagcctctccaatacagcacagaagacaaaagttatccaaccaaggcctctgcctgagaagcaagtccctggaggcagacaccaaaaaacgcaacagt

SEQ ID NO: 172818 - DNA, 601 bp, Human
aggcgcagtggttcacgagttcaggagtttgagaccagcctgggcaacaaggccaaaccctgtctctagtaaaaatacaaaagtcagccaggtgtggtggcacatgtctataatcccagctactcgggaggctgaggcaggagaatagcttgaaccgggaggcagaggctgcagtgagccgagatcgtgccactgcactccaggctaagcaacacagcaagacactgtctcaaaaacaaaacaaaaaaaaagaaagaaagaaaattaaggcactttgactccagaggtgaggcatcaacaygcagtgaccacaccgtgctctgggcctggatcccctcacctccctgggctttcctgaggccaagagcatgtcctgggtacacaaaggtgctcaataaataaatgttagcaaaactcctagaactcaaattaaataagccacagccaggagatgtggacatggtcctgggtctgccaccatccttctgtggggctgtcctgacctctttcctgctctgagcctccgctgttttcccatctggaaaatgaagctctcaacagcaataaggtcatttgcaacatggactatgtaggttcaaag

SEQ ID NO: 172819 - DNA, 601 bp, Human
cccagataagggtgagcctggaccacccacagggtttagacattaacttttacagcgtataggcagtaggaccagcaggaattgggttggcactgtcacagccccagctgtcctcaagaaaaaaccgagtgctaggcgcagtggttcacgagttcaggagtttgagaccagcctgggcaacaaggccaaaccctgtctctagtaaaaatacaaaagtcagccaggtgtggtggcacatgtctataatcccagctactcgggaggctgaggcaggagaatagcttgaaccgggaggcagagsctgcagtgagccgagatcgtgccactgcactccaggctaagcaacacagcaagacactgtctcaaaaacaaaacaaaaaaaaagaaagaaagaaaattaaggcactttgactccagaggtgaggcatcaacacgcagtgaccacaccgtgctctgggcctggatcccctcacctccctgggctttcctgaggccaagagcatgtcctgggtacacaaaggtgctcaataaataaatgttagcaaaactcctagaactcaaattaaataagccacagccaggagatgtggacatggtcctg

SEQ ID NO: 172820 - DNA, 601 bp, Human
gagataaggaagccaggatgtcccagataagggtgagcctggaccacccacagggtttagacattaacttttacagcgtataggcagtaggaccagcaggaattgggttggcactgtcacagccccagctgtcctcaagaaaaaaccgagtgctaggcgcagtggttcacgagttcaggagtttgagaccagcctgggcaacaaggccaaaccctgtctctagtaaaaatacaaaagtcagccaggtgtggtggcacatgtctataatcccagctactcgggaggctgaggcaggagaatmgcttgaaccgggaggcagaggctgcagtgagccgagatcgtgccactgcactccaggctaagcaacacagcaagacactgtctcaaaaacaaaacaaaaaaaaagaaagaaagaaaattaaggcactttgactccagaggtgaggcatcaacacgcagtgaccacaccgtgctctgggcctggatcccctcacctccctgggctttcctgaggccaagagcatgtcctgggtacacaaaggtgctcaataaataaatgttagcaaaactcctagaactcaaattaaataagccacagcca

SEQ ID NO: 172821 - DNA, 601 bp, Human
atctacgacacctaatgcaatttgagagcttactctgtgccgggccgtatgctaagtgctttccatggattatctcacactcactatttgaggtaggtatcctaaaaaatgcctggacctcataagatttattgtgaggattaagtaggataatgtatgtcagaacaaaagacattgcctggtacatagtaagtcaatgcttgataaatgttatcgagtattaccagcactaggtattattgtattcccattttacatatggggaaactgaggctcaggaagattaaggtcacagataagyggcagagatctaagcaccccatccctcctcatgcctcaaggaggaagccacaaacaggctgggtcacagcccctgggtgggtggggggaaaggcccctctgcttctttgctccagccctctctgggccctactggtcagcacacacataccaagtgagcttgctcaccagagataaggaagccaggatgtcccagataagggtgagcctggaccacccacagggtttagacattaacttttacagcgtataggcagtaggaccagcaggaattgggttggcactgtcacagccccagctg

SEQ ID NO: 172822 - DNA, 601 bp, Human
ctcttctccaccagaccagccctctgggaataaatattgacaccaaagtgctgtgccaagttgatttccacccttctaagtaatgcgcacaaagaaaacccgatgtgtgcaggtgttctaaggttttacatcatgtcctcaacatccccacaaggcaggcagttagcagtttaacctgggccaacctcggtatccctatctacgacacctaatgcaatttgagagcttactctgtgccgggccgtatgctaagtgctttccatggattatctcacactcactatttgaggtaggtatcctaaaaaatgcctggacctcataagatttattgtgaggattaagtaggataatgtatgtcagaacaaaagacattgcctggtacatagtaagtcaatgcttgataaatgttatcgagtattaccagcactaggtattattgtattcccattttacatatggggaaactgaggctcaggaagattaaggtcacagataagtggcagagatctaagcaccccatccctcctcatgcctcaaggaggaagccacaaacaggctgggtcacagcccctgggtgggtggggggaaaggcccctctgct

SEQ ID NO: 172823 - DNA, 601 bp, Human
taggcggggataaatgagacagcacacgtcacacacccagcattagacctgcacacctcaatttaagtaattatttgccttcttggcccagtgtccacttagagttgccgtgggactgattactacacaaacgtctttagagctgtgcaaattaggaatcagctcaatattgcttaggactgacagagctaggattttaaaatctctcttctccaccagaccagccctctgggaataaatattgacaccaaagtgctgtgccaagttgatttccacccttctaagtaatgcgcacaaagaraacccgatgtgtgcaggtgttctaaggttttacatcatgtcctcaacatccccacaaggcaggcagttagcagtttaacctgggccaacctcggtatccctatctacgacacctaatgcaatttgagagcttactctgtgccgggccgtatgctaagtgctttccatggattatctcacactcactatttgaggtaggtatcctaaaaaatgcctggacctcataagatttattgtgaggattaagtaggataatgtatgtcagaacaaaagacattgcctggtacatagtaagtcaatg

SEQ ID NO: 172824 - DNA, 601 bp, Human
caggaatcagaggttgcagtgagccgattgtgccactacatacactccagcctgtgtgtcagagccagaccctgtctcaaaaaaaaaaaaaaaaatttaaaagagagaaaaataaggtggtcctgcatgggcttagatacaggtaatacactctggtaagggaggtgcctgctctacctgggccctcttgtcagaggtgtggtctctgcacccaggaactccttgtttccctggcaacctcagcctatatgcgctctcagagggtgtctgatgggggatgtcacagcagcctgtaatcgcyggctttcttctctggctgagggccaaaggaaactggacacctgtgttccatgacccccatcagtttagatcgagcagctgtcgtggtgccgtgtaagggttggggccttgctacgggatcctggcaggccgcaacacctctaaggtaactcgtccattcattcataaatttatcaggcacctgccctgtaccaggcattgttttagccactgggaatacagcagtgaaaaaacagtttccatctcctgggagttcacattcaggaggccaatctatgggtctggatggttatctccacct

SEQ ID NO: 172825 - DNA, 601 bp, Human
acaatggatccctattctgccttaagaaggaaattccgcaaagtgagacaatatggatgaaccctgaggacattatgctacatggaataagccagtcacggaaaggcaagtactgcagattccacttaaatgaggaatctggtaaaacagtcaaaatcctagaatcaagagtggaatggtggctgccacgggctgatggtagaggaaatggggagttactcattactgggcataaagtttcagttaagccagatgaataagctctggagatctgttggacaacgctatagctatggtctgyacaatgtgctgtacacgttaaaatgtgtttaaagggtagtctcacgctaagtgttcttatcacaagaaaatacaatttagggccaggcgcggtggctcatgcctgtaatcccagcactttgggaggccgaggcgggaagattgcttgagctcaggagttcgagaccagcctgggcaacaaagtgagacctcgtatctacaaaaaatacaaaaaaaaattagccaggcatagtggtgcgtgcctgtggtcccagctactcaggaggctgacgtgggaggatggcttgtgcccaggaatcag

SEQ ID NO: 172826 - DNA, 601 bp, Human
agatacctgcacccccatgttcatcgcagcactattcataaaagccgagatgtagaaacaacctaaatgtccaccaagagatgaatggataaagaaaatgtagtatgtacacacaatggatccctattctgccttaagaaggaaattccgcaaagtgagacaatatggatgaaccctgaggacattatgctacatggaataagccagtcacggaaaggcaagtactgcagattccacttaaatgaggaatctggtaaaacagtcaaaatcctagaatcaagagtggaatggtggctgccaygggctgatggtagaggaaatggggagttactcattactgggcataaagtttcagttaagccagatgaataagctctggagatctgttggacaacgctatagctatggtctgcacaatgtgctgtacacgttaaaatgtgtttaaagggtagtctcacgctaagtgttcttatcacaagaaaatacaatttagggccaggcgcggtggctcatgcctgtaatcccagcactttgggaggccgaggcgggaagattgcttgagctcaggagttcgagaccagcctgggcaacaaagtgagac

SEQ ID NO: 172827 - DNA, 601 bp, Human
aaccatatatttaacaggggttaatctccaaaatatataaggaactcctgcaacttgattgcaaaaaaaaccctaatatcccaattaaaaaatgaatgaaggacgtgaatggacacctcttcaaagacgacatacaaatgtccaacaggtaaataaaaagatgctcaacatcactaatcatcacggaaaggcaaatcaaaaccacagtgagatatgtatcatcttacacctgtaaaaatggctatcatcaagaagacaaaagatgacacgtgttgatgaggatgtggagaaaagggagcayttgcacactgttggtgggtatacaaaacggtgcagctgctatagaaaacagtatggaagttcctcaaaaattaaaaacagaactacttggccaggtgtggtggtgcatgcctgtaatcccgtcactttcggaggccgaggcaggtggatcacctggggtcaggagttcgagaccagcctggccaacatggcaaaacctcgtctctactaaaaatacaaaaattagcctggtgtggtggcacatgcctgtaatcccagctactcaggaggctgaggcaggagaatcgcttgaatccgggag

SEQ ID NO: 172828 - DNA, 601 bp, Human
gggaggctgaggcaggagaatggtgtgaacccaggaggcggagcttgcagtgagccaagatcacaccactgcactccagtctgggcgacagagcgagactccatctcaaaataaaataaaaaataaaaattaaagatgacacatataaatggaagacatcccagctttatggaccggaagacttaatattgttaagatgtcaatactacccaacatgatctacagattcattgtaatccctgtcaaatcctgatggcatcttttacagaaatagaaaaatctatcctaaaatattatggamtctcaagggaccctaaatagccaaaacaattttgaaaaagaaaaacaaaggtgaaggtcgcacacttccagatttcaaaatgtactacaatgctgcagtaaccaatacggtgtggtactggcataaagacagacatatagatcaagagaacagaatagagagtccagaaataaggctgggcatggtggctcacactggtaatctcagcaccttgggaggtgagaggactgcttgagtccaggaattcaagaccagcctgggcaatatagtgagaccccatctctggaaaaaaaaaaaaaa

SEQ ID NO: 172829 - DNA, 601 bp, Human
ctgttggtatacaacataatcttatatgtagaaaatgctaaagattatgcaagaaagttagaattaataaacacatttagttgcaggtataagataagcacacaaaaatcaaccgtgtttctacatactaacaatgaataaacaaaaaattcaatttacaacagcatcaaaaaatgaatatacttaggaatgtttatatagtattcctaaaaacttaagaagaaataaacttaaaaaggaggcaaaagtcctgtgcactgaaaactataaattgttgcaaaaaaaaattaaagattggccrggcgcggtggctcacacctgtaatcccagcactttgggaggctaaggtgggcggatcacgaggtcaggagatcgagaccatcctggctaacacagtgaaaccccgtctctactaaaaaagtacaaaaaatcagctggacgtggtggcgggtgcctgtagtcccagctactcgggaggctgaggcaggagaatggtgtgaacccaggaggcggagcttgcagtgagccaagatcacaccactgcactccagtctgggcgacagagcgagactccatctcaaaataaaataaaaaataaaaa

SEQ ID NO: 172830 - DNA, 601 bp, Human
aaaaaaaaaaaattagccgggcgtggtggcgggcgcctgtagtcccagctactcgggaggctgaggcaggagaatggcatgaacctggaggcggagcttgcagtgagccgagatcacaccacagtactccagcctggacgacagagcgagactctgtctcaaaaaaaaaaaaaaaaaggccatatattaaaggccatatattaaaaatgcacagttaacatcgcacttaatggtgaaagactgaaagcttttcctccaagatcacgaacaaggcaaaaatgcccacgctcaccactcctayacaacatagcactgagagtcctagccagtgcacttaggcaacaaaatgaaataaaagacatctaaattggaaaggagaaataaaattattattattatttttttattgagatggagtctcactctgtcacccaggctggagtgcagtggcacaatcttggctcactgcaacttccgcctcccgggttcaagcaattctcctgcttcagcctcccaagtagctggaattacaggcatgtgccaccacgcctggctaatttttttgtatttttagtagagagggggtttcaccatattggcc

SEQ ID NO: 172831 - DNA, 601 bp, Human
ccgaggcgggcggatcacaaggtcaggagatcgagaccatcctggctaacacagtgaaatcccatctttactaaaaatacaaaaaaaaaaaaaaaaaaattagccgggcgtggtggcgggcgcctgtagtcccagctactcgggaggctgaggcaggagaatggcatgaacctggaggcggagcttgcagtgagccgagatcacaccacagtactccagcctggacgacagagcgagactctgtctcaaaaaaaaaaaaaaaaaggccatatattaaaggccatatattaaaaatgcacarttaacatcgcacttaatggtgaaagactgaaagcttttcctccaagatcacgaacaaggcaaaaatgcccacgctcaccactcctatacaacatagcactgagagtcctagccagtgcacttaggcaacaaaatgaaataaaagacatctaaattggaaaggagaaataaaattattattattatttttttattgagatggagtctcactctgtcacccaggctggagtgcagtggcacaatcttggctcactgcaacttccgcctcccgggttcaagcaattctcctgcttcagcctcc

SEQ ID NO: 172832 - DNA, 601 bp, Human
taccacattaacacgatgaaaggagataaaaaaaaactacgtgatcatctcagttaaagcagaaaaagcatttggcacagttaaacaccacttcatgagaaatactcaacaaacaaaatagaagaaaacaacctcaacatatataaaggtcatatattaaaatgccatatattgggccaggcgcagtggctcacgcctgtaatctcagcactttgggaggccgaggcgggcggatcacaaggtcaggagatcgagaccatcctggctaacacagtgaaatcccatctttactaaaaatacaaaaaaaaaaaaaaaaaaattagccgggcgtggtggcgggcgcctgtagtcccagctactcgggaggctgaggcaggagaatggcatgaacctggaggcggagcttgcagtgagccgagatcacaccacagtactccagcctggacgacagagcgagactctgtctcaaaaaaaaaaaaaaaaaggccatatattaaaggccatatattaaaaatgcacagttaacatcgcacttaatggtgaaagactgaaagcttttcctccaagatcacgaacaaggcaaaaatgcccacgctcacca

SEQ ID NO: 172833 - DNA, 601 bp, Human
gttctcactgtgcatatattattatctttaaagtgagacttattttaaaactaggaatgtttttgttcttaagatataaggacatcaggacagttcctgggtctgttatatcctgggtctgtttctgttcccttaactataaacgtcttagggctaagaatacctaacctcttgagaatgtggcccagcaggtctcagcctcattttacccagcccctattcaagataaagtcactctggtttgaatgcctctgacatactgatgcaaagatactcaacaaaatacttgcgaatcatattyaactattaaaagagagattacaccatgatcaagtgggatttattcctggaatgtaaggatggttcaacattcaaaaatctatcaatgtaatataccacattaacacgatgaaaggagataaaaaaaaactacgtgatcatctcagttaaagcagaaaaagcatttggcacagttaaacaccacttcatgagaaatactcaacaaacaaaatagaagaaaacaacctcaacatatataaaggtcatatattaaaatgccatatattgggccaggcgcagtggctcacgcctgtaatctcag

SEQ ID NO: 172834 - DNA, 601 bp, Human
aggcggaggttgcagtgagccaagatcacgtcactgcactccagcctgggagacagagcgagactccatctcaaaaaacaaaagataaacaacagtaagtgttggcaggaatatggagaaattggaaccttcatacactgatggtggtaatgtaaaatgtgcagtccaggcactttgggagagtccggcagttcctcaatatgttaaacgtagcattactattgatccaaatggcaattccctcctacatatagatccaaaagaatttttaaaatatgttcattagctaaacagactaagwtaaaaactcaaattatggccaggcacgttggctcacgcctataatcccagtgctttggggtggatcacctgaggtcaggcattcaagaccagcctggccaacatagagaaaccctgtctctactaaaaatacaaaaatttgccaggcttggtggcacacgcctgtaatcccagctacttgggtggctgaggtatgagaatcgcttgaacccaggaggtggaggttgcagtgagccgagatcacaccactgcactccagcctaggcaacagagtgagactctgtctcaaaataaataaata

SEQ ID NO: 172835 - DNA, 601 bp, Human
tggttgcaggaaaccatgttgcaaccacgagagaagtgggtgtgaagacaaagctaatacacagaggaagacagagagaatcacaggaaaacggagaacaagcctgctccctactgactttttaggcagaatatgcaaacgaattaatttctgcgctgtttagtaggttagtttaaggtttgctgtcacttgttaccaaaagtacctgatcccacgcttggcaggagatgatgagtaaccacactctccaggtggcagactccaggttgtaccagctgaaaatgctacaccaacggctctgcaacttgaacgttcagcagagtgcttgttaaaacagatcactgggtcccactccagagcttctgattcagtgggtctgaagcaaggtccaagaatctggtttccaacaagtgctcagatgctgctgctgttgctggacccctggtcacactttgagaactactgctcaatgggaatttataagagcaagaggcctggaccctgggaccacatctgtcctccccttaacaaaaggcactgtaagatgttggtagagaaacttgggggcaaactggcagaagtactgcctcttttatgctcc

SEQ ID NO: 172836 - DNA, 601 bp, Human
taggacttactcatcccctgcaagggaggggtagaagcagggtgctaagccagtcaggaaaattttctgcctcgtgccctgactcagggctggtgtcatcagagctaagctggtgagttgtgcttgatggtgtggaatgccacgtcgtctcactctggagctaattaggaagcacacaactctgatggttgcaggaaaccatgttgcaaccacgagagaagtgggtgtgaagacaaagctaatacacagaggaagacagagagaatcacaggaaaacggagaacaagcctgctccctactractttttaggcagaatatgcaaacgaattaatttctgcgctgtttagtaggttagtttaaggtttgctgtcacttgttaccaaaagtacctgatcccacgcttggcaggagatgatgagtaaccacactctccaggtggcagactccaggttgtaccagctgaaaatgctacaccaacggctctccaacttgaacgttcagcagagtgcttgttaaaacagatcactgggtcccactccagagcttctgattcagtgggtctgaagcaaggtccaagaatctggtttccaacaagtgctc

SEQ ID NO: 172837 - DNA, 601 bp, Human
cttagagctatcccagaggaagcagatatccaggctgagttttgaagggtgaatttaccacgtggggaagggtaaaggcattcctggcagaacacagaagcagaggtggggcagcagggaaaagcgtggaagcgggtaatggcggagcattccatggggttccaaaggatgggaatccagcaggctggaggtcaattagaactagaacttgaacatctcaaagtatgaacctaatctggagagctgtgtgtgcgtgtgtgcgtgtgtgtctggggagatacaccaaagggtttaagcaagrggtgttgtagacaggcttttgctttggaaagatccctctagatgcattattaaggaaaaaacagtgggttggggacaaacagcgaagaggccatttcatgagtcctgatgtcctgggcaccatggctacctccccctccacatacaccatgtcttccttcccctttgtgaaatagccatgagaactgggtaggacttactcatcccctgcaagggaggggtagaagcagggtgctaagccagtcaggaaaattttctgcctcgtgccctgactcagggctggtgtcatcagagctaagct

SEQ ID NO: 172838 - DNA, 601 bp, Human
cctactttgctaggcaacagtaggggacacaaaagtagtatgtgatcaacaaacactatctgagctcctagtgcatggcaagcctggggactgaggacccagggagaatcaaacaggtccctgccccaagatcaccagctgagggagatatagaaatgagtggtgcaggcacacggtgactatgtaacccagaagcctgtggacacggtcattaacctgccttagagctatcccagaggaagcagatatccaggctgagttttgaagggtgaatttaccacgtggggaagggtaaaggcaytcctggcagaacacagaagcagaggtggggcagcagggaaaagcgtggaagcgggtaatggcggagcattccatggggttccaaaggatgggaatccagcaggctggaggtcaattagaactagaacttgaacatctcaaagtatgaacctaatctggagagctgtgtgtgcgtgtgtgcgtgtgtgtctggggagatacaccaaagggtttaagcaagaggtgttgtagacaggcttttgctttggaaagatccctctagatgcattattaaggaaaaaacagtgggttggggacaaac

SEQ ID NO: 172839 - DNA, 601 bp, Human
aagtccaaagtgaaaccgccccagtgctaaaaggacggattccctgaacctgtcaagggcataagcagcctatatttgcaggtggctcacggttttcctaggacctgaagaactgagatttgtggtcagtttaatgcattgatcattataaactgagtgtctaccaggggccctactttgctaggcaacagtaggggacacaaaagtagtatgtgatcaacaaacactatctgagctcctagtgcatggcaagcctggggactgaggacccagggagaatcaaacaggtccctgccccaaratcaccagctgagggagatatagaaatgagtggtgcaggcacacggtgactatgtaacccagaagcctgtggacacggtcattaacctgccttagagctatcccagaggaagcagatatccaggctgagttttgaagggtgaatttaccacgtggggaagggtaaaggcattcctggcagaacacagaagcagaggtggggcagcagggaaaagcgtggaagcgggtaatggcggagcattccatggggttccaaaggatgggaatccagcaggctggaggtcaattagaactagaactt

SEQ ID NO: 172840 - DNA, 601 bp, Human
tggataaagggaggctcctcaggatcggaaagctaaaggcctctaagccctgatcaagtccaaagtgaaaccgccccagtgctaaaaggacggattccctgaacctgtcaagggcataagcagcctatatttgcaggtggctcacggttttcctaggacctgaagaactgagatttgtggtcagtttaatgcattgatcattataaactgagtgtctaccaggggccctactttgctaggcaacagtaggggacacaaaagtagtatgtgatcaacaaacactatctgagctcctagtgcrtggcaagcctggggactgaggacccagggagaatcaaacaggtccctgccccaagatcaccagctgagggagatatagaaatgagtggtgcaggcacacggtgactatgtaacccagaagcctgtggacacggtcattaacctgccttagagctatcccagaggaagcagatatccaggctgagttttgaagggtgaatttaccacgtggggaagggtaaaggcattcctggcagaacacagaagcagaggtggggcagcagggaaaagcgtggaagcgggtaatggcggagcattccat

SEQ ID NO: 172841 - DNA, 601 bp, Human
gctgggaagctctgggttaagttcctcagctttggtttgactcccaggccttacttgctttttttagtatctgggtcttaacatttttaccttcagcttatcagtggcaggagggctacaggggattggtattataaacttgtcagggctttttgcagaaatacatggggtttaattaataaaacaatagtctcaacagtaacagataaaataatagttgaatgtatctcccaaaaggcatgtgttggaaacttaatccccaatgtaacagtgttgggaggtgggaccaacagtaatgggrggtgtttagaccatgagggctccaccctcatgaatgaattagtgctgattataaaagggctagaggctgtgagttcagttgctggctctctcctgcatgccctcttgctctttccaccttccacgatggcaagaaggccctcgccagatgcagggccctcaaccttggacttcccagcctccagagccatgagctagataaatttctattgtttacaaattacccagtgtcaggtattctgttatagcagcataaaatgcactgagacgatggtaataaatatgaataaaataataatct

SEQ ID NO: 172842 - DNA, 601 bp, Human
ctgggactacaggcgcccgccaccacatccggctaattttttgtattttttggtagaggcagggtttcaccgtgttagccaggatggtctcgatctcctgacctcgcgatctgcctgcctcagcctcccaaagtgctgggattacaggcgtgagcccccgcgcctggcctgtcatcagctattcttaagagtcagtatgagaagtgaccaaacccaggcagttcctgcatctttcagtgaaactgtcccttacacaacactcttatacaacgtccctgtgccctctccagaggtcagcacyaggaaagctcgtgcattctgacaacctggcttgcttcctcttctttagttcaagagctccacaaccccttgagcttcccttttatttatttatttttttgccttggctgctgggaagctctgggttaagttcctcagctttggtttgactcccaggccttacttgctttttttagtatctgggtcttaacatttttaccttcagcttatcagtggcaggagggctacaggggattggtattataaacttgtcagggctttttgcagaaatacatggggtttaattaataaaacaatagtc

SEQ ID NO: 172843 - DNA, 601 bp, Human
tgccatcagctgtttttttttttttttttttttgacagagtctcactctgttgcccaggctggagtgcagtggcgcgatcttggctcactgcaagctccgcctcccaggttcacgccattctcctgcctcagcctcccgagtagctgggactacaggcgcccgccaccacatccggctaattttttgtattttttggtagaggcagggtttcaccgtgttagccaggatggtctcgatctcctgacctcgcgatctgcctgcctcagcctcccaaagtgctgggattacaggcgtgagccmccgcgcctggcctgtcatcagctattcttaagagtcagtatgagaagtgaccaaacccaggcagttcctgcatctttcagtgaaactgtcccttacacaacactcttatacaacgtccctgtgccctctccagaggtcagcaccaggaaagctcgtgcattctgacaacctggcttgcttcctcttctttagttcaagagctccacaaccccttgagcttcccttttatttatttatttttttgccttggctgctgggaagctctgggttaagttcctcagctttggtttgactcccagg

SEQ ID NO: 172844 - DNA, 601 bp, Human
accatctgtatggccttggacaaccgccaatcctctccgtaaaatgggctaatattacgtggctctaggatttactgtaaggaacagatgaggtggtacttataaagacctagtcctaggctgggggcagtgactcactcttgtaatcccagcatattgggaagatgaggcaggcagatcacctgaggtcaggagttcgagaccagcctggccaaaatggcaaaaccccgtctccactaaaaatacaaaaagtagccaggtgtggtggcgggcacctgtaatcccagctacttgggaggckgaggcaggagaatcacttgaacccaggaggcggaggctgcagtgagcggagatcacaccacggcattccagtctgggtgacagagcaagactctgtctccaaaaaaaaaaaaaaccgaaaaacccagtcctaatacaccgtggatatgtaacaaggtcagacacttcccgcttctccaacaaggtgccaacacagaggaaaagattgtaaacctggggtcgagtcctggtgtgccacttaattgactacatgaccctggataagtcaatctccctgagcctccatttccccatctgtaaa

SEQ ID NO: 172845 - DNA, 601 bp, Human
taacacctaccatctgtatggccttggacaaccgccaatcctctccgtaaaatgggctaatattacgtggctctaggatttactgtaaggaacagatgaggtggtacttataaagacctagtcctaggctgggggcagtgactcactcttgtaatcccagcatattgggaagatgaggcaggcagatcacctgaggtcaggagttcgagaccagcctggccaaaatggcaaaaccccgtctccactaaaaatacaaaaagtagccaggtgtggtggcgggcacctgtaatcccagctactygggaggcggaggcaggagaatcacttgaacccaggaggcggaggctgcagtgagcggagatcacaccacggcattccagtctgggtgacagagcaagactctgtctccaaaaaaaaaaaaaaccgaaaaacccagtcctaatacaccgtggatatgtaacaaggtcagacacttcccgcttctccaacaaggtgccaacacagaggaaaagattgtaaacctggggtcgagtcctggtgtgccacttaattgactacatgaccctggataagtcaatctccctgagcctccatttcccca

SEQ ID NO: 172846 - DNA, 601 bp, Human
aaccctggctgggaacccctggttagcctccctaacacctaccatctgtatggccttggacaaccgccaatcctctccgtaaaatgggctaatattacgtggctctaggatttactgtaaggaacagatgaggtggtacttataaagacctagtcctaggctgggggcagtgactcactcttgtaatcccagcatattgggaagatgaggcaggcagatcacctgaggtcaggagttcgagaccagcctggccaaaatggcaaaaccccgtctccactaaaaatacaaaaagtagccaggygtggtggcgggcacctgtaatcccagctacttgggaggcggaggcaggagaatcacttgaacccaggaggcggaggctgcagtgagcggagatcacaccacggcattccagtctgggtgacagagcaagactctgtctccaaaaaaaaaaaaaaccgaaaaacccagtcctaatacaccgtggatatgtaacaaggtcagacacttcccgcttctccaacaaggtgccaacacagaggaaaagattgtaaacctggggtcgagtcctggtgtgccacttaattgactacatgaccctgga

SEQ ID NO: 172847 - DNA, 601 bp, Human
tgagatggggatgatacaccctaaccctcatgggaatgataagctcatccaggccttgacacgtgcctggccccaggtcgggactcagttatgtgagctgtcactatgattctttccttgagttcatgggtctgtttttctcatttatttttgtttgggttttttgaggctctgtgaaagccatcctctcccctctcacccagaaatgttcctgtgccattctattgaatccttccacatcctgaagttccatcaccaaaccctggctgggaacccctggttagcctccctaacacctacyatctgtatggccttggacaaccgccaatcctctccgtaaaatgggctaatattacgtggctctaggatttactgtaaggaacagatgaggtggtacttataaagacctagtcctaggctgggggcagtgactcactcttgtaatcccagcatattgggaagatgaggcaggcagatcacctgaggtcaggagttcgagaccagcctggccaaaatggcaaaaccccgtctccactaaaaatacaaaaagtagccaggtgtggtggcgggcacctgtaatcccagctacttgggaggcgga

SEQ ID NO: 172848 - DNA, 601 bp, Human
agtcatcagaaatggatccatgcatgctgatcccgaacgccaaggaagaggtacttcctccatccacttgttcattcattcattcgtccattcatttgttccctcttacccaaccaccacctaaccagcttgttcccagtggcaagggaacagacagaggtgacttggaaacaggcaatgaccttttgaagcacagcatatcattctgccttgtagtaattctcagctccacgaaagaggaagaaaaattctactaactgctagaaaaaaaacaagccacaagaggtgatgatggaaaagmagcaaaactcagtgaccatgcaaggccacttactagctgggcgacctgtgagatggggatgatacaccctaaccctcatgggaatgataagctcatccaggccttgacacgtgcctggccccaggtcgggactcagttatgtgagctgtcactatgattctttccttgagttcatgggtctgtttttctcatttatttttgtttgggttttttgaggctctgtgaaagccatcctctcccctctcacccagaaatgttcctgtgccattctattgaatccttccacatcctgaagttcca

SEQ ID NO: 172849 - DNA, 601 bp, Human
ggattaaaggcacctgccaccacacctggctaatgtttgtgtttttagtagagatggggtttcaccatgttggccaggctggtctcaaacatctgacctcaggtgatccacccgccctggcctcccaaagtgctgggattacaggcgtgagccaccctgcctgacctcttttttcttaaagtagggctacaggtggttgaggaagagggatggcgtcacaaacttcaggacaggcagaatcacctcttagcttccagctcctggcccctgcttgttgtgaagttccttcaacccagctcascagaggccctggagagtggggcagtcaagaagacccacgctgtctctaaacaggaaagaaactctcaaccatggtctagctggaccagagacagctctccagccagaggagggtggagcagcctcaggaatttgatgaagcctccagtttgtggcttaccttccaggagcctcctggcaatgtaaatatgaccctgaggtcatgtgggtcctatgaggatgtggtgatgcgtggctttggagccagtcacggctgggctcatggcccaggtccaccgctcactagtgtggccttggacag

SEQ ID NO: 172850 - DNA, 601 bp, Human
cctatgcgcctggtgcccacctgccagctgccctgtttcctatgctccacagccaagaacctcaggatgccttcccccggccaagctggccaagtcctctcagaatcccagcacctgtctcaggctctctccatcttccagaaccctggaccttgctggctcagaacatcagggccttgaagatcagctcagatggagaaactgaggccaaaaaaggggatgtaactgaccaaggccacagagattgttcctggactggaagcagagctccaaaccctcaggtcattcattcattcatcawacacctactccacactgacaggctgcaggccccgggagaacaaccaggtctaggccctcaaggggctcccagcctagtggaggggcagaaaggacgattacagtagaaaggtccttcctgacctcgtgatccacccgctgcactccagcctgggcaatagagcaatagagggagactccgtctcaaaaaaaaaaaaaaaaaaaaaagaaaggttcttccagccctggttcactcccattctcactctttctggcccactccgggctctttgcatagatgctttttcttttctttcttctt

SEQ ID NO: 172851 - DNA, 601 bp, Human; identical to SEQ ID NO: 33758

SEQ ID NO: 172852 - DNA, 601 bp, Human; identical to SEQ ID NO: 33759

SEQ ID NO: 172853 - DNA, 601 bp, Human; identical to SEQ ID NO: 33760

SEQ ID NO: 172854 - DNA, 601 bp, Human; identical to SEQ ID NO: 33761

SEQ ID NO: 172855 - DNA, 601 bp, Human; identical to SEQ ID NO: 33762

SEQ ID NO: 172856 - DNA, 601 bp, Human; identical to SEQ ID NO: 33763

SEQ ID NO: 172857 - DNA, 601 bp, Human; identical to SEQ ID NO: 33764

SEQ ID NO: 172858 - DNA, 601 bp, Human; identical to SEQ ID NO: 33765

SEQ ID NO: 172859 - DNA, 601 bp, Human; identical to SEQ ID NO: 33766

SEQ ID NO: 172860 - DNA, 601 bp, Human; identical to SEQ ID NO: 33767

SEQ ID NO: 172861 - DNA, 601 bp, Human; identical to SEQ ID NO: 33768

SEQ ID NO: 172862 - DNA, 601 bp, Human; identical to SEQ ID NO: 33769

SEQ ID NO: 172863 - DNA, 601 bp, Human
agaacccttccttatcctcccttacaagacaacagccgatcccaggcgccccacccctgcactgtggatctccttctgtggcactggccaccccctgccatgcacacatacttgcttatttgccacctgtatccccactggaacacacgctccatgaggacaaggtctgggtggcttcgttccccaaggcactcccaacacagagctggcattcaggaggtgcctggggaatacccgctgatggacaaacagctgtccatgctgttccctgggcggggtgagaacatgcccagcgtccagrtcactggtgagttcattaggctccacccttcagggagcagagtgggaggggaatccactcacctccagcagctgcgcggcactgggtcgggtttctgggttcttatccagggctatcttcaggaagtcacggaactctacagacctgggaggacaggcgtcagaggtaagcatggaggaggcaagagcagagagaagccccccacgtcacagactccactgtcccaatcatgcccctcaaaggacagaggaaactttcacaagctaaaacagtgacagggcctacacgacgcccttttca

SEQ ID NO: 172864 - DNA, 601 bp, Human
ccctccaatagttcaaaaagcttcaagggaaaccattatccacctgcccattctaaggcagtacagccagctaatgagatgctcagagtctcctgatcccgcatacagcagccagaaggcaggaagacccttgtaaatggatgtcgatgctgtgtctcccctaatgcacagataaagcccaggacctggctctggcttgcaaggccctgcaggaccctgtgtgcagaaaatagcacagcaagcttcagaaagggccgctaacaaggttggatcctcagctggtctctgcaaactaggagasggctcccaccattaactaataagagtggcccgctctgcctaaactgttctgcaaacaatatggcttaggtggaatacctcctttccttctagagtctggaactctggtctgtgccaggcagggggtgcttatgtgaccactacccactaaaaaccctaaggggcttccgtggtggacagcacagagaattaagctgtcctggtgactgtactgggagagggccctggaagcttgcacctggctcccaagaccttttcccacgcacctcctccttgggctgagttctctctgtgcttttgc

SEQ ID NO: 172865 - DNA, 601 bp, Human
gcatgggcccaggcaaagagtggctcacagctccctccaatagttcaaaaagcttcaagggaaaccattatccacctgcccattctaaggcagtacagccagctaatgagatgctcagagtctcctgatcccgcatacagcagccagaaggcaggaagacccttgtaaatggatgtcgatgctgtgtctcccctaatgcacagataaagcccaggacctggctctggcttgcaaggccctgcaggaccctgtgtgcagaaaatagcacagcaagcttcagaaagggccgctaacaaggttrgatcctcagctggtctctgcaaactaggagacggctcccaccattaactaataagagtggcccgctctgcctaaactgttctgcaaacaatatggcttaggtggaatacctcctttccttctagagtctggaactctggtctgtgccaggcagggggtgcttatgtgaccactacccactaaaaaccctaaggggcttccgtggtggacagcacagagaattaagctgtcctggtgactgtactgggagagggccctggaagcttgcacctggctcccaagaccttttcccacgcacctc

SEQ ID NO: 172866 - DNA, 601 bp, Human
ctcacccagcctccagccatgacgccctaactcgaggcatgggcccaggcaaagagtggctcacagctccctccaatagttcaaaaagcttcaagggaaaccattatccacctgcccattctaaggcagtacagccagctaatgagatgctcagagtctcctgatcccgcatacagcagccagaaggcaggaagacccttgtaaatggatgtcgatgctgtgtctcccctaatgcacagataaagcccaggacctggctctggcttgcaaggccctgcaggaccctgtgtgcagaaaatarcacagcaagcttcagaaagggccgctaacaaggttggatcctcagctggtctctgcaaactaggagacggctcccaccattaactaataagagtggcccgctctgcctaaactgttctgcaaacaatatggcttaggtggaatacctcctttccttctagagtctggaactctggtctgtgccaggcagggggtgcttatgtgaccactacccactaaaaaccctaaggggcttccgtggtggacagcacagagaattaagctgtcctggtgactgtactgggagagggccctggaagct

SEQ ID NO: 172867 - DNA, 601 bp, Human
ggcagatttgcaaatgaccgggcaagtgctgtgcacagccctcagaacactgctgtggacacaccgacctcacccagcctccagccatgacgccctaactcgaggcatgggcccaggcaaagagtggctcacagctccctccaatagttcaaaaagcttcaagggaaaccattatccacctgcccattctaaggcagtacagccagctaatgagatgctcagagtctcctgatcccgcatacagcagccagaaggcaggaagacccttgtaaatggatgtcgatgctgtgtctcccctaaygcacagataaagcccaggacctggctctggcttgcaaggccctgcaggaccctgtgtgcagaaaatagcacagcaagcttcagaaagggccgctaacaaggttggatcctcagctggtctctgcaaactaggagacggctcccaccattaactaataagagtggcccgctctgcctaaactgttctgcaaacaatatggcttaggtggaatacctcctttccttctagagtctggaactctggtctgtgccaggcagggggtgcttatgtgaccactacccactaaaaaccctaaggggc

SEQ ID NO: 172868 - DNA, 601 bp, Human
aaagactcaagtgcctggtgtggcgccttcctccccttcctgccactgcacctctaaggctgtcatgctgagggcaggaccggagccgacacggcagtgaaagggcagccctgttgcatcacccaggcccattcctccccctcttccatcagtggcagtgacatggggacactggtcggcagatttgcaaatgaccgggcaagtgctgtgcacagccctcagaacactgctgtggacacaccgacctcacccagcctccagccatgacgccctaactcgaggcatgggcccaggcaaagartggctcacagctccctccaatagttcaaaaagcttcaagggaaaccattatccacctgcccattctaaggcagtacagccagctaatgagatgctcagagtctcctgatcccgcatacagcagccagaaggcaggaagacccttgtaaatggatgtcgatgctgtgtctcccctaatgcacagataaagcccaggacctggctctggcttgcaaggccctgcaggaccctgtgtgcagaaaatagcacagcaagcttcagaaagggccgctaacaaggttggatcctcagctggtctctg

SEQ ID NO: 172869 - DNA, 601 bp, Human; identical to SEQ ID NO: 165010

SEQ ID NO: 172870 - DNA, 601 bp, Human; identical to SEQ ID NO: 165011

SEQ ID NO: 172871 - DNA, 601 bp, Human; identical to SEQ ID NO: 165012

SEQ ID NO: 172872 - DNA, 601 bp, Human; identical to SEQ ID NO: 165013

SEQ ID NO: 172873 - DNA, 601 bp, Human; identical to SEQ ID NO: 165014

SEQ ID NO: 172874 - DNA, 601 bp, Human; identical to SEQ ID NO: 165015

SEQ ID NO: 172875 - DNA, 601 bp, Human; identical to SEQ ID NO: 165016

SEQ ID NO: 172876 - DNA, 601 bp, Human; identical to SEQ ID NO: 165017

SEQ ID NO: 172877 - DNA, 601 bp, Human; identical to SEQ ID NO: 165018

SEQ ID NO: 172878 - DNA, 601 bp, Human
accagggtaaaagaaaaggagatgggtggaagatgagcccaagacaatttaacattatctacctaaataaacagatgaaatactatcatcttaaaaatgtccaagtcttataagaattcctcctgaaaaactgcaggaaacttaagtggtacattttacactgaacttatagtatgttcttgatacgtaacaagtagcttatcagattccttctaaaatactaagatgtatgaaatactatgatgcattcctctgaaatgcaaattatcactcaaagaaatgagtagcaggattttaaagmccccacccactggatgaagaaattgagacactagaagttaaacaacttggccaaagacaatggtagttaactgcagagtttgcagccgtgatgactaactggcattcacatggcttaactgggtaattcagagaaaagttaccagctacattgctaagttttcttatgtgatatagtaaggtgactaggtaactatccgtatatggaaactggaaggctcaagtattttagggtgatctaagtaagagagagactgcacacaatcctacgttggttcagatcaatagctcaatatgtatg

SEQ ID NO: 172879 - DNA, 601 bp, Human
tggaaagctgaggtatacatttacaacaaaaactaataaaacttctcttaaaaaccagttgaggccaggcacagcgtttcatgcctataataacagcagttcaggaggtcgaggtaggcagatcacttgaggtcaggaattcgagaccagcctggccaacatggcaaaaccccatctctactaaaaaaataaaaaggtagccaggtgtggtggcactcgtctgtaatcccagctacttgggaggctgaggcataagaattgcttgaacctgggaggcggaggttgcagtgagctgagatcrcaccactatacacacccaagcctgggcaacagagcgagactccatctcaaacaaaacaaaacaaacaaacaaacgagtcaaaacttctttttggaaggatccacattaagaagcacattcttaggtgatattttgttatatacattttatatctataatcaaactgtgttaagtaaatcacatgcatctgaaaagattcgtgaagctactcaatatcattcatgaatatctataccagtttcaaatacaagaaatggtgattattaacgcagaaagttagctaccagggtaaaagaaaag

SEQ ID NO: 172880 - DNA, 601 bp, Human
ttcatgtagattaaaaatgctgttaatcttcaattttctgccagttcagacatttttcaaacacaattttcaacacaagaactggaaagctgaggtatacatttacaacaaaaactaataaaacttctcttaaaaaccagttgaggccaggcacagcgtttcatgcctataataacagcagttcaggaggtcgaggtaggcagatcacttgaggtcaggaattcgagaccagcctggccaacatggcaaaaccccatctctactaaaaaaataaaaaggtagccaggtgtggtggcactcrtctgtaatcccagctacttgggaggctgaggcataagaattgcttgaacctgggaggcggaggttgcagtgagctgagatcgcaccactatacacacccaagcctgggcaacagagcgagactccatctcaaacaaaacaaaacaaacaaacaaacgagtcaaaacttctttttggaaggatccacattaagaagcacattcttaggtgatattttgttatatacattttatatctataatcaaactgtgttaagtaaatcacatgcatctgaaaagattcgtgaagctactcaatatca

SEQ ID NO: 172881 - DNA, 601 bp, Human
cagagtagctcaaaaaggcaattccgctaatacaaagatctttctagatactgtcatttacttaaaatgctctcaattagtatgtgaaatattaatttataataactattgattgtatgaattcaacttttaaaaattatttaatggaaaaaatgttggtaaaacagtaactttaatgggatcacattctgaagaaaagaaaatctcatcctataagtcattttgatctgatctacttgcctaatgtatacttaacgctgtattgaaaatgcttctggggaaaagagaagtgtatttgcasaagaatttaatagccacagaagcaataaagatttttaaagattaaaaagttccatggccactaaaatttcagtaagaagtttcatgtagattaaaaatgctgttaatcttcaattttctgccagttcagacatttttcaaacacaattttcaacacaagaactggaaagctgaggtatacatttacaacaaaaactaataaaacttctcttaaaaaccagttgaggccaggcacagcgtttcatgcctataataacagcagttcaggaggtcgaggtaggcagatcacttgaggtcagga

SEQ ID NO: 172882 - DNA, 601 bp, Human
taatataacttggttttttaaaaattcattagtagattaatttcttattctggcaacagactcatagttctctctttcccaaattgggtatttgacctagtactgaaacgactttcataaatactgccaataaggctttcatgtaagacaaatattctcagagtagctcaaaaaggcaattccgctaatacaaagatctttctagatactgtcatttacttaaaatgctctcaattagtatgtgaaatattaatttataataactattgattgtatgaattcaacttttaaaaattatttaatggaaaaaatgttggtaaaacagtaactttaatgggatcacattctgaagaaaagaaaatctcatcctataagtcattttgatctgatctacttgcctaatgtatacttaacgctgtattgaaaatgcttctggggaaaagagaagtgtatttgcagaagaatttaatagccacagaagcaataaagatttttaaagattaaaaagttccatggccactaaaatttcagtaagaagtttcatgtagattaaaaatgctgttaatcttcaattttctgccagttcagacatttttcaaac

SEQ ID NO: 172883 - DNA, 601 bp, Human
attatgccgtgggtttaatataacttggttttttaaaaattcattagtagattaatttcttattctggcaacagactcatagttctctctttcccaaattgggtatttgacctagtactgaaacgactttcataaatactgccaataaggctttcatgtaagacaaatattctcagagtagctcaaaaaggcaattccgctaatacaaagatctttctagatactgtcatttacttaaaatgctctcaattagtatgtgaaatattaatttataataactattgattgtatgaattcaacytttaaaaattatttaatggaaaaaatgttggtaaaacagtaactttaatgggatcacattctgaagaaaagaaaatctcatcctataagtcattttgatctgatctacttgcctaatgtatacttaacgctgtattgaaaatgcttctggggaaaagagaagtgtatttgcagaagaatttaatagccacagaagcaataaagatttttaaagattaaaaagttccatggccactaaaatttcagtaagaagtttcatgtagattaaaaatgctgttaatcttcaattttctgccagttc

SEQ ID NO: 172884 - DNA, 601 bp, Human
aatagatggtgttaagaatccccagttagcacctcccctacaatttcccaaattaccacccagcccataaactattaggtgacatgtaccataaagtattatgccgtgggtttaatataacttggttttttaaaaattcattagtagattaatttcttattctggcaacagactcatagttctctctttcccaaattgggtatttgacctagtactgaaacgactttcataaatactgccaataaggctttcatgtaagacaaatattctcagagtagctcaaaaaggcaattccgctaayacaaagatctttctagatactgtcatttacttaaaatgctctcaattagtatgtgaaatattaatttataataactattgattgtatgaattcaacttttaaaaattatttaatggaaaaaatgttggtaaaacagtaactttaatgggatcacattctgaagaaaagaaaatctcatcctataagtcattttgatctgatctacttgcctaatgtatacttaacgctgtattgaaaatgcttctggggaaaagagaagtgtatttgcagaagaatttaatagccacagaagcaataaag

SEQ ID NO: 172885 - DNA, 601 bp, Human
agagagctgaggctgccagatgtgacctgtgaatagatggtgttaagaatccccagttagcacctcccctacaatttcccaaattaccacccagcccataaactattaggtgacatgtaccataaagtattatgccgtgggtttaatataacttggttttttaaaaattcattagtagattaatttcttattctggcaacagactcatagttctctctttcccaaattgggtatttgacctagtactgaaacgactttcataaatactgccaataaggctttcatgtaagacaaatattcycagagtagctcaaaaaggcaattccgctaatacaaagatctttctagatactgtcatttacttaaaatgctctcaattagtatgtgaaatattaatttataataactattgattgtatgaattcaacttttaaaaattatttaatggaaaaaatgttggtaaaacagtaactttaatgggatcacattctgaagaaaagaaaatctcatcctataagtcattttgatctgatctacttgcctaatgtatacttaacgctgtattgaaaatgcttctggggaaaagagaagtgtatttgca

SEQ ID NO: 172886 - DNA, 601 bp, Human
agaagaacaaaacaagaaacaaaaaagcaagtggctaaatatgcttggatcttttcagtctatattgctgaaaaacaaacaattatcttaaaaactctaattacgaagccagtttaagttctgttgtagcctcttgggtctgtatcatccctagggaaaaatcacaggcttgaggtactaacttcatgcttaacttgaactcagagaaatcagcaaaagtcacataacctttaaaatgctgatggtcctgaggacattctctacttcattcaactgaaaaccaagtttaagcatatctgaygggcatttataccacatcaatatttatttaatgaactttatgcaaaggcacattgatgagtttaaatcactatagtccttatacattgaaacagaacaccagtagtgaaatgacatttattaattccattaagacacaactacatattttattcttataatggccatgttaataagttcaaggcatacgtcaaggttaggatcaaaatttggccagggcttcttaagatagaccttaaaacattgcacgttgatgttcttttgaacaagtttgtctccaggaccagtaaatatgacactt

SEQ ID NO: 172887 - DNA, 601 bp, Human; identical to SEQ ID NO: 165010

SEQ ID NO: 172888 - DNA, 601 bp, Human; identical to SEQ ID NO: 165011

SEQ ID NO: 172889 - DNA, 601 bp, Human; identical to SEQ ID NO: 165012

SEQ ID NO: 172890 - DNA, 601 bp, Human; identical to SEQ ID NO: 165013

SEQ ID NO: 172891 - DNA, 601 bp, Human; identical to SEQ ID NO: 165014

SEQ ID NO: 172892 - DNA, 601 bp, Human; identical to SEQ ID NO: 165015

SEQ ID NO: 172893 - DNA, 601 bp, Human; identical to SEQ ID NO: 165016

SEQ ID NO: 172894 - DNA, 601 bp, Human; identical to SEQ ID NO: 165017

SEQ ID NO: 172895 - DNA, 601 bp, Human; identical to SEQ ID NO: 165018

SEQ ID NO: 172896 - DNA, 601 bp, Human; identical to SEQ ID NO: 172878

SEQ ID NO: 172897 - DNA, 601 bp, Human; identical to SEQ ID NO: 172879

SEQ ID NO: 172898 - DNA, 601 bp, Human; identical to SEQ ID NO: 172880

SEQ ID NO: 172899 - DNA, 601 bp, Human; identical to SEQ ID NO: 172881

SEQ ID NO: 172900 - DNA, 601 bp, Human; identical to SEQ ID NO: 172882

SEQ ID NO: 172901 - DNA, 601 bp, Human; identical to SEQ ID NO: 172883

SEQ ID NO: 172902 - DNA, 601 bp, Human; identical to SEQ ID NO: 172884

SEQ ID NO: 172903 - DNA, 601 bp, Human; identical to SEQ ID NO: 172885

SEQ ID NO: 172904 - DNA, 601 bp, Human; identical to SEQ ID NO: 172886

SEQ ID NO: 172905 - DNA, 601 bp, Human
agacataactgaacatcgtgttttcagtttactatttcccttaggagattatttttcctcaagtggaaatctgatagggcaaaaaggataaagacataaggacatcttatttacatgaataccacacgtagtcctggacacgaattaaggctgaaaagtcaaaatgtgtttctttctcgagaaacacaaggcacaaaaaatgacaaacctacaaaatacaggcattctacttcaagctgggttaaacagtgaggggtagggacagagaggaagacaaaactattcacgattttttgttttaaaaaggatattctctgaattgatgaatctgtgctttgatgtgatcttcgcagatctgtctcagctgtttgtacaagtttgcagaaatcttgtaagaacagagattttctacagcctgcaaggttaaaatactttcttaaggagaggatgaaggatttctcaactatttacatcagattcttattaatttgatatttctaccacatcagcttattaaaaagggttattcatccacttaagacacaaggtaaaacaacaaaatatatcaatgtgggtggcaaactttctcataaccaatgca

SEQ ID NO: 172906 - DNA, 601 bp, Human
ggtacaagtcatatgtgccatgtgacagagagcatattagtcttaaacatgaataccttgcacactaagtgaaactaaatggcacttgattatgcaccaaagtgctatttcctaatttgtaaaagaaaaaaaaaacatagtttatactaaaaaacacctttaaaaacaagtcttagacataactgaacatcgtgttttcagtttactatttcccttaggagattatttttcctcaagtggaaatctgatagggcaaaaaggataaagacataaggacatcttatttacatgaataccacaygtagtcctggacacgaattaaggctgaaaagtcaaaatgtgtttctttctcgagaaacacaaggcacaaaaaatgacaaacctacaaaatacaggcattctacttcaagctgggttaaacagtgaggggtagggacagagaggaagacaaaactattcacgattttttgttttaaaaaggatattctctgaattgatgaatctgtgctttgatgtgatcttcgcagatctgtctcagctgtttgtacaagtttgcagaaatcttgtaagaacagagattttctacagcctgcaaggttaa

SEQ ID NO: 172907 - DNA, 601 bp, Human
atgtaaccaaatgtcacctgtaccccaataacttacgggaaaataaaaaataaataaatttttaaaaaaagaaaaaaaaagaaaaggaatagatattgaagcaatctccctattgctaagttttaaaaactaacattcctgtatttgaagaaatgtttttaactattaatacaatgtttagccgaaatacaatactttttccagcttaccatttgtctgcaatggttttgccagcatctatcaatcttctttaaaaaaagaacgctatccaatgaatccctgaaacatatgttaaggataytttaaagcgtttggtacaagtcatatgtgccatgtgacagagagcatattagtcttaaacatgaataccttgcacactaagtgaaactaaatggcacttgattatgcaccaaagtgctatttcctaatttgtaaaagaaaaaaaaaacatagtttatactaaaaaacacctttaaaaacaagtcttagacataactgaacatcgtgttttcagtttactatttcccttaggagattatttttcctcaagtggaaatctgatagggcaaaaaggataaagacataaggacatcttatttac

SEQ ID NO: 172908 - DNA, 601 bp, Human
cacacccctaataatcgaatccttggatgaaaactaattaactagggaaaagaataacttgaagtttgtattatgaaaacaactgttaacacttcaaatcacacctgaaaacagttactaacatgtttaggatggctaaagtgctgcaagtgatttaacgacagtttaagactattaaattcagcatgtggtacttactgggtggtctgatctaagtaagtaataagtctgtctgcttcttcttctagacgtttgttaacatgatgtagatattcaggaacctacaaagatagttttttayattattgttttcctccccataaatcattcagaaaatgtcaagtccaaaagatcctggaagtggccctgtcaaatgtgacagggtagaatcatatgtaaaaatttataggtagagtttatgatccagaattctggcctttaagaagagagaaaagaaaggagcacctaagtgagagaagagcatcacaatgttgggaagataaatgcaaagggaagcttatattctacaaagtaaggtctattgtgagagacagtgagaatttattagtcatgatttttaaatacctctctttcttgcatt

SEQ ID NO: 172909 - DNA, 601 bp, Human
cagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagccyagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcct

SEQ ID NO: 172910 - DNA, 601 bp, Human
gttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgcccyggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctct

SEQ ID NO: 172911 - DNA, 601 bp, Human
ctaggtttgggggagagttgctgcaggctgagtgtggctgcgcgagggtggggcaggagccggtgctctgggactacgctgtttggcccagcacaggcagatgtcatggagcctcagcaaggttggaacatttggccttcaggcatctactggctattttagaccatgttatctgcaatctttggggctcccggcagtttctttctgaagaagcaagctaatatgggcatccttgcatcacctctaatccaagaaatgattacaaggagaaaaggtaatttccttttaagaaaagccacastatacaaagtatatgccatatagcacaggaagatttgtgctgcttatgagcatagggagaacgctgctactactaagacttgacttagcatctgaagagtgggattcagagacattcagaaaccagcagcctttctctgccaagtttctgttggaaccaactcccagagatgtcctggcatattggttatgcgtcaaatttcaaaatgctgattaagatttcctatgtcccttttatagcggttcattgcctactacaagggaattgagcatgaagatagtggtttggggttctctaatc

SEQ ID NO: 172912 - DNA, 601 bp, Human
ggggtatacgacttgctcagtgctgctcacttggcactagcaagagaaaggaaggccttaggttggcaaagcaagtccagcagatcactgagtggtggggaagtcttccccgaaattcacggtgagaggagcatgggactgcccaatgtggagtagcctccttgatgctgggtgttgaccctggccatcagacctacccagggaaggtttagttcccccatctgtctcttggggcttcaccatccgtcttttgtgttgcggactcctgtcttagcaaatacttttttttttttttttttttgagacggagtctctctctgtcacccaggctggagcgcagtggcgtgatctcggttcactgcaagctccacctcctgggttcacgccattctcctgcctcagcctcccgagtagctgggactacaggcgcccaccaccacgcccggctaattttttgtatttttagtagagacggggtttcaccgcattagccaggatggtctcgatctcctgacctcgtgttccgcccgcctcggcctcccaaagtgctgggattacaggcgtgagccaccacgctcagccagcaaatagttcttattta

SEQ ID NO: 172913 - DNA, 601 bp, Human
ccccgaaattcacggtgagaggagcatgggactgcccaatgtggagtagcctccttgatgctgggtgttgaccctggccatcagacctacccagggaaggtttagttcccccatctgtctcttggggcttcaccatccgtcttttgtgttgcggactcctgtcttagcaaatacttttttttttttttttttttgagacggagtctctctctgtcacccaggctggagcgcagtggcgtgatctcggttcactgcaagctccacctcctgggttcacgccattctcctgcctcagcctccygagtagctgggactacaggcgcccaccaccacgcccggctaattttttgtatttttagtagagacggggtttcaccgcattagccaggatggtctcgatctcctgacctcgtgttccgcccgcctcggcctcccaaagtgctgggattacaggcgtgagccaccacgctcagccagcaaatagttcttatttaaaacaataaattttttttcaatgactatctcagtcaccaaaattatccttcaacttcaggacattttcagtaatggctatcatcatcctaggtggtatacagacagg

SEQ ID NO: 172914 - DNA, 601 bp, Human
gatgctgggtgttgaccctggccatcagacctacccagggaaggtttagttcccccatctgtctcttggggcttcaccatccgtcttttgtgttgcggactcctgtcttagcaaatacttttttttttttttttttttgagacggagtctctctctgtcacccaggctggagcgcagtggcgtgatctcggttcactgcaagctccacctcctgggttcacgccattctcctgcctcagcctcccgagtagctgggactacaggcgcccaccaccacgcccggctaattttttgtattttyagtagagacggggtttcaccgcattagccaggatggtctcgatctcctgacctcgtgttccgcccgcctcggcctcccaaagtgctgggattacaggcgtgagccaccacgctcagccagcaaatagttcttatttaaaacaataaattttttttcaatgactatctcagtcaccaaaattatccttcaacttcaggacattttcagtaatggctatcatcatcctaggtggtatacagacaggaatttgtattcttacaaacaattcttatctactaaaaactaatcatataattataa

SEQ ID NO: 172915 - DNA, 601 bp, Human
ctctctctgtcacccaggctggagcgcagtggcgtgatctcggttcactgcaagctccacctcctgggttcacgccattctcctgcctcagcctcccgagtagctgggactacaggcgcccaccaccacgcccggctaattttttgtatttttagtagagacggggtttcaccgcattagccaggatggtctcgatctcctgacctcgtgttccgcccgcctcggcctcccaaagtgctgggattacaggcgtgagccaccacgctcagccagcaaatagttcttatttaaaacaataaaatttttttcaatgactatctcagtcaccaaaattatccttcaacttcaggacattttcagtaatggctatcatcatcctaggtggtatacagacaggaatttgtattcttacaaacaattcttatctactaaaaactaatcatataattataatacttatatatgagattaataataatattttcatatacaggtgctccttgacttatgatggggttacatctggataaacccattgttaagttgaagctactgtaagttgaagatgaattttcatacataacccatcttaagtcaagga

SEQ ID NO: 172916 - DNA, 601 bp, Human
cacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtaaaaaaaaaaaacaaaaaaaamcagaaaaatgagtgtggtcaaggctctccctttggggacactgaaggaatgagcgcaaggtctttgagttccatctgggttccactccaagtcagagaccaggcgcaatgaattcaagcccagtggaaaatctcccatagaattcaaccacccagcttctctccagatggcatcccatcatccgcagcatctctcaacctttatctcctatctcctgcctcatctccttcctaagtaaagaacaccttccaactcaacataaggcagctacaggtacgttttgtgaaagggactcttcat

SEQ ID NO: 172917 - DNA, 601 bp, Human; identical to SEQ ID NO: 172909

SEQ ID NO: 172918 - DNA, 601 bp, Human; identical to SEQ ID NO: 172910

SEQ ID NO: 172919 - DNA, 601 bp, Human; identical to SEQ ID NO: 172911

SEQ ID NO: 172920 - DNA, 601 bp, Human; identical to SEQ ID NO: 172912

SEQ ID NO: 172921 - DNA, 601 bp, Human; identical to SEQ ID NO: 172913

SEQ ID NO: 172922 - DNA, 601 bp, Human; identical to SEQ ID NO: 172914

SEQ ID NO: 172923 - DNA, 601 bp, Human; identical to SEQ ID NO: 172915

SEQ ID NO: 172924 - DNA, 601 bp, Human; identical to SEQ ID NO: 172916

SEQ ID NO: 172925 - DNA, 601 bp, Human
agccctgcgcgcctgtgcaccgtgcgcctgtgattggacatctctgggtctctggacagctgccggggtcacgcgccgccggtgaaacgacgtctccacaaagagaggagcagaggcccccagggatcccggagggcagggcaacgcggcaattgccccgaccccagggcggccgcgcgtgtcctcgggggacgcagcctcttccccgctccccggctccgggaagagacgcgacccaggcggggacccggcgctgagcgaggaggcgctggggctgcgaagcgtgcgaccccgaggcctscacccggaccggggccaccactcaggcggcggcgccggcgccggatccagcccgagccccgcgcagcccaaaggatacgacagccccggccgaggggcggccgaggtggcccagaacaatctgcagacgggcggcggcgcgaagctgctccatggctgcggcgcggggaacccccacccctcccggcctctgccccatttagcccagcgggcggctccgcctccaggcgccgccccggactggacgtaagcgggattccgggcggtgccagctcgcgggccgggctgctggggagcccta

SEQ ID NO: 172926 - DNA, 601 bp, Human
atgttatcctttctttctctctgtttctctcttttggaacgcactggccatcacggctcactgtaaccctggactcctggccttggcccccagaagagccgagacaacaggcaaggcgtgtgccgccgcgccagtcctcacccgctgtccttccccaaatagtgtctttatataactcagtggcaatgccgtagtccagcagggaggccgccctgggcagcgcctgcctggccagctcctgcccgggagggcaccgtcctctcccctccggagaggtcccggtcactgcctgcctgggccsgttccaggcagccctgcgcgcctgtgcaccgtgcgcctgtgattggacatctctgggtctctggacagctgccggggtcacgcgccgccggtgaaacgacgtctccacaaagagaggagcagaggcccccagggatcccggagggcagggcaacgcggcaattgccccgaccccagggcggccgcgcgtgtcctcgggggacgcagcctcttccccgctccccggctccgggaagagacgcgacccaggcggggacccggcgctgagcgaggaggcgctggggctgcgaagcgtgcgacc

SEQ ID NO: 172927 - DNA, 601 bp, Human
atcgtaccactactgcactccagcctgggtgacagagtgaggccctgtttcaaaaaaaaaaaaaaaaccaaaaaagcaaaaccctagaaattccttttaaagatctcttttctatccggtaactgcagagagttgacatagaattgcattgtttctttagcttaatcggttactttcggaatgtcactctcatcaattaacatgttatcctttctttctctctgtttctctcttttggaacgcactggccatcacggctcactgtaaccctggactcctggccttggcccccagaagagcygagacaacaggcaaggcgtgtgccgccgcgccagtcctcacccgctgtccttccccaaatagtgtctttatataactcagtggcaatgccgtagtccagcagggaggccgccctgggcagcgcctgcctggccagctcctgcccgggagggcaccgtcctctcccctccggagaggtcccggtcactgcctgcctgggccggttccaggcagccctgcgcgcctgtgcaccgtgcgcctgtgattggacatctctgggtctctggacagctgccggggtcacgcgccgccggtgaaacga

SEQ ID NO: 172928 - DNA, 601 bp, Human
gggaatggcttgaatctgggaggcggaggttgcagtgggccgacattgcggcactgcactccagcctggccacagagcaagactccgtctcaaaataataataataataataataataataataccacataacaacaacaacataaattcgcctggcatcgtggcgcaaccctgtagtcccaactacttaggaggctgaggtgggaggatctcttgagcccaggagtgagccgagatcgtaccactactgcactccagcctgggtgacagagtgaggccctgtttcaaaaaaaaaaaaaaaaccaaaaaagcaaaaccctagaaattccttttaaagatctcttttctatccggtaactgcagagagttgacatagaattgcattgtttctttagcttaatcggttactttcggaatgtcactctcatcaattaacatgttatcctttctttctctctgtttctctcttttggaacgcactggccatcacggctcactgtaaccctggactcctggccttggcccccagaagagccgagacaacaggcaaggcgtgtgccgccgcgccagtcctcacccgctgtccttccccaaatagtgt

SEQ ID NO: 172929 - DNA, 601 bp, Human
tttgtataataaaattctaatcaggtaacatattatgtggtatatcttcattaccactcaagaaacttttatatacataatatatttcaaaatcaaaactcaaactacttactggaattgttgaggatggaaactggcagaggaaatagtccctgaagtgggatgagctacctaggatgtgaattaaggcaaataaagtaaaatatagaaggccaggcacggtggctcatgcctgtaattccagcactttgggaggctgaggcaggaggattacttgagctcaggagttcgagaccagcckggccaacatggtgaaaccccatctctactaaaaatacaaattaggccgggggcggtggctcacgtttgtaatcctagcactttgggaggccgaggcggatggatcacctgaggtcgggatttcgagaccagcctgaccaatatggtgaaaccccatctctactaaaaatacaaaaattagccaggcgtggtggcgttcatttgtaatcccagctactggagaggctaagacaggagaattgcttgaacctgggaggtggagattgcagtgagctgagatcaggccactgcattccagcct

SEQ ID NO: 172930 - DNA, 601 bp, Human
agtgcactaattagaataagtcctggaaacagaggatttgtataataaaattctaatcaggtaacatattatgtggtatatcttcattaccactcaagaaacttttatatacataatatatttcaaaatcaaaactcaaactacttactggaattgttgaggatggaaactggcagaggaaatagtccctgaagtgggatgagctacctaggatgtgaattaaggcaaataaagtaaaatatagaaggccaggcacggtggctcatgcctgtaattccagcactttgggaggctgaggcargaggattacttgagctcaggagttcgagaccagcctggccaacatggtgaaaccccatctctactaaaaatacaaattaggccgggggcggtggctcacgtttgtaatcctagcactttgggaggccgaggcggatggatcacctgaggtcgggatttcgagaccagcctgaccaatatggtgaaaccccatctctactaaaaatacaaaaattagccaggcgtggtggcgttcatttgtaatcccagctactggagaggctaagacaggagaattgcttgaacctgggaggtggagatt

SEQ ID NO: 172931 - DNA, 601 bp, Human
cttaaaatacatacagaaaattagtcggtctccaaaattttccacaagtgcactaattagaataagtcctggaaacagaggatttgtataataaaattctaatcaggtaacatattatgtggtatatcttcattaccactcaagaaacttttatatacataatatatttcaaaatcaaaactcaaactacttactggaattgttgaggatggaaactggcagaggaaatagtccctgaagtgggatgagctacctaggatgtgaattaaggcaaataaagtaaaatatagaaggccaggcrcggtggctcatgcctgtaattccagcactttgggaggctgaggcaggaggattacttgagctcaggagttcgagaccagcctggccaacatggtgaaaccccatctctactaaaaatacaaattaggccgggggcggtggctcacgtttgtaatcctagcactttgggaggccgaggcggatggatcacctgaggtcgggatttcgagaccagcctgaccaatatggtgaaaccccatctctactaaaaatacaaaaattagccaggcgtggtggcgttcatttgtaatcccagctactg

SEQ ID NO: 172932 - DNA, 601 bp, Human
gcaaggctccgtctcagaaaaaaaaaaaaaaaaaaaagtgcattagtggaagaaaaattaactagtgacactatgttcactcagtggaatatgactcagacattaaaaattaaggccatataatagtatggatggcgggcacagtggctcatgcctgtaatcctagctttgggaggctgaggcgggcggatcacgaggtcagatcgggaccatcctggctaacacggtgaaacccgcctctactaaaaatgcaaaaaattagcccggcatggtgtctggcgcctgtagtccagctactggrgaggctgaggcaggagaatggcgtgaacccgggaggcggagcttgcagtgaagcaagatggcaccactgcactccagcctgggcgacagagccagactcggtctcaaaataaaataaaatataataaaatataataaaataaaaaatagtatggacaatgcttattataataaaatattattacaattatgtaaaaccaagacactatatgaaaaaaagaaaagcctgcaaagaaatacaccaaagcaatttttaacagtgattgcctttagaaatggaattagggatgattttttaaaa

SEQ ID NO: 172933 - DNA, 601 bp, Human
caagaggatgaggcaggagaatcgctagaacctgtgggggtggagattgcagtgagccaggattgcaccagtgcactccagcctgggtgacagagcaaggctccgtctcagaaaaaaaaaaaaaaaaaaaagtgcattagtggaagaaaaattaactagtgacactatgttcactcagtggaatatgactcagacattaaaaattaaggccatataatagtatggatggcgggcacagtggctcatgcctgtaatcctagctttgggaggctgaggcgggcggatcacgaggtcagatcgrgaccatcctggctaacacggtgaaacccgcctctactaaaaatgcaaaaaattagcccggcatggtgtctggcgcctgtagtccagctactggggaggctgaggcaggagaatggcgtgaacccgggaggcggagcttgcagtgaagcaagatggcaccactgcactccagcctgggcgacagagccagactcggtctcaaaataaaataaaatataataaaatataataaaataaaaaatagtatggacaatgcttattataataaaatattattacaattatgtaaaaccaagacact

SEQ ID NO: 172934 - DNA, 601 bp, Human
ctcaagaggatgaggcaggagaatcgctagaacctgtgggggtggagattgcagtgagccaggattgcaccagtgcactccagcctgggtgacagagcaaggctccgtctcagaaaaaaaaaaaaaaaaaaaagtgcattagtggaagaaaaattaactagtgacactatgttcactcagtggaatatgactcagacattaaaaattaaggccatataatagtatggatggcgggcacagtggctcatgcctgtaatcctagctttgggaggctgaggcgggcggatcacgaggtcagatygggaccatcctggctaacacggtgaaacccgcctctactaaaaatgcaaaaaattagcccggcatggtgtctggcgcctgtagtccagctactggggaggctgaggcaggagaatggcgtgaacccgggaggcggagcttgcagtgaagcaagatggcaccactgcactccagcctgggcgacagagccagactcggtctcaaaataaaataaaatataataaaatataataaaataaaaaatagtatggacaatgcttattataataaaatattattacaattatgtaaaaccaagaca

SEQ ID NO: 172935 - DNA, 601 bp, Human
gctactcaagaggatgaggcaggagaatcgctagaacctgtgggggtggagattgcagtgagccaggattgcaccagtgcactccagcctgggtgacagagcaaggctccgtctcagaaaaaaaaaaaaaaaaaaaagtgcattagtggaagaaaaattaactagtgacactatgttcactcagtggaatatgactcagacattaaaaattaaggccatataatagtatggatggcgggcacagtggctcatgcctgtaatcctagctttgggaggctgaggcgggcggatcacgaggtcggatcgggaccatcctggctaacacggtgaaacccgcctctactaaaaatgcaaaaaattagcccggcatggtgtctggcgcctgtagtccagctactggggaggctgaggcaggagaatggcgtgaacccgggaggcggagcttgcagtgaagcaagatggcaccactgcactccagcctgggcgacagagccagactcggtctcaaaataaaataaaatataataaaatataataaaataaaaaatagtatggacaatgcttattataataaaatattattacaattatgtaaaaccaa

SEQ ID NO: 172936 - DNA, 601 bp, Human
agcgtgcctgtaatcccagctactcaagaggatgaggcaggagaatcgctagaacctgtgggggtggagattgcagtgagccaggattgcaccagtgcactccagcctgggtgacagagcaaggctccgtctcagaaaaaaaaaaaaaaaaaaaagtgcattagtggaagaaaaattaactagtgacactatgttcactcagtggaatatgactcagacattaaaaattaaggccatataatagtatggatggcgggcacagtggctcatgcctgtaatcctagctttgggaggctgaggygggcggatcacgaggtcagatcgggaccatcctggctaacacggtgaaacccgcctctactaaaaatgcaaaaaattagcccggcatggtgtctggcgcctgtagtccagctactggggaggctgaggcaggagaatggcgtgaacccgggaggcggagcttgcagtgaagcaagatggcaccactgcactccagcctgggcgacagagccagactcggtctcaaaataaaataaaatataataaaatataataaaataaaaaatagtatggacaatgcttattataataaaatattatt

SEQ ID NO: 172937 - DNA, 601 bp, Human
tctactaaaaatacaaaaattagcgtgcctgtaatcccagctactcaagaggatgaggcaggagaatcgctagaacctgtgggggtggagattgcagtgagccaggattgcaccagtgcactccagcctgggtgacagagcaaggctccgtctcagaaaaaaaaaaaaaaaaaaaagtgcattagtggaagaaaaattaactagtgacactatgttcactcagtggaatatgactcagacattaaaaattaaggccatataatagtatggatggcgggcacagtggctcatgcctgtaatsctagctttgggaggctgaggcgggcggatcacgaggtcagatcgggaccatcctggctaacacggtgaaacccgcctctactaaaaatgcaaaaaattagcccggcatggtgtctggcgcctgtagtccagctactggggaggctgaggcaggagaatggcgtgaacccgggaggcggagcttgcagtgaagcaagatggcaccactgcactccagcctgggcgacagagccagactcggtctcaaaataaaataaaatataataaaatataataaaataaaaaatagtatggacaatgc

SEQ ID NO: 172938 - DNA, 601 bp, Human
aatgttaactatggtcaccaaaacaagtgcattagtgggccggacacagtggctcatgcctgtaatcccagctttttgggaggctgaggcaggtggatcacctgaggtcgggagttcgagaccagcctgactcacatgatgaaaccccatctctactaaaaatacaaaaattagcgtgcctgtaatcccagctactcaagaggatgaggcaggagaatcgctagaacctgtgggggtggagattgcagtgagccaggattgcaccagtgcactccagcctgggtgacagagcaaggctccrtctcagaaaaaaaaaaaaaaaaaaaagtgcattagtggaagaaaaattaactagtgacactatgttcactcagtggaatatgactcagacattaaaaattaaggccatataatagtatggatggcgggcacagtggctcatgcctgtaatcctagctttgggaggctgaggcgggcggatcacgaggtcagatcgggaccatcctggctaacacggtgaaacccgcctctactaaaaatgcaaaaaattagcccggcatggtgtctggcgcctgtagtccagctactggggaggctgagg

SEQ ID NO: 172939 - DNA, 601 bp, Human
tagccaggcatggtagtgggcacctgtaatcccagctacccgggaggttgaggcaggaaaatcgcttgaacttgggaggcggaggttgcagtgagctctgatcatggcactgcactccagcctgggcgacagagccagactccgtctcaaaaaacaaaaacaaagacaaaaacaagaacctaggaaacgttcatgctcttcaattcagcatttctaagaccaaggaaataatctgaaaacttacgctttatgttcaaaatgttaactatggtcaccaaaacaagtgcattagtgggccggrcacagtggctcatgcctgtaatcccagctttttgggaggctgaggcaggtggatcacctgaggtcgggagttcgagaccagcctgactcacatgatgaaaccccatctctactaaaaatacaaaaattagcgtgcctgtaatcccagctactcaagaggatgaggcaggagaatcgctagaacctgtgggggtggagattgcagtgagccaggattgcaccagtgcactccagcctgggtgacagagcaaggctccgtctcagaaaaaaaaaaaaaaaaaaaagtgcattagtggaagaa

SEQ ID NO: 172940 - DNA, 601 bp, Human
tcatgcctataatcccagcactttgggaggccgaggcaggtggatcgcctgaggtcaggagtctgagacgaacctgaccaacatggtgaaaccccatgtttactgaaaacacaaagtttagccaggcatggtagtgggcacctgtaatcccagctacccgggaggttgaggcaggaaaatcgcttgaacttgggaggcggaggttgcagtgagctctgatcatggcactgcactccagcctgggcgacagagccagactccgtctcaaaaaacaaaaacaaagacaaaaacaagaacctargaaacgttcatgctcttcaattcagcatttctaagaccaaggaaataatctgaaaacttacgctttatgttcaaaatgttaactatggtcaccaaaacaagtgcattagtgggccggacacagtggctcatgcctgtaatcccagctttttgggaggctgaggcaggtggatcacctgaggtcgggagttcgagaccagcctgactcacatgatgaaaccccatctctactaaaaatacaaaaattagcgtgcctgtaatcccagctactcaagaggatgaggcaggagaatcgctagaa

SEQ ID NO: 172941 - DNA, 601 bp, Human
ctctacaaaaaatactggttgtgccactccactccagcatgggcgacagagtgagaccctgtctcaaaaaaaaaaaaaaaatttaaattacatcctaaaaatatgtatcaagaacctgaggctaggcgtgggggctcatgcctataatcccagcactttgggaggccgaggcaggtggatcgcctgaggtcaggagtctgagacgaacctgaccaacatggtgaaaccccatgtttactgaaaacacaaagtttagccaggcatggtagtgggcacctgtaatcccagctacccgggaggytgaggcaggaaaatcgcttgaacttgggaggcggaggttgcagtgagctctgatcatggcactgcactccagcctgggcgacagagccagactccgtctcaaaaaacaaaaacaaagacaaaaacaagaacctaggaaacgttcatgctcttcaattcagcatttctaagaccaaggaaataatctgaaaacttacgctttatgttcaaaatgttaactatggtcaccaaaacaagtgcattagtgggccggacacagtggctcatgcctgtaatcccagctttttgggaggctgaggca

SEQ ID NO: 172942 - DNA, 601 bp, Human
ctccaagcacctgccctgccctcctctgtggaaagggttgcagacttgaggggtggtttctctgcactaagttggcctccagcttgaggtagaataattccaatgaaagggaggagaaactgtctggctagaatccattcccagaattaaattattccctagtttagcataccagtagggaagtctttttataatttggttacattgtaataataataacagcaaacatttctgtaacacttaccatgtgcccagctctcttcaaagtggtttccatatatttcaccgtatttagtcctartaacaacactaggacataagtgctattattatccccattttacagatgaggaaacagaggcatgggatgtgaagtaaattgccccaggacacatgatattaagtggtggagctgagactgaagcccaggcatggtggctcccgactgtaatcccagcaactcaggagggtgaggccaggagttcaagaccagcctgggcaacatagtgagactccctgtctctaaaaacaaagaaataaaaaattagctgggtatggtggtgcacaactgtggtcccagctactcaggaggctgaggcaa

SEQ ID NO: 172943 - DNA, 601 bp, Human
attagctgggtgtggtggtgggcacctgtaatcccagctattcaggaggatgaggcaggagaatcactcaaaccccagaggcagaggttgcagtaagccgagattgagccactgcactccagcctgggcaacagagcaagactccatttcaaaaaaaataaaaataaaaaaagttatctaagaggtcctcaccccccacaactatagtcattccatgtccagtcggagtgcccatgaccacactgacattttcccctggtttgctccctgagtgtggctcccgaacacctgctctcctcarggagggagagacctggtaatgctaagctgccttctatcacataaacccctcctgcagatcagaaggaagaaaaggcagaaaggataggggactctctcatggctgatttttactgcaggcatagaggaatttcccagtgtagtccaagtgatctgcactacaatctctggacttgaactcctgggctccagcgatcctccccccgcagcctcctgagtagttgggaccacaggtgcacatccacgcccagcttgaggaaggttattaaaatacagaaacctgggttatatttctcaatca

SEQ ID NO: 172944 - DNA, 601 bp, Human
caacatggtgaaaccctgtctctactaaaaataccaaaaaaaaaaaaaaaaaaaaaaaaattagctgggtgtggtggtgggcacctgtaatcccagctattcaggaggatgaggcaggagaatcactcaaaccccagaggcagaggttgcagtaagccgagattgagccactgcactccagcctgggcaacagagcaagactccatttcaaaaaaaataaaaataaaaaaagttatctaagaggtcctcaccccccacaactatagtcattccatgtccagtcggagtgcccatgaccacrctgacattttcccctggtttgctccctgagtgtggctcccgaacacctgctctcctcaaggagggagagacctggtaatgctaagctgccttctatcacataaacccctcctgcagatcagaaggaagaaaaggcagaaaggataggggactctctcatggctgatttttactgcaggcatagaggaatttcccagtgtagtccaagtgatctgcactacaatctctggacttgaactcctgggctccagcgatcctccccccgcagcctcctgagtagttgggaccacaggtgcacatc

SEQ ID NO: 172945 - DNA, 601 bp, Human
gcctgaccaacatggtgaaaccctgtctctactaaaaataccaaaaaaaaaaaaaaaaaaaaaaaaattagctgggtgtggtggtgggcacctgtaatcccagctattcaggaggatgaggcaggagaatcactcaaaccccagaggcagaggttgcagtaagccgagattgagccactgcactccagcctgggcaacagagcaagactccatttcaaaaaaaataaaaataaaaaaagttatctaagaggtcctcaccccccacaactatagtcattccatgtccagtcggagtgcccawgaccacactgacattttcccctggtttgctccctgagtgtggctcccgaacacctgctctcctcaaggagggagagacctggtaatgctaagctgccttctatcacataaacccctcctgcagatcagaaggaagaaaaggcagaaaggataggggactctctcatggctgatttttactgcaggcatagaggaatttcccagtgtagtccaagtgatctgcactacaatctctggacttgaactcctgggctccagcgatcctccccccgcagcctcctgagtagttgggaccacaggt

SEQ ID NO: 172946 - DNA, 601 bp, Human
cagctacttggaaggctgagggctgaggcaggagaatcgcttgaacccaggaggcagcaggttgcagtgagtcaagatcgcaccactgcactccagcctaggcgacagagtgagactctgtctcaaaaaaaaaaaaaaagaaaagaaaaagaaaaaaaaacacacaaaacaggacgggcacggtggctcacgccggtaatcccagcactttgggaggctgagccgggtagattgcctgaggtcaggagttcgagaccagcctgaccaacatggtgaaaccctgtctctactaaaaataccaaaaaaaaaaaaaaaaaaaaaaaaattagctgggtgtggtggtgggcacctgtaatcccagctattcaggaggatgaggcaggagaatcactcaaaccccagaggcagaggttgcagtaagccgagattgagccactgcactccagcctgggcaacagagcaagactccatttcaaaaaaaataaaaataaaaaaagttatctaagaggtcctcaccccccacaactatagtcattccatgtccagtcggagtgcccatgaccacactgacattttcccctggtttgctccctgagtgtgg

SEQ ID NO: 172947 - DNA, 601 bp, Human
cctgggagttggaggttgcagtgagttgagcaagaccctgtctcaaaaacaaacaaacaaaaaaagtgttgaaaataggtgtgatgaatgttttctctgacatccttgaactttctctgatcctcactgcaaatcttaggacaatgttttgctcagaaaggaaatgccatctcatttgtaaactctttagaggtactgatgtgaaacagaaactgcgaaggagattcggatcaagactcagccgccgggcagacctacctcccacttggggtaatcgtggggcttcagggagcccttgtgygtgcctgggagcacaaccagacagccgttgttccggctgatgtgctccatcgccgtccaggcgcaaacgatgagatcgctgggcctgaaggggaaatagtgcaggtcctggtgcagggggtgacgggacgtcttcttgcctgaaaagaaaacctgctactaaaggatactcgaggccgagtgcagtggctcacgcctgtaaccccagcactttgggatataaaaatatatcccaaagtgggaggctgaggcagatggatggcttgagcctgggagttcaaaaccatcccgggaaacacag

SEQ ID NO: 172948 - DNA, 601 bp, Human
ccaacatggcaaaaccctgtctttactaaaaccacaaaaattagccgggcgtggtggtgcacacccgtagtcccagctactagggcgactgaggcgggaggatggcttgaacctgggagttggaggttgcagtgagttgagcaagaccctgtctcaaaaacaaacaaacaaaaaaagtgttgaaaataggtgtgatgaatgttttctctgacatccttgaactttctctgatcctcactgcaaatcttaggacaatgttttgctcagaaaggaaatgccatctcatttgtaaactctttakaggtactgatgtgaaacagaaactgcgaaggagattcggatcaagactcagccgccgggcagacctacctcccacttggggtaatcgtggggcttcagggagcccttgtgtgtgcctgggagcacaaccagacagccgttgttccggctgatgtgctccatcgccgtccaggcgcaaacgatgagatcgctgggcctgaaggggaaatagtgcaggtcctggtgcagggggtgacgggacgtcttcttgcctgaaaagaaaacctgctactaaaggatactcgaggccgagtgcagtggc

SEQ ID NO: 172949 - DNA, 601 bp, Human
ttttgattaaaagctcttcagccaggtgtggtggctcacgcctgtaatcctagcactttgggatgcagaggtgggcggatcacgagttaaagagatcaggaccatcctggccaacatagtgaaatcccgtctctactaaaaatacaaaaattagctgggtgtggtggtgcacgcctataatcccagctactcgggagtctgaggcaggagaatcacctgaacccaggaggcagaggttgcagtgagccgagaacgtgccattacactctagcctggtgacagagtgagactcctcaaaaaaaaaacaaaacaaaacacaacaaaaaaacaaaaagggtcttcgatcttcctaaaagtttgaactaaaaagttcccattcttcccccaaataaactgcagacttgttagtaaaacagtcttttctaatctggtcctaatgtacatttttgggctcacctcctctgctgctccccaaaatacacccccagcgcccagcccatctagactgcaagctccctgggtctttcctgttctttggtcaagttcaggcttgcccttgaccttgtgccttcctatatcgactcttccctatgggacattg

SEQ ID NO: 172950 - DNA, 601 bp, Human
tatcttgattgtggtgatgatttcacaggtatgtgtgtgtggaaaatgatcaaattatacatgcaaaatatgtacaatttacatgacaattatacctcaatgaaactgtttatttgtttaattgtttgttttttgattaaaagctcttcagccaggtgtggtggctcacgcctgtaatcctagcactttgggatgcagaggtgggcggatcacgagttaaagagatcaggaccatcctggccaacatagtgaaatcccgtctctactaaaaatacaaaaattagctgggtgtggtggtgcrcgcctataatcccagctactcgggagtctgaggcaggagaatcacctgaacccaggaggcagaggttgcagtgagccgagaacgtgccattacactctagcctggtgacagagtgagactcctcaaaaacaaaacaaaacaaaacacaacaaaaaaacaaaaagggtcttcgatcttcctaaaagtttgaactaaaaagttcccattcttcccccaaataaactgcagacttgttagtaaaacagtcttttctaatctggtcctaatgtacatttttgggctcacctcctctgctgctcc

SEQ ID NO: 172951 - DNA, 601 bp, Human
aatctatactatgtgattacatgtctatgacattttagaaaatgcaaactaacctgcagtaacagaaagcagctcagtggttgcctagagcagggagaaggatggagtatcttgattgtggtgatgatttcacaggtatgtgtgtgtggaaaatgatcaaattatacatgcaaaatatgtacaatttacatgacaattatacctcaatgaaactgtttatttgtttaattgtttgttttttgattaaaagctcttcagccaggtgtggtggctcacgcctgtaatcctagcactttgggakgcagaggtgggcggatcacgagttaaagagatcaggaccatcctggccaacatagtgaaatcccgtctctactaaaaatacaaaaattagctgggtgtggtggtgcacgcctataatcccagctactcgggagtctgaggcaggagaatcacctgaacccaggaggcagaggttgcagtgagccgagaacgtgccattacactctagcctggtgacagagtgagactcctcaaaaacaaaacaaaacaaaacacaacaaaaaaacaaaaagggtcttcgatcttcctaaaagtttgaact

SEQ ID NO: 172952 - DNA, 601 bp, Human
agcatcaatgaacctcaaaatcactacactgagtgaaggaagccagaacgggacaaaaaaatctatactatgtgattacatgtctatgacattttagaaaatgcaaactaacctgcagtaacagaaagcagctcagtggttgcctagagcagggagaaggatggagtatcttgattgtggtgatgatttcacaggtatgtgtgtgtggaaaatgatcaaattatacatgcaaaatatgtacaatttacatgacaattatacctcaatgaaactgtttatttgtttaattgtttgttttttrattaaaagctcttcagccaggtgtggtggctcacgcctgtaatcctagcactttgggatgcagaggtgggcggatcacgagttaaagagatcaggaccatcctggccaacatagtgaaatcccgtctctactaaaaatacaaaaattagctgggtgtggtggtgcacgcctataatcccagctactcgggagtctgaggcaggagaatcacctgaacccaggaggcagaggttgcagtgagccgagaacgtgccattacactctagcctggtgacagagtgagactcctcaaaaacaaaa

SEQ ID NO: 172953 - DNA, 601 bp, Human
ctcagcctcccgaatagctgggagtacaggcacacaccaccatgcctggctaatttttgtatttttagtagaaatagggcttcactatcttggccatgctggtctcaaactcctgacctcaagtgatccacccgccacggcctcccaaagtgttaagattataggcgtgagccactgtgtccagacgagttaggagttcctaaaaccatgttcctcatttcctatcgaactacaactcattctccctgctttaacaatgggggctctttccattcgcagcatcatgggattccaggatctwttcttttcttttttttttttttttgagatggagtcttgctttgttgcccaggctggaatgcagtggcgcgatctcagctcactgcaaactccacctcctgggttcaagctattctcctgcctcagcctcctgagtagctgggactacaggcgcacgccaccacaccaggctgattttgtatttttagtagagacagggttgctccatgttggtcaggctggtctcgaactcctgacctcaagtgatccgcccacctcagcctccctaagtgctaggattacaggcatgagccactgcgcc

SEQ ID NO: 172954 - DNA, 601 bp, Human
tacatccagaataatgaaagaatagtaaattaaaacactgtgtttgtttgtaactatttcccaaattagttgctactttaggtaatgcggttatgtctttattaaagaaattgacatgagaagcaccttaggagtcagggtaagggaagcagcccattcctcttcctaagagcatccccagttccttctgggaatgacgacatccctcttagacagtgctgagactctgacccagagcccttctctcctggccagggtgaatgtgtgacccacactaagctaatcatacctcccactctgmatctgagcagggtatctgagactccacacgctctggaagccctgcaaacttttccctttgccttctgtcagccaaagcccactgcagttgcatgcaccaaactttaaaccttggcttcactgatgagtttcacattaaatggttttatatcaggatccagacactcacatattttcatttgacactaattattggtgcaagaaatctgagacgttctattattattattattgttattactgagatggagtcttgctctgtcgcccaggctggagtgcagtggtgcgatctcagctcact

SEQ ID NO: 172955 - DNA, 601 bp, Human
tgtctcgaaaaataatggtaataaaaaaaaagaagtcacatgttgatattaaaatcactgattttttggaggaaatgaacagtgtggaatttccacctgcccttcatgactgcattatacatgaagatctagcttagctttgccttttgtggttaatgcaggcaaccacctatctcttgggcatttccagcctgaaactgtgagtgttcccagtgtgttctcctcctcgcccagaactttaaataaatccttcatctcttactcaggagtgtctctgagaagctatttccccaaaataggrgggagaaaatgctcaatttttctgagctcaaaggcacttatgttacatccagaataatgaaagaatagtaaattaaaacactgtgtttgtttgtaactatttcccaaattagttgctactttaggtaatgcggttatgtctttattaaagaaattgacatgagaagcaccttaggagtcagggtaagggaagcagcccattcctcttcctaagagcatccccagttccttctgggaatgacgacatccctcttagacagtgctgagactctgacccagagcccttctctcctggccaggg

SEQ ID NO: 172956 - DNA, 601 bp, Human
gccattctcctgcctcagcctcccgagtagctgggactacaggcgcccgccacctcgcccagctaattttttgtatttttagtagagatggggtttcactgtgttagccaggatagtctcgatctcctgacctcgtgatccacccgccttggcctcccaaagtgctgggattataggcatgagccaccgcgcccggcccataatcaatattgacaaggttaggatcctgaggtcacctggcttcttactgataagagcacagaaagcccaaggtaagcaaatatatttcctggtaaataarctggactaaagtccaggttggttaaaagccacaaatctttaaaatgttaatgcaatttaattaaaattttattcaattaatttgaattcaatgaattgaatacaatttttgtttctaacccacacttctgcagcaggtgcagcaatgtgaatgcttaccttccggaatccctgggttttattctgaccagatccgtggatgagcaaaggatggaagaaaacagtgtcgcccttctccatcaccaggtgcacccgggccttgttttcctcgtagtcctggatcccgtggaacattttgtta

SEQ ID NO: 172957 - DNA, 601 bp, Human
cactcaaggccaggagttcgagaccagattggccaacctggggaaaccccatctctactaaaaaatacaaaaattagctgggcatagtggcgtgtgcctgtagtctcagctactcacgaggctgaggcaggagaattgcttgaacctgggaggccaaggttgcagtcagctgagattgcatcactgcaatccagcctgggcaacagagtgagactccacctcaaaaaaaaaaaaaaaagaaaaaaggaaaattgccaagtctatatattaaaacccacaacatgatttgtgtcgttgtgcytgcacctcgctacttgcacagctctgaaggttgtgctagtgtggggtccaatagtgtcttttatttaaacttttggcattgtgcgcagccaatacattgggtattttgcattaattttgatttttttaaatttcgcattaaaatgttactaaactcgattgcagagtctttttttggcatccccttacattttacccctggagagagtgccccaacttgtcccaccctaatcctgaccctgatgaggctggtggaaatatgaatgaatggaagacgaaatttggcccctaacccatggcc

SEQ ID NO: 172958 - DNA, 601 bp, Human
cctctgggatttgttttcttgtcattgacagcatggagtttatactgccccaccgggttttggtgaagaaaataagaaaatgaatatgaatgtgcttttgtactttacagagaactatgtagcagaggttaatattgttattctaaatataacttacagagtaattaaactaaatgtgggaggtattcatttagcacaaccttgacaaacctcaaacataatgtacatatatttgttctcccttaaaatttaggatgttagctcaaagctccagttgacaaaatgtataggcattttaggyactgaacaaaaagtgaggaaggacaagaatttctaggacctgcaaatgcaaaatcagagcattttcagagatgcgacacatttccaggttctaaagggagaagcaagattccttcttttgttgttgttgagacagagtctcgctctgtcgcccaggctggagtgcagtggcatgatctcggctcactgcaagctccgcctcctgggttcacaccattctcctgcctcagcctcccgagtagctgggactacaggcatgtgccaccagacccagctaatttttgtatttttagtagagacg

SEQ ID NO: 172959 - DNA, 601 bp, Human
aaattttttggggacacagtctcaccccattgcccaggctggagtgcagcggctcactgcaacctctgcctcccgggttcaagcgactctcctgcctcagcctcccgagtagctgggattacaggtgtgcaccaccacgcccagctaactttttgtattttcagtagagacagggtttcgctacattggccagactgatctcaaactcctggcctcaagtgatctgtccgccttggccttgcaaagcctcccaagtgctgggattacaggtatgagccaccactcctggtctacttaaccracttctaaaacagtgttaactaaattaagtcagtgggtcccccagctgctgtcagttctgttttattcaggatatttgttggtgccagctaacataactgggtcaatgtcatgtcgggttacagaacaaacagttcactgccatttttctgcataatttttttttttgagacggaattttgctcttgttgcccaggctggagtgcaatggtaccatcttggctcattgcaacctctgcctcctgggttcaaatgattctcctgcctcagcctcccaagtagctaggattagaggcatgtg

SEQ ID NO: 172960 - DNA, 601 bp, Human
gtttggttttggttttctgttgaaagagttatagcagatggctatttcaaagattggttctttctcctttcacaagtcgagctcgaaacatccaaatatcctggaaataatatcaaacagagtgggtttatggaacacttcaatctgccctccatttaccttcaatttcaccataacacaaaattgatttctagcttctatgaaaggttacatagggaaaataatccctgtaagttatattcattagtaaacaaaacaactcaacttaaactacttactcaactcttttttaaaaattttytggggacacagtctcaccccattgcccaggctggagtgcagcggctcactgcaacctctgcctcccgggttcaagcgactctcctgcctcagcctcccgagtagctgggattacaggtgtgcaccaccacgcccagctaactttttgtattttcagtagagacagggtttcgctacattggccagactgatctcaaactcctggcctcaagtgatctgtccgccttggccttgcaaagcctcccaagtgctgggattacaggtatgagccaccactcctggtctacttaaccgacttcta

SEQ ID NO: 172961 - DNA, 601 bp, Human
atccactttatttggactccatgacaccgttcctatgcccttgactagatgtgaatgtattatacattgttctagatttgggggaaaaaaatctcttatgacataaaattggtagggaatgggtttatcagaaaggggatacaaaacataccctaagctccaaatcattcacttcttcttgggtaaagagctaactgaatgaaagaaattgatttaacacttaaattagacaccaaccacctttattggctgccaccctaaattagttttccttaaaacagtaatatttcacttttactgttttttttttccattaaagcaacaccattgtgctgcaaaactaactctatgcaattaagtacctgatacatgttttctgcttttaacaagtgatagaaaaggttacatcatctcattaagaaaacattttccttagacatttcgtttggttttggttttctgttgaaagagttatagcagatggctatttcaaagattggttctttctcctttcacaagtcgagctcgaaacatccaaatatcctggaaataatatcaaacagagtgggtttatggaacacttcaatctgccctccattta

SEQ ID NO: 172962 - DNA, 601 bp, Human
gcagagtctcgctcttgtcacccatgttggcgtgcagtagtgtgatcttggctcactacagcctctgccacccaggttcaagtgattcttctgtctcagcctcccaagtagctgggattacaggcactggccaccatgcccggctaatttttgtatttttagtagagacggggttttacccgagaccaggctggtctcgaaatcctgaccttaggtgatccgcctgcctcagcctcccaaagtgctgggattacaggcgtgagccactgagcccagccaaatagattttttaaaagttgaytgaaaagtgaacatttgaattttagaaactttcccatgccttcaggtaccaagttaagacagatagctgttgcaggaagggcataaattgctacccataacttcgttaaaatttactccagatgttttaacaacatatttaaaggtaatatactgaagcagtattctcagtcacttgaataccttttcagaatttaggccatatctacttaaccatctattattttcttactatagttttaattcaactcacataaaatttattttaaaggaagactttatgtcaccttcataaataaaa

SEQ ID NO: 172963 - DNA, 601 bp, Human
tcatggaagacaatttttccacgggacagtgtgtggcgggggggtggggaatggttttaggatgaaattgttccacctcagatcagcaggcattaggttctcctaaggagtgcgcaacgaagatccctcacatgtacagttcacagtagggtttgcactcctatgaaaatctaatgccacccctgatctgataggaggcagagcagagctcagacggtaatgcctgccactcacctcttgctatgtggcccagttcctaacaggccatgaaccaatacccgtccgcgacctagggattgarggtccgtgatttaaagtattcaggaagatgtgtgtaggctatgtgcaaatactgcaccattttatatcagggacttaagcattctcagattttgatagggaggtcttggaaccaatttcccaggaatgtgtgagggaggactgtgtaacaaattgaccattgtaaccattttaaagtgtacagttgagtaatattaagtacattcatggtgttgtgcaaccaatctccccgactcttttcatcttacagagtggagactctctacccattaaacaataactccccattccctcctcccac

SEQ ID NO: 172964 - DNA, 601 bp, Human
ttgagcccaggaatttgaggccagtctggacaacatagtgaaaccttgtccctttaaaaaaaaaaaataacgtcctaaaaattgatgtggagtgtaaagatgaacccagaaaccatatgcattatttttctaaataaaaaataacggatgaggaatgaatcaatctcaaagttatagactaaacactataccataaataaaataatcataaaaagtaattggatatgtgaataaaataaagttttctataagaaagtctgttataactgacgaaagtcagcttaatatctgaacttcaccttttttttttttttttttttgagagggagtgtcgctctgtcacccaggctggagtgcagtggtgcaatctcggctcactgcagtcttagcctcccagattcaagcaattctcctgcctcagcctcctgagtagctgggactataggcacgtgccaccatacctggctgatttttgtttttgtttttgttttttttagtagagactgagtttcaccacgttggtcaggctggtctcaaactcctgacctcaagtgatccacctgccttggcctcccaaagtgctgagattacatgcgtgaac

SEQ ID NO: 172965 - DNA, 601 bp, Human
tttatcaaaagcagccttgtccctgatagctgccgaatcatttttaaaaaggggggtggatgggaagatgggagagaaagtagaaaaggatatgtgtttattaaaccttaacatgggatccatttaaacttttgatgttatttatatctgaatatacagaattaacactataaagagcctgctaagactagacttccaggctgagcacggtgactcatgcctgtagtcccagcattttgggaggctgaggcaggtggatagcctgagctcaggagtttgagaccagcctgggcaacatagygaaaccccatctctatcaaaaatacaaaaaattagctgggtgtggtggcacatgcctgtggtccccactacttgggaggctggggtgggaggatcacttgaacctgggcggtggaggtttcagtaagccgagattgcaccactgtactccaacctggatgacggagtgagacctcatctccccaccccccaaaaaagaaaagatttccaaatattaggtacatatactaatattatgagattctcaacataagaagactgtttttctgaaacaataatgtatttttgaaaagtcacttag

SEQ ID NO: 172966 - DNA, 601 bp, Human
tagcctgagctcaggagtttgagaccagcctgggcaacatagcgaaaccccatctctatcaaaaatacaaaaaattagctgggtgtggtggcacatgcctgtggtccccactacttgggaggctggggtgggaggatcacttgaacctgggcggtggaggtttcagtaagccgagattgcaccactgtactccaacctggatgacggagtgagacctcatctccccaccccccaaaaaagaaaagatttccaaatattaggtacatatactaatattatgagattctcaacataagaagaytgtttttctgaaacaataatgtatttttgaaaagtcacttagaggaccagaaacattttttaaaagccctaccaagatttaatacatggtataaagttattgatttttgggcattcaaaaaagtattgagattaattattaaagtagacagtatagtactgtagaaagaatagggaggatccaagttcagtagttttgtttgttttttgagtcagggtcttgctatggtgtgaaggctggccttgaacttctgggctcatgcagtcttcccaagttgctggaactacaggcgtgcgccac

SEQ ID NO: 172967 - DNA, 601 bp, Human
atgcaatgtgaaataatcagatcatagacaatgaggtatccatcccctcgaacttttatcctttgtgttactaacaatcccgtgaacactcttttagttattttaaaatgtataattagttactactgactatagtcaaccctgttatgctgtcaaataatagatcttattcattcttactgttttttttgtactcattaactgttctcagcgccccctcccccaacacttcccagtctctggtaaccatcttctaccgtctatgtccatgagttcaattgttttgatttttagatcccasaaatgagtgagaacatgggatgtttgtctttctgtgcctggcttatttcacttaatatgatctccagttcatccatgctgttgtgtggatcaacatgttgttgcaggatctctttcttttttatgactgaatagtactccattgtgtatatgtacattttctttatccattcatctgttgatgtacgcttgggttgcttccaaatcttggcttttgtgaacagtgctacaacaaacatgggagtgcagatatttctttgacatagtggtttcctttcttttgggtatatacccagcagtg

SEQ ID NO: 172968 - DNA, 601 bp, Human
gttcatggattggagggcaaatgaagttaaagacaaaggtagtataagatgcttttcttgagagggagagatgtgcggaaaatagcatgagagtaacgctgaggttgtttatgagagtgaaagtggagttcttcacaatatcagaagcttaaggatgttgaatttaaagctacatagtacttcaggttttattcttgcttctaaattccagtgtttagaaggattgtcttgaagatatggacaaccaaagtgatttttcctgtataagtaccttactagctgattgcaccactagagctcyaaaaattatcatttatttctaaagaagttctgtagtagaattgaatcggatggcagtgggactgaacattttgtaacttttttttttcttttttaatgaacgtggaataggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaa

SEQ ID NO: 172969 - DNA, 601 bp, Human
cccagtgggtgaaggtgcctgcctggtttccttccacccacagccatccagccctgtatagctggggatgaaaggacagccagcctaactccactagaggcctggggtagcaacttctccctttgagcctcggttcccgggtgtacaaaatgggcggggaagtgaactggtagttaagctccaaaaaatctgctggctggacacaccccttcctgacacctggtctgggccacaaagagcctaggagaatgggctgcccagggtgccagaaggtgggggcatggtgctaatgctccgttamctccccccgggcagaaggcctgcccagtttcccacccaaagatcccttggcttaggcctggtcttctgagaggccaagggtgacaggctcagtcctaggacctgggcttctaactgctcacccgaggtggctgggccctgggcttgcttgcagcccgcagggtcatggtggggtaatgagggaggggtcagaaccaagcaagccagggcacctgcggggaggccctgtacagggaagggcaggggagtccagcactctctctagggacctggcccatacggatcctcttcctccagactc

SEQ ID NO: 172970 - DNA, 601 bp, Human
tgcagcaggccagcctagaatgttctgtagctttttagaagcaacgttacttagaccgcgtagcaccatgagaaaatgcccacagacgcagtattaaatgaaaaaaggtgtcacggcacacacactccagtgacaacgacaatgaaggaaaaggatggggaaaagactggcagtgaactccaaaatgctaacacagtcactgcctgctgaagaaatagtgggtgatttttgtttcattttctaaatttcctgtagcgctgttttgttattttctaaatcaagaaaatgagtacattcatgktttccctataatgagctcagattcacttccctgggacccacctgctccctagctctggcccacgtgtctgggacaatttctgccatgggatgcctttctcatttgggacagtccctcagacatatgagaatctgtccctactttctctttcccagactcagtcaacatccctggctctttgaagatgacctgtcaaggttttaaaatccttcaaaagatggagcccagaaccgcacccaggtgggtctgccccctttggggggcagccatgtcacactgtggatcctgggtctcaacccc

SEQ ID NO: 172971 - DNA, 601 bp, Human
cacttctcaactttcacaggaccttcccctccaggaggccctccaggctgccccagcccacgcagagccccagcttcagagctcctaccagctctgccaggaagtgagaaccacaggcctcccctcactgactcctcgtctcctctacccgccagcagaggcgctctcagggtttgctcttcatccttccctcctgtctccctgcagcacggacagcacaagctgcagatagatagatgcgcgagtctgcatgaggaccaggtgtcaggctgggctgagaagcagcagccagggtccaagkggggcagatgatgcccaggttttcgcctgcccacgaggcttacaaccatgccatgatcaggacagccaggggggcaccaagcagcctctcttctacttgttccttcgactctgggcccagaccacagaaggaggggtggagggaagctgcggttggagggtgtgtgcacagctagtgtgtgatgagaagctgacttcatcttagcacctcaaaaccaggaagagaaactgagcaggcagaaagggcaggctgggctgcacagggccctccagtccctgggggcctgctgaggggagctct

SEQ ID NO: 172972 - DNA, 601 bp, Human
aacaggctggcattgtgcccaagcgctgaggtcagtggctgcagcctcaggcagcctttcttgtgagcccaggctgacaaggagtggggagaaagaactgggagcccagaaactcccaggctgcccttttcctaccctggaagcagctgtagacccccaaggccaggcacgtgctgagggccaggggaggtcaaggggctcccttgcccttcccccttgccaaaactctgctgcctaatggggcgtgggagccttcagtaactgtttacgcccagctaaaaatacccactgaaaagggaastgcacaaaagacctgggggaactcagggccctggcccccggagattctggtgctgccacaggacctagctggatgctctgggggatggggacagccactggaggcaaaacaggcaacagcaaggtccaccttgccttctcattctttgagccagtgttttagaagccttcctgtgtgcccagagccatgcttggtaggccaggatatccgggtggagaaggaaaggactcaagaggtcctgcctttggggacccaaggtcaccactcacacacctctcctctgtgcacaagccagggctg

SEQ ID NO: 172973 - DNA, 601 bp, Human
gcaatgcctacaactaacactcaaatcagcaaaaaatacatacacacatatgtctatgtagataaaagaagagatagagtaaatgtggcaaaatgttaagaactggcaaatctgcatgaaggatatatgaatattcattatactattacttcaactttttggtaggtttcaaatactcaaaataaaaggctgtgaaaaaaaaagccaggtgcaggttctctatggaatactacaagttgtgtttttaaagaggtattaatgcaacacctccctaaactcaaatatgcctcgattatctttkgaaagacagaggaaactggtaacagaggttgcctctaggatgagaagggaaagtgagatcaagttcaagagaaacttactttttactgttcatttgctattttgtccttttgggcttttaaaaaaattattattatttttttaaagccacatgcatctattaccttcccccttaaaactggaaataagaaactttttgtaaatcacctctctctggagaattccttgggtccccagctgtgttggctgccgaggcctccaaggcctctcacacatccccgtgctccagtgagaacctcac

SEQ ID NO: 172974 - DNA, 601 bp, Human
tgccttaaaaaaacacagcaggacagtccctgcagtgctgtctgtagtagcaggagatgatggggagacagcctttatgtccatcagttgggggctgggtggataaattacaagatgtccctgaaaggggacagcatagctctagctgtgatggggccaggggagatctctagatgccgatactgaacactccccatgatagagtatggaaaatggcaaaacaccagctcaagtcattgaagaaaaagttgccaggggagcagaacagacacagcttccaagtcccatcccacaggctaaytggaaagaggaaggagcacctgcactacagggagacgtgcggacaaccccggaaccaagtgatccagtgaagcatcaccagcaaggtgacgcatggacactaagtgcctcctggaggaggactctgcattgcccgggggggcgttcctgccagagctgttccacctgactccaaccagggagaagcaatcagacaaatccagaacaactggcccggactcttcatgtcaatgtcataaaagagcaaaacaaaaaaagggctggagaatgttctagattgaacaggacactagagaaacat

SEQ ID NO: 172975 - DNA, 601 bp, Human
acagctactgccaccgccgcctccccactgccttgattataataataaaaataataacaggccctgttttctgagcacttattctgtgccaggccctgtccttggcacgttatggctcatcacatcctctaacaactctgagacagagaagctattattatccccattttgcagatgagaaccccaagtgaggcccacaggggcaaggcgggggtccctagggccacaccttgagtgagcattctgtccccctcaggtgtcaaactcctgagctgctgagccagccctccccatagccccrtgcctccctgccggacaggccccaggagttgccatggggaccacactagcctaggggcaagggagaggagggaggagggaggaggcagaagcagctatgaggggcacaggggcggtgctcagggaagggtaagcctaggagcggtcggggtgggctgcctcaaggagctgggctctgaaggcctcagagggtctggaaacagggaagagggctaaactcatcacctttactctgctggctgtgactctagaacccagcttccccatctgtgcaatggactggtgatactccttggctctg

SEQ ID NO: 172976 - DNA, 601 bp, Human
tttattttattattattgttattattgcgacggagtcttgctctgttgcccaggctggagtgcagtggcgcgggagaagacattttagtgcaaagtgctgggggtgtgaagtaggcacggactgcagagctcagacaggctccctggaggagggagctctggggctgagccctgaagattgcagggcttacacaggcagagggcgggccagggaaggcaccccaggttgatgcagcagtctgagcaaaggtgtcaggcaggggactggcatagtatgagaaactggcccaggtggaagccratggtgagggaagcgggaaggcagaccctgcccatctggggctctaggaccccacacacttccagagtccaccttgagcaccgctgctcaggggacactgtaggggatggtttcaagtgggcctggcataaactctgccaggcagcagggggacttccactgccaatgtgaggaaccagggtttgactccaagggcgatggggcctcagcaggggggcatgtgatcatggagagcagaaggagctggggaggagacggccagggagaaccaacacttccaggccgcacacctggctctat

SEQ ID NO: 172977 - DNA, 601 bp, Human
cccttgactctcacaaatctctaagttgttattatctccatttcccagatgtgatgctgaggcttggaggtgacatgatttgtccaatgttacagtcaatgaatggtaaaccaggacaaaagcccagccctggtgacctaaaagctcacttggggtcgggggactgagggagcaggggccctagagcacagtgggggtttcggggcagttggaaggcctgagtgccgggtctcggcaggtgcccaccttggccatgtactcagtgacgatgtagagcccgcccttctcctccacgatcacrcccaggagctgcaccaggttgctatgccgcagttgcctggggcaggacgagagtggtcagaaaggggaagctggtgcctcactcctaacctaggccaacctcccccctaccccgcccccactcacgtcatgactgaggcttcagccaggaaggcctgggcagtggcgtcgttcttaatgcacttgacggcgactttgttccctcggtaatcgcccagcatcacgtctgggggcagagaggtggtcttgttcccaagttcggagtccctcagaacccccccagggggcccggcccagctca

SEQ ID NO: 172978 - DNA, 601 bp, Human
ttccaggctgccgacttcctgagaaaacatgggcccacaagccctcatggtcacagaccccaggcctggtgaacacagagggggctgactcagttttcccaggaagctgagtcacagctcacagcatccagcactcccaccagggcctctgccctcacctctccgagcaccctctgcctctcacctcctccctgctctgcctggctgggagaagagaaaggaaaaaagagagtgaaggggaacaaaactccaactcccctccactccctctgctgagggccaggaactgatattcttagarccctttgtgtaactttcagtctctccagtctttgcctcagctgcaggcatgccttccatgccactcccacttcctcctggccgatgctcacctttgacactccagggcccctctatataacattttctgactcttgcacaaacaaaattgaccagcctctcctcctctgcacccccaacacgtcccattactcacttctgtcgggggacctcaggtgccccgaactgggttggtcataataaaccttaattcatgcacactcttgaaattcatcaatccatgcaaagtcctcttcgtgac

SEQ ID NO: 172979 - DNA, 601 bp, Human; identical to SEQ ID NO: 20163

SEQ ID NO: 172980 - DNA, 601 bp, Human; identical to SEQ ID NO: 20164

SEQ ID NO: 172981 - DNA, 601 bp, Human; identical to SEQ ID NO: 20165

SEQ ID NO: 172982 - DNA, 601 bp, Human; identical to SEQ ID NO: 20166

SEQ ID NO: 172983 - DNA, 601 bp, Human; identical to SEQ ID NO: 20167

SEQ ID NO: 172984 - DNA, 601 bp, Human; identical to SEQ ID NO: 25641

SEQ ID NO: 172985 - DNA, 601 bp, Human
ctgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctraactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttcctttgaggaattaagggactaattaaagaattcaggaacaaattcctcgaaagaaaaaaatgtatgcatttcttttg

SEQ ID NO: 172986 - DNA, 601 bp, Human
tccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacgctcagctaatttttaaattttttgtagagacagggttkcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagat

SEQ ID NO: 172987 - DNA, 601 bp, Human
tctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggygtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgat

SEQ ID NO: 172988 - DNA, 601 bp, Human
gccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaaggaaaaaaaccccaagacattaagaggttggagccattttgttttttgaaacagagtctcgctctgttgcccaggctggagtgcaatggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggatta

SEQ ID NO: 172989 - DNA, 601 bp, Human
agctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagaaaaaaaaccccaagacattaagaggttggagccattttgttttttgaaacagagtctcgctctgttgcccaggctggagtgcartggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaa

SEQ ID NO: 172990 - DNA, 601 bp, Human
gctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaawaagcaacttttttttccaggaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgt

SEQ ID NO: 172991 - DNA, 601 bp, Human
tcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaataagcaayttttttttccaggaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaat

SEQ ID NO: 172992 - DNA, 601 bp, Human
tttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaataagcaacttttttttccargaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacc

SEQ ID NO: 172993 - DNA, 601 bp, Human
aggaaggggatccaacatcagacacagcccctctccccaagtgtccaggatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatmaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtgga

SEQ ID NO: 172994 - DNA, 601 bp, Human
gaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgkgagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagagtgtctcagggttcaaggtatccatgtcccatctaatgctggcattccttctgcagcacccctgacctgtggctgtccagctttcatgtacacatctccagggacaggaagcttgctcattctagaggcagctgctc

SEQ ID NO: 172995 - DNA, 601 bp, Human
attgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagrtgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcagtccttgcctggggatggcagtgctgctgagggaaggaagtggggaacactgtgagtgcaaggacaggtgaggcaggcacagacggctgtcccaagggaaagtgctccatcagctgtgccag

SEQ ID NO: 172996 - DNA, 601 bp, Human
tattttaaagctataaaaattataaatcagtcattatgatgtgtttttctctactgagccctctggtgtgttccctgttttattaacgtggatggagggtgtgtcagggaggttgggacagaggcagagaagaggccagcccggccttcagggagttcgtggcctgtctggaaagagggtcttttacataccagcagtttgcagagccagacacagaacgatagagcaggaccttttaaactcctttttcaaaaaaaaaaaaaaatgtttaattttggtaaaatacacataatataaaatmcatcatcttaaccatttcaaaatgttcagttcagtgtacactaagtgtacaggtctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtg

SEQ ID NO: 172997 - DNA, 601 bp, Human
ctgagccctctggtgtgttccctgttttattaacgtggatggagggtgtgtcagggaggttgggacagaggcagagaagaggccagcccggccttcagggagttcgtggcctgtctggaaagagggtcttttacataccagcagtttgcagagccagacacagaacgatagagcaggaccttttaaactcctttttcaaaaaaaaaaaaaaatgtttaattttggtaaaatacacataatataaaatccatcatcttaaccatttcaaaatgttcagttcagtgtacactaagtgtacagktctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagc

SEQ ID NO: 172998 - DNA, 601 bp, Human; identical to SEQ ID NO: 25642

SEQ ID NO: 172999 - DNA, 601 bp, Human; identical to SEQ ID NO: 25643

SEQ ID NO: 173000 - DNA, 601 bp, Human; identical to SEQ ID NO: 25644

SEQ ID NO: 173001 - DNA, 601 bp, Human; identical to SEQ ID NO: 25645

SEQ ID NO: 173002 - DNA, 601 bp, Human; identical to SEQ ID NO: 25646

SEQ ID NO: 173003 - DNA, 601 bp, Human; identical to SEQ ID NO: 25647

SEQ ID NO: 173004 - DNA, 601 bp, Human; identical to SEQ ID NO: 25648

SEQ ID NO: 173005 - DNA, 601 bp, Human; identical to SEQ ID NO: 25649

SEQ ID NO: 173006 - DNA, 601 bp, Human; identical to SEQ ID NO: 25650

SEQ ID NO: 173007 - DNA, 601 bp, Human; identical to SEQ ID NO: 25651

SEQ ID NO: 173008 - DNA, 601 bp, Human; identical to SEQ ID NO: 25652

SEQ ID NO: 173009 - DNA, 601 bp, Human; identical to SEQ ID NO: 25653

SEQ ID NO: 173010 - DNA, 601 bp, Human
gagttggaggggaggggaagccagaaaagcccagggagcctggggaagccatggcggtggccagggcatggtttcttttctattggggggtgggatcgggggcaggtagagtaatgagaagcagaggtagcccagaaaagcctatgattagccatggcccaggttatgctggtccctcaaagcacagcccacccttgccctggaaaaggcacccagccttcctcccccagcaatgggagatgctggaagcagcccatcacagccagccctgaactccaaaccgcaaactcaatctatcatkgtttgctggcaattctttattaaaccagttctgctggatcaatgcttcctgcccgtcaaaatgatgaataaatcctcgactagcctgagcaatgcttgcagaagctcttgcgaagcctgaggtgggcaatggcgattggctacacatagaggcccaaggccaatggctaaaactctagagaccaaggctgggggtgctggtcggggtgcggtgggttaggtggggttgggtggtgggttttcgaagcttagaagaattagctaggctcttgcctgtttgacattctaaggatgacactag

SEQ ID NO: 173011 - DNA, 601 bp, Human
acccctgcttgagccaaggacagaggcccttgtgatcttcccaaaaccaaggaaaggaagttgtgaggacaggggaggtgtggttcacaacagcatcacggctcctctgacagctcactgcagcttctcacctcggcagggcgaccacagttgtacaatttgtgcttgacatggcaacaggcaacaagattcccattttctaaatgggaaaactggggctcaaataaggctcataacccacacagggctccacagcagtcagggttggggaggtgatgggaggtgagtaatggcagtgacrgggtgccagtgaccagcagcaggaagtcggctcaggacacccctgggacctgctaggccactggcccagtttccaagattttggagcccagctctttctgccccaaggaaaggacactttaagcacccccgtcttcccttcctcatggcttcaggaggctcagtctaggagagggtagggacagggggatgagaaaggccaagcttctgcctgcctccattattaaggctgagccagctttgggggcgcagcagcaatcccagaactgacgttccacacagggacttccccaccagcttc

SEQ ID NO: 173012 - DNA, 601 bp, Human
atccttctggatggagtaaaatgtctgaccccaagaaggttcacaacccctgcttgagccaaggacagaggcccttgtgatcttcccaaaaccaaggaaaggaagttgtgaggacaggggaggtgtggttcacaacagcatcacggctcctctgacagctcactgcagcttctcacctcggcagggcgaccacagttgtacaatttgtgcttgacatggcaacaggcaacaagattcccattttctaaatgggaaaactggggctcaaataaggctcataacccacacagggctccacagmagtcagggttggggaggtgatgggaggtgagtaatggcagtgacggggtgccagtgaccagcagcaggaagtcggctcaggacacccctgggacctgctaggccactggcccagtttccaagattttggagcccagctctttctgccccaaggaaaggacactttaagcacccccgtcttcccttcctcatggcttcaggaggctcagtctaggagagggtagggacagggggatgagaaaggccaagcttctgcctgcctccattattaaggctgagccagctttgggggcgcagcagc

SEQ ID NO: 173013 - DNA, 601 bp, Human
tatccttctggatggagtaaaatgtctgaccccaagaaggttcacaacccctgcttgagccaaggacagaggcccttgtgatcttcccaaaaccaaggaaaggaagttgtgaggacaggggaggtgtggttcacaacagcatcacggctcctctgacagctcactgcagcttctcacctcggcagggcgaccacagttgtacaatttgtgcttgacatggcaacaggcaacaagattcccattttctaaatgggaaaactggggctcaaataaggctcataacccacacagggctccacarcagtcagggttggggaggtgatgggaggtgagtaatggcagtgacggggtgccagtgaccagcagcaggaagtcggctcaggacacccctgggacctgctaggccactggcccagtttccaagattttggagcccagctctttctgccccaaggaaaggacactttaagcacccccgtcttcccttcctcatggcttcaggaggctcagtctaggagagggtagggacagggggatgagaaaggccaagcttctgcctgcctccattattaaggctgagccagctttgggggcgcagcag

SEQ ID NO: 173014 - DNA, 601 bp, Human
ctcctctactccccatctatgaaacaaaggctccaggccagcggcttgctaaggcctctccagatctgatattccgacacctgatcgattttctgtgcctgctgactatccctttctgagcccctcctcgacgttttaattctcaggagaatgttttcttgaactacttgtgtaattaaattttttaaacactaacataaaagaaggaggaatgtcaaattccagttctgatattcatggctgcatgatttgggggacctctctctctctctctctcctttcctcgtcggaggcttatctrtaagttggggatataaaactatttggaggccatcgtgaagaataaatgaaatgggagatatagagctcctagcacagcctggcacatggtaggtgctttgtaaatggtggttactgatctgtgaacccacctggctttagtctctgttgatttgagtctagggctataaaatccaaagcctacaggggtcaggcagctaaatggcatgaatgacgtggctgggtgtaagacagtggccttagcgacagctggggacctgcacaactgcagagcaaaagccaatgtaaaggaggcagcctc

SEQ ID NO: 173015 - DNA, 601 bp, Human
caggcggcccttagcttaagcttccaagaaagtgcacagagtggttctctctttccttcagatccagctcagagtcacttgctccaggatgccttccctgaccatcaatccatattgatctattgctcatctgccctcccataaaccagaagtggaaccctactctccattttgccacctccagcacccttaatagtgaaagcagtcttggaatgggtgatatggtattctggagggcatgactcccttagcttgcctctctccaagcccagaggataatgtattagccagcccccattakgtattaatttctgaaagcctcgttcacgcagacataacacatccacccacacagataaatgcttagacagacacaaaatcatcagcagccaattatcaggcccccgcagctgccgtgatcagacctggaggccccgctgcttgctctgcaatttgtggtagcccagagctgggggagcagtgggtggagggagtccccctatccagccggcacggctcgaggtccagccctgaccctgagggcacctgagcttgctgcctggctgagaacaccaaacaccagccccaaacgatgaagaga

SEQ ID NO: 173016 - DNA, 601 bp, Human
gcacctaggaccagggtgcacacatacacacaggcaaacacaccacacgtactcagatggcagcacaggcagcccgctcagagtcctcaagggtgaagggcagggactaaggagtacaggttaaaggaggcaggttctgaataagcagcccccagcacctgccaacacccaccccagccaggcggcccttagcttaagcttccaagaaagtgcacagagtggttctctctttccttcagatccagctcagagtcacttgctccaggatgccttccctgaccatcaatccatattgatctaytgctcatctgccctcccataaaccagaagtggaaccctactctccattttgccacctccagcacccttaatagtgaaagcagtcttggaatgggtgatatggtattctggagggcatgactcccttagcttgcctctctccaagcccagaggataatgtattagccagcccccattatgtattaatttctgaaagcctcgttcacgcagacataacacatccacccacacagataaatgcttagacagacacaaaatcatcagcagccaattatcaggcccccgcagctgccgtgatcag

SEQ ID NO: 173017 - DNA, 601 bp, Human
gaggtcacccagcagaacaggatgagggtcaggaggggaagctgagggtgggagaggtgggcagttctgggcaggctggctcaagatagaggacccagggctctggggcgggccggcccccacactgcaggaagccaggccccaggggcagtctcccctgctggaccaagtttcttctaaaaggtgctaatggcatgaacgggacctgtggacctgagggtctttcctgtctttggggaaaggaacaagtgccctcacatcctctgaagatactggaggtgggagaagcccatggctgackttggcatacagtggctggggactcacattaatcattaacaggggctgctctagcctccaacggggaactgcagggtaattacttctgggctccaggccacacgctcagtgacattattgcaggcaacacctgccttctgggcctagtaaggcaggagaagcgagtcttctcaaaggctgtgcacctaggaccagggtgcacacatacacacaggcaaacacaccacacgtactcagatggcagcacaggcagcccgctcagagtcctcaagggtgaagggcagggactaaggagtacagg

SEQ ID NO: 173018 - DNA, 601 bp, Human
agtggggccatgttctctgaggtcccttctggcctcagaattttatgattttgactcctcacaacccacaaggaaaaaaaaggtataaaagctccctggagagggaggcctattaccaatggggttggatattgtgctaagaaggcaggattttaccccaagctctggggagccaccgtaggactaaggcaaatgcagagcaatcagagaactgcaggctgttagtgcagatgggggcttggggatgcccagctcattggctcccaaagtgatggaggcagaatcacctgagtgcttcctraaactctacctgcccggcctcacccagggagcccaaacatccatgatcacataagcacccagatgactcttcagcggctgccaattcaggctttgggatcttgctaacacccaacccctctctggtcccattttcagaggaggaaagcaagactcagagaggtgaggcctcagttaagtccacacagctgggcagcacagagccaagtcttctactggtaggattcacaggcttgtcccctagactctgtccccaggagctacagagcaacccaacaggatgatgatgccccagagcctc

SEQ ID NO: 173019 - DNA, 601 bp, Human
gacatcctgaacgccagcttgagaactcagggctcttccagggtacatgaggggctgggaaagttatagaggaagagaattccttgagaaagggactgcaaccgcaccttctcaacagcacagtgagaacaggcctgggcaaaagaaacactttgagatgaaaacccattgtttatctgatgggctaattcctcctctgcagaccctatgttgcatatgcagaaacacaccagtgaatatgtacatgcgcacacacacacacacacacaccgccaaactgcacagcaggggacatctgctycacagtgctccaagttgcccagatgcatgttccctcaggccagggcctaacctctctgtgcttcacccagtggacaagaccactggggaagatgggggaggtaacaagcagttggagaacctctcagtcaagcttacaagaatcaaagaaggctccaacaccactcccccaggaaccttctgtcctcccactcaggagattggagcaaaaatagaacattgttgtggagtagcacgggagcacaccctctggggaaattaggtgggagagctcacctgctcacacaggaaggcactgcca

SEQ ID NO: 173020 - DNA, 601 bp, Human
tgtcttcctcccacccccgcctggccactagggctctatttttaacccacctcaaaaactctgactcagaatcacagggctcccaggtaagctgctcccttgcctgcctagggctgcctcagacacagtccgatttagagccaagggcatctggggcttggtttacaggcgggttgtttggatttgggtgtacatttattttccaatttttctatgtttatcaatatttgaggaacaaagtttgtttcgttttgtttttcttaaaacccaatgatgaccctttacccctgcctcttctaargtacctccccatcctgggctgaggtcctgcctgtcatgatgcaatgagagctggcctcagcctctccccaagaaggtgagctgtgtgagggcaacagctaacccagtcttctcttcttggcctgtgatccttcagccatacagcacggcgcccctcacacaggaatgtgcacacacatcacctggggactttctgagctgcagacctggtggacttcagtcggctgtggggtggggccaacatctgcactgttaacaagcacccaggtgatgctgagactgctggtgcagggaccacatt

SEQ ID NO: 173021 - DNA, 601 bp, Human
ctggagggaaatatagccccacccactgcccaaccttcctgcccaacctcccctcactgttgttcttccctgaccccagggtctccccaccacaatagataaattgctgtcttcctcccacccccgcctggccactagggctctatttttaacccacctcaaaaactctgactcagaatcacagggctcccaggtaagctgctcccttgcctgcctagggctgcctcagacacagtccgatttagagccaagggcatctggggcttggtttacaggcgggttgtttggatttgggtgtacmtttattttccaatttttctatgtttatcaatatttgaggaacaaagtttgtttcgttttgtttttcttaaaacccaatgatgaccctttacccctgcctcttctaaggtacctccccatcctgggctgaggtcctgcctgtcatgatgcaatgagagctggcctcagcctctccccaagaaggtgagctgtgtgagggcaacagctaacccagtcttctcttcttggcctgtgatccttcagccatacagcacggcgcccctcacacaggaatgtgcacacacatcacctggggactttc

SEQ ID NO: 173022 - DNA, 601 bp, Human
cctccaccacaggggattttagaagttctcccttcttcccaaataggcctagcagtgagactcaggagccctgaggaggggatgaaggaggcaactccactgctctcccggaatcccctccattccccaaccagacagacccaggaggagtcttagggcttcccctactgtgagctccccaagggcagaaatgatttctcttccttttccaagatgggaacacacagttgggcaagggatggggaggaatctcagtaacattatcttattgttaaatggatggatggacagatggatggayggatggatggatggatggatggatggatggatggacggacggacgggagactgttgccagaagaagaaaagactgccaaagataaaacaaaaaaagaattcactaaatcattaacattgatgatttctaagggtgggaatatatcgtgactctgagtttctccatttcacctttctacattttccaccttccccaaaacaggcagatgttacctttataatcagaaacattcatctacctttaaacaatggccagcgccctgtgctgtaaggggtcctctaacatgtgtcaggggaaaga

SEQ ID NO: 173023 - DNA, 601 bp, Human
aaagtgcccctgcctgcagagttccaggttgcaaagaaattacttcatagcaaattgtttgtttgtttgccagactcaaaatggggctgtgattcaaggagagggtagggcctgttttgctgaaggtgggtgagatggctgtcctacatcacactgtgtggcaaagggcagtttccagagagtcagctttctgcagctcctttgaaagccaagctcttcagggcctcaagacagggccttatgggggataaggccggatgccaagaggccaacttcagctcctctctaccccatgacccaycactccttcctgtggccccagtacccatatgccagctgagagaacccaactaaggcctgaggacccatcctcagcttcacactttactacaaagaatgcagcacacctgctaatgagtcatgggccccaggaggatggtttcagcatctatggggtgccctagagccgtgcatgctctacccagccacatagacctcactcaaagacagctgtgtacactcattagatgccacacgcaggtatccccattcacacacacagtgcacaaacacccctctatacactctgctgtcatccctc

SEQ ID NO: 173024 - DNA, 601 bp, Human
ggacctagggctccaaagggtctttctgctgctgcctctgggccaagcagaggtgggagaagcccccgggctggagtggcctgctatggtcctggagacagggttcctggggccagctgggaaaccccagtccaatctcaggggtccagtgagagccctaggctggccagtgtgcccggcagaaactagctcaaagcaattttcttcccagctggtaggagagataaaggtttgtgtgtggaagggtgagagtcatccatctggcctcctgggatcttcttcctccccacgagatggggcrgcacgtctagttcagaggcctgactcaaggcctcctggggcctctgcctcccccagagaaaggccaggaccagcgcctgaccagttctgggtgcccaagagggtggcctggccagggtggcagtggggacaggagccctgggcctgagctcccaggatgcataatgtggggacgtgaaagacaagcttagctccaacccacgactcaccctgtccagccactggcatctctgccaactcctacaaaagaccacagccctcaggccctggaggagtaaggtcagcccctgggaggctgagg

SEQ ID NO: 173025 - DNA, 601 bp, Human
accttgccaaggcagatgggagctggggactgggccccagggagccacagcttcagagaacatcattatgtgcctcacaagtggggaaactgaggcccaaaggaggaaagagactcatagagggacttgaaagaggagattagggcagggttttctgtactaaatactctcctcagctctcatgtggacctagggctccaaagggtctttctgctgctgcctctgggccaagcagaggtgggagaagcccccgggctggagtggcctgctatggtcctggagacagggttcctggggccakctgggaaaccccagtccaatctcaggggtccagtgagagccctaggctggccagtgtgcccggcagaaactagctcaaagcaattttcttcccagctggtaggagagataaaggtttgtgtgtggaagggtgagagtcatccatctggcctcctgggatcttcttcctccccacgagatggggcggcacgtctagttcagaggcctgactcaaggcctcctggggcctctgcctcccccagagaaaggccaggaccagcgcctgaccagttctgggtgcccaagagggtggcctggccag

SEQ ID NO: 173026 - DNA, 601 bp, Human
cttcacgttccgtgagctacaacaaggtcttcagaatcagctaacataaaccttgccaaggcagatgggagctggggactgggccccagggagccacagcttcagagaacatcattatgtgcctcacaagtggggaaactgaggcccaaaggaggaaagagactcatagagggacttgaaagaggagattagggcagggttttctgtactaaatactctcctcagctctcatgtggacctagggctccaaagggtctttctgctgctgcctctgggccaagcagaggtgggagaagccccygggctggagtggcctgctatggtcctggagacagggttcctggggccagctgggaaaccccagtccaatctcaggggtccagtgagagccctaggctggccagtgtgcccggcagaaactagctcaaagcaattttcttcccagctggtaggagagataaaggtttgtgtgtggaagggtgagagtcatccatctggcctcctgggatcttcttcctccccacgagatggggcggcacgtctagttcagaggcctgactcaaggcctcctggggcctctgcctcccccagagaaaggcca

SEQ ID NO: 173027 - DNA, 601 bp, Human
ctcacacctcggagggagggaggaggcatggctggagaggctcgggagggagtctgctgacccagatcgcccaggatggaggcaagaggcttgcatcctccaagatggtggcccacctgcgctgactcacaagactgcctgactgccaccaacacttaggagatctcctgggggcctggtctgggcccggctgggggaggcagtagaagcctggggtcaggagtctagcttcttgcagtgccaggcagcctggggcaagctttccccagtctgtgggaggcaagctccctagccccaaccragggcatcctccttcacgttccgtgagctacaacaaggtcttcagaatcagctaacataaaccttgccaaggcagatgggagctggggactgggccccagggagccacagcttcagagaacatcattatgtgcctcacaagtggggaaactgaggcccaaaggaggaaagagactcatagagggacttgaaagaggagattagggcagggttttctgtactaaatactctcctcagctctcatgtggacctagggctccaaagggtctttctgctgctgcctctgggccaagcagaggtg

SEQ ID NO: 173028 - DNA, 601 bp, Human
tccacttctcgcagatgccaagcacctgattctgagatgaggcaatcaaggtctacaggatgaggggactcatcagaggccacacagcagccccagctggccttctgcctccagcccctctttggccacttcaggctgccaagggagaggagagacttctgggatgggtcactggagtgctgagccttgcagggtaacgtccaaagaagggtaaccatggtttctaacaatagcctccatgcctggaacaagctcacacctcggagggagggaggaggcatggctggagaggctcgggagrgagtctgctgacccagatcgcccaggatggaggcaagaggcttgcatcctccaagatggtggcccacctgcgctgactcacaagactgcctgactgccaccaacacttaggagatctcctgggggcctggtctgggcccggctgggggaggcagtagaagcctggggtcaggagtctagcttcttgcagtgccaggcagcctggggcaagctttccccagtctgtgggaggcaagctccctagccccaaccgagggcatcctccttcacgttccgtgagctacaacaaggtcttcagaat

SEQ ID NO: 173029 - DNA, 601 bp, Human
gtgggggcacatccattcaggttagggggtgccctagatttgaggacactcacctcacctgcaccactctccagcacctgggaagtggttgccgagaacaaggctggacgttgctgggagaggctgctaaacactggtgtgtccccactgttggctggggccacaggccaccggagagtcagttgcaccaggcaaatatttgccttgctctttatatttcattagaactccctcttacgatgttggttctgactgcaggggttgagcaccttcatttccaggccactacaagccttgcccrtcaggcggtccaggcagctcactctgccacacatggaacttggggaagccctgctctcactccttctgcagtttctcaactgcagtgcaaggacagagccactgccttttccaccccgagcctcagtttcctcatctgtggaatgggtaattgccagatctcagggctatcatgggggtcaggtgagatcatatccaccactagcacatggtaggcactcaggacatgttggttcctttccttccctctctttcccagccctcccaacaaagagttgatttctcagtcccaaggagaggc

SEQ ID NO: 173030 - DNA, 601 bp, Human
tcctgtcttggctcaaaagccacttccatggaaaggaaggacactggatccctgtgtgtgacacagccaagggctctcccttcccattctcactgtgactctttgccctgatgaatttccttcctggagttctcactatctgaaatgacattcactgacttgcgtgctgctgcacgaggcagggctcctctctacttctcacttctgtgttcctccatgcttagcacaagcaggcatcaaaaatatctgctgattgcctgaataaatgcgcgtacatctaaatgaatgagtgggtaccatrtgggagctcaaggaagcctccgggcatggctagaaagagtcccagactgtcacaggccacagtaactgctcctttggacagatcacgctgggccttaaagacagagcatcgaaggtggcatgttttcctgcaatgacctcctttccttctgtatcgcctttatcttttcattactccttttcttctaagatcaggtccttgtctaattgtgcctttatcgtgatctcagcaatgaacacggcacagagcatgtggtaaggtttcaggaactgagaagggcttcgtgatgaaggtgaaggc

SEQ ID NO: 173031 - DNA, 601 bp, Human
ttagaaaaccacaccagagcacagcccacctcccttctcttccctgactgtgccccccagcagaggaccctggcccacagccaagccacatccatgccactcctgcgaacagccacttgtaagtgggtcaaggggtgggcacagaggcagaatggtcccctcaggacatcctgggaacggccctgcacaggccttgacagcaagcttagaggtgtctgcgccaggaatgctgggtacccaagtgtggtcaagaaagagttgcaaagagcccccagactcctcactgtggggagaggagccytccggagtgggggccagtggggcccttctttcctgggtctcggggaagtacccttagaaagacccaaatgtctatgccatgtcccctggaagtcagcctgtgtcagtgcccaagaaagcccccctccctatgggggtcagggaggaaagtcttgcccttgcttgcccagagctcatagtctggctggggaaggaagccgcacccaggaaagggacttgggaacatgtatatagaaacccagcaacagaggaaggcaagcagggcacaatggggaggtgagtagagaggctggtccaggct

SEQ ID NO: 173032 - DNA, 601 bp, Human
aaagaaaatatattctattctcctaccttgacagaaggcaccatcgtaatgccctggagggccagacttgaaatgagaactcttagaaaaccacaccagagcacagcccacctcccttctcttccctgactgtgccccccagcagaggaccctggcccacagccaagccacatccatgccactcctgcgaacagccacttgtaagtgggtcaaggggtgggcacagaggcagaatggtcccctcaggacatcctgggaacggccctgcacaggccttgacagcaagcttagaggtgtctgygccaggaatgctgggtacccaagtgtggtcaagaaagagttgcaaagagcccccagactcctcactgtggggagaggagccttccggagtgggggccagtggggcccttctttcctgggtctcggggaagtacccttagaaagacccaaatgtctatgccatgtcccctggaagtcagcctgtgtcagtgcccaagaaagcccccctccctatgggggtcagggaggaaagtcttgcccttgcttgcccagagctcatagtctggctggggaaggaagccgcacccaggaaagggacttg

SEQ ID NO: 173033 - DNA, 601 bp, Human
tgaatttggggtctctggtccattttctgtggctggtcatgttcaggcacctgtatcctaagaccgtgaggctctccccagcaggtccctgagcaccagagcccccagcaccagccggggggaagatcccacttttgcctccttaattaacacttaggtgaatgtgacatgtctatgaccctgggcaaatcctaacctttctatgtcttggttgaccaggatgccactagctccccagctcacccaaccccctggtgtctgagctaagacaccaggggtttggggagggcgagtgacacarcaccattcacggtctcagagccggccatcctccacacctgcctccccaccaccacaactcagcctccccctcaaacaagctagacatctgccccctgttttacaagattgcttgtgaattaaactagctagcaaagtgctctctgcacaccagtcatagacgcaagggtggggccattattattaagctccttctcttcccagctgctagggactgcacctttgtgtccctcccaaattcctacgttgaattcctaaccctcgaggtgatggcatttggaaatgaggccttcggaaggtc

SEQ ID NO: 173034 - DNA, 601 bp, Human; identical to SEQ ID NO: 32297

SEQ ID NO: 173035 - DNA, 601 bp, Human; identical to SEQ ID NO: 32298

SEQ ID NO: 173036 - DNA, 601 bp, Human; identical to SEQ ID NO: 32299

SEQ ID NO: 173037 - DNA, 601 bp, Human; identical to SEQ ID NO: 32300

SEQ ID NO: 173038 - DNA, 601 bp, Human; identical to SEQ ID NO: 32301

SEQ ID NO: 173039 - DNA, 601 bp, Human; identical to SEQ ID NO: 32302

SEQ ID NO: 173040 - DNA, 601 bp, Human; identical to SEQ ID NO: 32303

SEQ ID NO: 173041 - DNA, 601 bp, Human; identical to SEQ ID NO: 32304

SEQ ID NO: 173042 - DNA, 601 bp, Human; identical to SEQ ID NO: 32305

SEQ ID NO: 173043 - DNA, 601 bp, Human
gggaaggaaccatgcaggtatctcaggaagagcttcctccaggcaggaagatcagcaggtggaaaggccctggagccaccattcagtaaacatcatttgagcatctctaccagctaggttccattatgggaatgggaatatggtggtggacagggctgcctggtcccttccatacttctcacactagggtggttgagagagcttgggagctaacgaacaagatgggctgagaacactgcctagcccagaggacctgagcttagtgtgtagacattgctgctgttactgcctttgtcattgtattatttatttatttatttatttatttttagacagagttttgctcttcttacccaggctggagtgcaatggcgtgatctcagctcactgcaacctccacctcctgggttcaagcgattctcctgcctcagcctcctgagtagctgggattacaggcacccgcaccacgcctggataatttttttgtatttttagtagagacagggtttcaccatgttggccaggctggtctcgaactcctgaccttaggtgatccacctgcctcgacttcccaaagtgctgggattataggcatgagcca

SEQ ID NO: 173044 - DNA, 601 bp, Human
gaaggaaccatgcaggtatctcaggaagagcttcctccaggcaggaagatcagcaggtggaaaggccctggagccaccattcagtaaacatcatttgagcatctctaccagctaggttccattatgggaatgggaatatggtggtggacagggctgcctggtcccttccatacttctcacactagggtggttgagagagcttgggagctaacgaacaagatgggctgagaacactgcctagcccagaggacctgagcttagtgtgtagacattgctgctgttactgcctttgtcattgtattatttatttatttatttatttatttttagacagagttttgctcttcttacccaggctggagtgcaatggcgtgatctcagctcactgcaacctccacctcctgggttcaagcgattctcctgcctcagcctcctgagtagctgggattacaggcacccgcaccacgcctggataatttttttgtatttttagtagagacagggtttcaccatgttggccaggctggtctcgaactcctgaccttaggtgatccacctgcctcgacttcccaaagtgctgggattataggcatgagccact

SEQ ID NO: 173045 - DNA, 601 bp, Human
cctgggttcaagcgattctcctgcctcagcctcctgagtagctgggattacaggcacccgcaccacgcctggataatttttttgtatttttagtagagacagggtttcaccatgttggccaggctggtctcgaactcctgaccttaggtgatccacctgcctcgacttcccaaagtgctgggattataggcatgagccactgcgcccagtgattatagaaagttaaaggcacatggcaatgcacacgcctatctacgtcttccctgccaaagcaaagggcagcctctgggctcactttctygcgtttctacttccaaaaggcagtcagaactggcagggccttggagaccacttcatccacctcctagggtccctatgggagagttgaggtccagagcagggaagggtcctgacaggctctgaccagggcctctgatccctacaaacccccaatcggtgtccctctctaccaggacccaagcccacctgctgcagcccactgcctggccatgaccatcacttacacaagccaagtggctaatgcccgcttaggctccttctcccgcctgctgctgtgctggcggggcagcatctacaagct

SEQ ID NO: 173046 - DNA, 601 bp, Human
catgcacagcccacatggtacattttttaaaattattttttaattaaaatgtttatctaaggccagtagcagtgactcgcgtctgtaatcccagcactttgaggggccaaggtgcggggatcacttgagcctgggagttcagcgtgggcaacatagtgagaccccgtctctaccaaaaatttaaaaaattagctgggagtggtggcatttgcctgtggtcccagctacttgggaagctgaggtgtggggatggctgaagcctgtgaggtcgaggctgcagtgagctatgatcacaccactrcacttcagcctgagtgacaggctatctcaaaagcaaacaaaataatgtttatctaaacaataaaatataatcacagaatatatgatagcattttaaattgaaaaagcattaatgattacatggattgtaaaatatcaaatacatgaaattcttgtgttcttaataatgctagcaacaaggcacatttggtttttactagggcaccaaggtactttaaaaaaagttagggccagccacaggggctcacacctgtaatcccagcactttgggaggccaaggcaggaggatcacttgagccca

SEQ ID NO: 173047 - DNA, 601 bp, Human
gttcaagaccagcctggccaacatagtgaacccaatctctactaaaaatacaaaaattagccgagtggggtggcacgcacctgtagttccagctactcaggaggatgaggccggagaatcgcttgagcccgggaggcagaggctgcagtgagccgagaccatgccattgcactccagcctaggtgacagagtgagactccgtctaaaaataaaataaaaatcaaaaaatgatctgggcatggtggcttatgcctgtagtcccacccagctcctcaggaggctgaagcgggaggattgcttsagcccaggaggttgaggctgcagtgagtcatgactgtgccgctgcccttgagcctgggtaacagagcaagaccctatctcaaaacaaacaaacaaacaaacaaacaaacaaaaaccaataaaccaaaaacatttatctaaacaataaaataaaggacagatataatcaccgaatatatgatagcattttaaattgaaaaagcactaatgactacaatggattataaaacatcaaatacataaaattcttaagttcctcctaataccaaatacaaagcacattggtctttggtttttactt

SEQ ID NO: 173048 - DNA, 601 bp, Human
ctaaaaatacaaaaattagccgagtggggtggcacgcacctgtagttccagctactcaggaggatgaggccggagaatcgcttgagcccgggaggcagaggctgcagtgagccgagaccatgccattgcactccagcctaggtgacagagtgagactccgtctaaaaataaaataaaaatcaaaaaatgatctgggcatggtggcttatgcctgtagtcccacccagctcctcaggaggctgaagcgggaggattgcttcagcccaggaggttgaggctgcagtgagtcatgactgtgccrctgcccttgagcctgggtaacagagcaagaccctatctcaaaacaaacaaacaaacaaacaaacaaacaaaaaccaataaaccaaaaacatttatctaaacaataaaataaaggacagatataatcaccgaatatatgatagcattttaaattgaaaaagcactaatgactacaatggattataaaacatcaaatacataaaattcttaagttcctcctaataccaaatacaaagcacattggtctttggtttttacttgggcaccaatgcatgctgaaaaagagtcagacttcattttt

SEQ ID NO: 173049 - DNA, 601 bp, Human
cagagcaagaccctatctcaaaacaaacaaacaaacaaacaaacaaacaaaaaccaataaaccaaaaacatttatctaaacaataaaataaaggacagatataatcaccgaatatatgatagcattttaaattgaaaaagcactaatgactacaatggattataaaacatcaaatacataaaattcttaagttcctcctaataccaaatacaaagcacattggtctttggtttttacttgggcaccaatgcatgctgaaaaagagtcagacttcattttttagagtagttttaggttcacrgcaaaattgagcagaaggtagagttctcatgtgtctctttgctcctccccctgcccccagcctccccactatcaacacccccacactacagtggtagatttattacaatccctgaacccacagtgacacatcactatcacccaaagttcatagcgtacagcagggttcactcttgggctgtacattccatgggtttggataaatgtgtaatgatgtctccaccatcacagcatcaggcagagtagtttcactgctctaacaaaatcctctgcctattcacccctctcattaaagccaaac

SEQ ID NO: 173050 - DNA, 601 bp, Human
cccagcacctggtgcaagcaggtgggcggaccgggagcaacggggaggcaccgggcagagccaggggccgagatgggcgcggcaggaatggaagatgggtggagccaaagtcccccggactcgggggattgggtggagccaggagtggggtgtggtcaagatttgggggtccaattgggcgggacagagtcgggtgtctgaaggtggggcgaggccaggagcccaccctccgagagtaggagtctgaggcagggctaaggacccttgagggataatggaaagaagggtgacggcttgggawctggtgaggtactagggtctacttccctctgcccttgcccctcttgatctccggtttccactctggaggtatgggacattggtctctgacaccccctcagcctggcctgacctggtcctggttaataagacagacccaggctaggcgtggtggctctcgcctgtaatcccagtgctttaggaggcaaaggtgggaagatcgcttgagcccagctgtttgagacgcccctgagcaacatagcgagacccccatctctacaaaaacattaaaaattagcagggcatggtggcgtgtgcctgt

SEQ ID NO: 173051 - DNA, 601 bp, Human
gcgtgtgcctgtagtctgaggctgagtatcgggaggctgaggcaggaggatcacttgagcccagcagttccaggctgcagtgcgctaagatcgcaccgctgcactccaacctcggtgacagagccagaccctttctctggaaataaataaataccctgcccacatgctcagcccagaacagcacctagtaggtgctcagaaatttttttgttgttgaaagaaagaggatggcaaaggagtgctgaggttcctataggtcagcaggtgccggccatcccttctgcaggttctcccacccacygccttcttcactccactctgcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgtgagcccactgtacagacagggctgccgcagagtgggaagggttgtggtccacaggaaacaaggtttcctacaaagagaagccttgggcccctgagggtcttccgagagccggaggtgggg

SEQ ID NO: 173052 - DNA, 601 bp, Human
cccacccaccgccttcttcactccactctgcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgtgagcccactgtacagacagggctgccgcagagtgggaagggttgtggtccacaggaaacaaggtttcctacaaagagaagccttgggcccctgagggtcttccgagagcckgaggtggggttgcagaatcttttccaacagcaatccacagcccgaggtggtcccttctcagaggcccctccctcttctccaagtctgtgaggtcctggttcccttttgatagatgaggaagctgagacacaaagaggtttagtgagcttcccatggccacacagccaggaatggaccataggtaccaggccctggtacctggagaagaggtgggggcgagcccagggtgggggcaggtggtgttcagaaccccatccccctcttctgccccccaggagatgaacaccttgcgtactcagt

SEQ ID NO: 173053 - DNA, 601 bp, Human
cgtactcagtgtggacacctgtatgcctacgactggattagtatcccactggtgtatacacaggtgaggactaggctggtgaggctgcccttttgggaaactgaggctagaaggaccaaggaagcagctggggtgggaagggctcacctagaggctaagtggctcccctgggagttgggtccacactttgaagttgggtctggactttgaagtgccaagttctaagagtccaggctcctgcctggcccagtccagtagaggcaatgtgattatccccatattaaagagaggttggccgggyacagtggctcatgcctgtaatcccagcactttgggaagctgaggcaggtggatcacctgaggtcaggagttcgagaccagcctggccaacatggtgaaaccccatctctactgaaaatacagaattagctgtgtggtggtgcacgcctgtaatcccagctacttgggaggctgaggcaggagaatcgcttgaacccgggaggtggaggttgcagtgagctgagatcatgccactgcactccagcctgggcgacacagcaagactctgtctcaaacaaacaaacaaacaaacaaacaaaca

SEQ ID NO: 173054 - DNA, 601 bp, Human
gtactcagtgtggacacctgtatgcctacgactggattagtatcccactggtgtatacacaggtgaggactaggctggtgaggctgcccttttgggaaactgaggctagaaggaccaaggaagcagctggggtgggaagggctcacctagaggctaagtggctcccctgggagttgggtccacactttgaagttgggtctggactttgaagtgccaagttctaagagtccaggctcctgcctggcccagtccagtagaggcaatgtgattatccccatattaaagagaggttggccgggcrcagtggctcatgcctgtaatcccagcactttgggaagctgaggcaggtggatcacctgaggtcaggagttcgagaccagcctggccaacatggtgaaaccccatctctactgaaaatacagaattagctgtgtggtggtgcacgcctgtaatcccagctacttgggaggctgaggcaggagaatcgcttgaacccgggaggtggaggttgcagtgagctgagatcatgccactgcactccagcctgggcgacacagcaagactctgtctcaaacaaacaaacaaacaaacaaacaaacaa

SEQ ID NO: 173055 - DNA, 601 bp, Human
ttccttggggtcagcccaaagctgtcacaaaatcagatatttccctttattccagatttcctggacactttcacccaattataaacaccccacttcagccccaatcacgtgggaggaagtgtaacttcccttttctggattctcaagcagttactttcacggtcagaacacgcagctattatgattgaaaacttaaaagggcaacaatttcagtcttgcttctagggctagacaggaacttggcaaacatctgtggcctgttcagcaaaggatgttaatatttaagaatcttgtcttgggmtgggtgtggaggcaagtggatcacaggaggtcaggagtttgagaccaacctggccaacatgatgaaaccccatctctaccaaaaaaaatacaaatcagctgggcgtcgtggtgtgcctgtagtcccaacgcaggaggttgaggggagaattgcttgaacccaggaggtggtggttgcagtgagattgagcaactgcaatccagcctgggcgacggagtgagactgtctcaaaaaaaaaaaaaaaaggatcgtctcaacctttgccctcctactgcaacattttggtatttgaaatgaagg

SEQ ID NO: 173056 - DNA, 601 bp, Human
gacaggaacttggcaaacatctgtggcctgttcagcaaaggatgttaatatttaagaatcttgtcttgggctgggtgtggaggcaagtggatcacaggaggtcaggagtttgagaccaacctggccaacatgatgaaaccccatctctaccaaaaaaaatacaaatcagctgggcgtcgtggtgtgcctgtagtcccaacgcaggaggttgaggggagaattgcttgaacccaggaggtggtggttgcagtgagattgagcaactgcaatccagcctgggcgacggagtgagactgtctcaaaaaaaaaaaaaaaaggatcgtctcaacctttgccctcctactgcaacattttggtatttgaaatgaaggtaccttccatacttatgctgttaatactttcattctcactagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcc

SEQ ID NO: 173057 - DNA, 601 bp, Human
ctgctgggtgcggtggctcagcctgtaatcccagcactttgggaggccgaggcaggcggatcacgaggtcagcagatcgagaccatcctggtcaacatggtgaaaccccgtctctactaaaaataaaaaaaaatagctgggcgtggtggcgtgcgcctgtaattccagctactcaggagcctgaggtaagagaatcacttgaacccaggaggcggaggctgcagtgagccgagatcgcgccactgcactccagcctgggcgacagagcgagactctgtctctcacacacacacacaaattraaaacccccatgcaaggtggcaaatgtggacagtatgttgatgtaaacatacttttataatagttatatcacaaaaatttgattttcagttttagacatttgatgtagtcaagtgtttgtgaaaggcagtgacagtcacagaaatacaggcctgttttcaaatccatttggaacacatttattcttgggatagtttggacaatcacaaggcaattctaaggaagactcccacgacactgcctaagaccaagatttgggaaaattgattccactgatcactgaaaaatttcttgcccagta

SEQ ID NO: 173058 - DNA, 601 bp, Human
ccagtgtcagaattcattgtctgatgagagggcgctggagtactgaccctgcacttagtccttttctcctccctgctcctgtattaaccatgttaaagcatggttaaaactgagctcaggagtctgccagctgtaccacatatttatttataaaattaaaaacccctgctgggtgcggtggctcagcctgtaatcccagcactttgggaggccgaggcaggcggatcacgaggtcagcagatcgagaccatcctggtcaacatggtgaaaccccgtctctactaaaaataaaaaaaaatasctgggcgtggtggcgtgcgcctgtaattccagctactcaggagcctgaggtaagagaatcacttgaacccaggaggcggaggctgcagtgagccgagatcgcgccactgcactccagcctgggcgacagagcgagactctgtctctcacacacacacacaaattaaaaacccccatgcaaggtggcaaatgtggacagtatgttgatgtaaacatacttttataatagttatatcacaaaaatttgattttcagttttagacatttgatgtagtcaagtgtttgtgaaaggcagtgacag

SEQ ID NO: 173059 - DNA, 601 bp, Human; identical to SEQ ID NO: 29329

SEQ ID NO: 173060 - DNA, 601 bp, Human; identical to SEQ ID NO: 29330

SEQ ID NO: 173061 - DNA, 601 bp, Human; identical to SEQ ID NO: 29331

SEQ ID NO: 173062 - DNA, 601 bp, Human
aacagtgatgaaataaaagctttctgtatcccagccgggcgtggtggctcacgcctgtaatcccagcactttgggaggccgaggtgggtggatcacgaggtcaggagttcgagaccagcttggccaacatggtgaaaccccgtctctactaaaaatacaatatgccgggcgtggtggcgcgtgcctgtaatcccagctactcgggaggctgaggcaggagaatcgcttgaacctgggaggtggaggttgcagtgagccaagatggcgccattgcactccagtctgggtggcagagcaagaytctgtctccggcggttggtggggagtaaagttttctgtatccatactgtcctctaggttacaaaagactagagcaggccgggagtggtggctcatgcctgtaatcccagaactttcggaggctgaggcaggaggaatgcttgaacccaggactttgagaccagcccgagcaacatagtgagaccctgtctctatttttaaacaaataataataaataaaatagatacttttttaaaaaaagaccagagcaggcatccacaagactccttgaagggaggccagggctcagccaggcctttg

SEQ ID NO: 173063 - DNA, 601 bp, Human
atgttaagtcagtaattccacttgggaggaaccccagcatgggcctggcaccaggcaggaaacagtgatgaaataaaagctttctgtatcccagccgggcgtggtggctcacgcctgtaatcccagcactttgggaggccgaggtgggtggatcacgaggtcaggagttcgagaccagcttggccaacatggtgaaaccccgtctctactaaaaatacaatatgccgggcgtggtggcgcgtgcctgtaatcccagctactcgggaggctgaggcaggagaatcgcttgaacctgggaggyggaggttgcagtgagccaagatggcgccattgcactccagtctgggtggcagagcaagattctgtctccggcggttggtggggagtaaagttttctgtatccatactgtcctctaggttacaaaagactagagcaggccgggagtggtggctcatgcctgtaatcccagaactttcggaggctgaggcaggaggaatgcttgaacccaggactttgagaccagcccgagcaacatagtgagaccctgtctctatttttaaacaaataataataaataaaatagatacttttttaaaaaaa

SEQ ID NO: 173064 - DNA, 601 bp, Human
tggctgcgaatcaatgagaaaactgtgtgatggaagtctcaggatcccaagctaaatgttaagtcagtaattccacttgggaggaaccccagcatgggcctggcaccaggcaggaaacagtgatgaaataaaagctttctgtatcccagccgggcgtggtggctcacgcctgtaatcccagcactttgggaggccgaggtgggtggatcacgaggtcaggagttcgagaccagcttggccaacatggtgaaaccccgtctctactaaaaatacaatatgccgggcgtggtggcgcgtgccygtaatcccagctactcgggaggctgaggcaggagaatcgcttgaacctgggaggtggaggttgcagtgagccaagatggcgccattgcactccagtctgggtggcagagcaagattctgtctccggcggttggtggggagtaaagttttctgtatccatactgtcctctaggttacaaaagactagagcaggccgggagtggtggctcatgcctgtaatcccagaactttcggaggctgaggcaggaggaatgcttgaacccaggactttgagaccagcccgagcaacatagtgagaccc

SEQ ID NO: 173065 - DNA, 601 bp, Human
gtttttaaaacagatattattggctgcgaatcaatgagaaaactgtgtgatggaagtctcaggatcccaagctaaatgttaagtcagtaattccacttgggaggaaccccagcatgggcctggcaccaggcaggaaacagtgatgaaataaaagctttctgtatcccagccgggcgtggtggctcacgcctgtaatcccagcactttgggaggccgaggtgggtggatcacgaggtcaggagttcgagaccagcttggccaacatggtgaaaccccgtctctactaaaaatacaatatgcygggcgtggtggcgcgtgcctgtaatcccagctactcgggaggctgaggcaggagaatcgcttgaacctgggaggtggaggttgcagtgagccaagatggcgccattgcactccagtctgggtggcagagcaagattctgtctccggcggttggtggggagtaaagttttctgtatccatactgtcctctaggttacaaaagactagagcaggccgggagtggtggctcatgcctgtaatcccagaactttcggaggctgaggcaggaggaatgcttgaacccaggactttgagaccagcc

SEQ ID NO: 173066 - DNA, 601 bp, Human
gccaccgcccgggatgggatgcctggggcctgggctcaactacacagggcactgggctggcccaacccctggtctaccctgtgggttcatcatggacaaagactgattgcaccatcccagcaacctcacagtccctttggcctgaatggaccaagtatttctggcaactctagtccaggctgtggggccttgagggagctaagagacagcctaaagtgtccctttcctacttcagataggaccgtaaccaaataaggtcacccaggaaaggggtagccgtgcagggctgtcccaccatacrctgcagtttgcagggcacgctcacacttaggggccagcagcatttaccgaatacaaactactacatggcagccctgggccatgggcttgaggagacacagtcctgccctcagccagctcactgtctgccccagctctccccactttacagatgagtaaactggggcacagaggagtgacatgcctgcttcaaggtcgctcagtgcctccaatagcagagctggcacccggccccaaggagcagagagatgttttttgtttgtttgtttgagacggagttttgctcttgttgcccaggctg

SEQ ID NO: 173067 - DNA, 601 bp, Human
tgagccagcccggccgcctctagacctcactgccaggccctctctccactgctctctgctgcagccatactgtattcctggaacacaggacgcacggtcccacctctgagcctttgctctagctgatccctctgctgtgaactcattccctgtagaagttttgctcacagctacatcttcagaggtgagaaccatgcatgacacagagaagatgctcactgatggatttaatgagtcaaacattgaagaatcaatgagtgccggaaataaacaggataggtggcagcatagcatgcccttragaacatggctgtggattcaaatcccagaccaatcactgaatttcaagccactttgcctctctgagcctctgttttctcatctgtcaagtggcaataacaataaatggtacgtgcctcataggggcaccttgaggattaaaagagagggtttcaataaatcaagtactgatttcaaaacctggcacatagtaggcactcagcacatggcccttatatacttatggccagcagcggctgggcctcatccctccctggctggctccactagtatcaggctgcctatgactctcagacaaacc

SEQ ID NO: 173068 - DNA, 601 bp, Human
taaacactaattctccattctctcctccccctgccccggcaaccaccatgctaccttctgtccatacagatctgcctcctccagaaacctcatctgggagaaatcacatgtttgttcctttgcctctggcttgtttcactcagcacaatgtccttaaggtccatccatgttgcagcacgtgtcaggatgtcctacctttttaaggctgagccagcgtgatggtgagtccctctttctcctttgaaactccccagacacacacgcacatgcagacacacccaccagcccacaccagcaggcmtcactcagacactcagaaacatgcccacaatcacggcccacatgaacactcagccaaacacagccttgcacacatggtacgcaaagatgcagctggcacgcacagacacacccggcgcaacgtgcaagctgtggctgcggccccagaatctcctccctcccagcccttccctctatcaccccatgtcagttctggggccaccttattgagctgaggatcttgggtccagattggtctcctcgcctcctttcccgttggtcctgattcacccaggccagccctgtcgaggcactgacaggg

SEQ ID NO: 173069 - DNA, 601 bp, Human
gagacagagtcttgctctgtcgcccagactgggttgcagtggcatgatctcggcttactgcaacctccacctcccaggttcaagagattcttgtgccttagcctactgagtaggtgggattagaggtgcaagccaccacaccaggctaatttttgtatatttcgtagagtcggggtttcaccatattgcccaggctggtgttgaactcctgagctcaagcaatcctcccgccttggcctcccaaagtgttgggattacaggcataagccaccacgcccagccaattttttaaaaattgtartaaaatatacatgaaatttaccattgtaagcatttttaggtgtccagctcagtggtattaagtgcatgcacagtgttgtccaaccatcaccatcatccagctccagaaccttttcaccttccccaactgaaactctgtccccattaaacactaattctccattctctcctccccctgccccggcaaccaccatgctaccttctgtccatacagatctgcctcctccagaaacctcatctgggagaaatcacatgtttgttcctttgcctctggcttgtttcactcagcacaatgtcctta

SEQ ID NO: 173070 - DNA, 601 bp, Human
tgagctggagcactggctggtggtgaagcctcctctccctcccaaaaggtatggggtgggtaagacgctacagccaggagagaaatcagttcatcaaaatcctccttttgatggggacactgggcgacaacagggagggagcttgcctcgggatccaaacgagtgcctggctaaaccagatctggagccctggacttctcagggcatccctacagcttcactttcaactgcctgccccctgggaggggagggcaggctcacccctggctctgcatccccttgggcgaatgccgagggagckgctcctggccatgtggcaatgtctcccagccctccagccatccccctccctcaggggctgagcctctcctagggctctggctcacattcaggggtccatcctggctgggttcttccggagccagctctccaatcaacaggggctgtaggaacttgcgcacaaaattgagatcttgatggaaggcacggaaggcatcctgaaggagagcagacagtcaggcggacagacagacacagctgagtagcacagcggcaaccagcagagacaggcggaaggactacggatggatgggcagagcag

SEQ ID NO: 173071 - DNA, 601 bp, Human
caaagaggaatgaagtgacaagagtacccagcccggggtgtgagctggagcactggctggtggtgaagcctcctctccctcccaaaaggtatggggtgggtaagacgctacagccaggagagaaatcagttcatcaaaatcctccttttgatggggacactgggcgacaacagggagggagcttgcctcgggatccaaacgagtgcctggctaaaccagatctggagccctggacttctcagggcatccctacagcttcactttcaactgcctgccccctgggaggggagggcaggctcasccctggctctgcatccccttgggcgaatgccgagggagcggctcctggccatgtggcaatgtctcccagccctccagccatccccctccctcaggggctgagcctctcctagggctctggctcacattcaggggtccatcctggctgggttcttccggagccagctctccaatcaacaggggctgtaggaacttgcgcacaaaattgagatcttgatggaaggcacggaaggcatcctgaaggagagcagacagtcaggcggacagacagacacagctgagtagcacagcggcaaccagc

SEQ ID NO: 173072 - DNA, 601 bp, Human
aagtgtgagcggagatccccattccctgtgggttcccttccctgggggcaggcagcgatgcgggctggagggtgggttgggagaacagctgaatgctcattctctggaatggaatctagaccgggttgacgggtgtcgggtaggggagctggagggcagccaaggccaagtccaggcatgagcctgggtgggcctgtccctcctgcacccagttctccattgctgcctcctgctgggcgctgcaacccaaggacagagaggacgtggaacctgcccacccgatcttgggcctgatattggkcagtggagccagaaatgtcaacaatctgctaggaagccctgtgccaggcgctctaaagggctgtgccaaatggcaggggctcagagcatcaggctgggagagatcatgaaggagaagtgggcatctgaacaccagcacaggaaggaagggcaaccaagtaaggggaacagcgtgtacaaaggcgcagaggtataagacctggaatctggcctctgttccccacctccaaggtgaccacaagggctgagccccatcacccctcgcctggatggctgcagtgtcctctgctctccttttcca

SEQ ID NO: 173073 - DNA, 601 bp, Human; identical to SEQ ID NO: 23821

SEQ ID NO: 173074 - DNA, 601 bp, Human; identical to SEQ ID NO: 23822

SEQ ID NO: 173075 - DNA, 601 bp, Human; identical to SEQ ID NO: 23823

SEQ ID NO: 173076 - DNA, 601 bp, Human; identical to SEQ ID NO: 23824

SEQ ID NO: 173077 - DNA, 601 bp, Human; identical to SEQ ID NO: 23825

SEQ ID NO: 173078 - DNA, 601 bp, Human; identical to SEQ ID NO: 23826

SEQ ID NO: 173079 - DNA, 601 bp, Human; identical to SEQ ID NO: 23827

SEQ ID NO: 173080 - DNA, 601 bp, Human; identical to SEQ ID NO: 23828

SEQ ID NO: 173081 - DNA, 601 bp, Human; identical to SEQ ID NO: 23829

SEQ ID NO: 173082 - DNA, 601 bp, Human; identical to SEQ ID NO: 23830

SEQ ID NO: 173083 - DNA, 601 bp, Human; identical to SEQ ID NO: 23831

SEQ ID NO: 173084 - DNA, 601 bp, Human; identical to SEQ ID NO: 23832

SEQ ID NO: 173085 - DNA, 601 bp, Human; identical to SEQ ID NO: 23833

SEQ ID NO: 173086 - DNA, 601 bp, Human; identical to SEQ ID NO: 23834

SEQ ID NO: 173087 - DNA, 601 bp, Human; identical to SEQ ID NO: 23835

SEQ ID NO: 173088 - DNA, 601 bp, Human; identical to SEQ ID NO: 23836

SEQ ID NO: 173089 - DNA, 601 bp, Human; identical to SEQ ID NO: 23837

SEQ ID NO: 173090 - DNA, 601 bp, Human; identical to SEQ ID NO: 23838

SEQ ID NO: 173091 - DNA, 601 bp, Human; identical to SEQ ID NO: 23839

SEQ ID NO: 173092 - DNA, 601 bp, Human; identical to SEQ ID NO: 23840

SEQ ID NO: 173093 - DNA, 601 bp, Human; identical to SEQ ID NO: 23841

SEQ ID NO: 173094 - DNA, 601 bp, Human; identical to SEQ ID NO: 23842

SEQ ID NO: 173095 - DNA, 601 bp, Human; identical to SEQ ID NO: 23843

SEQ ID NO: 173096 - DNA, 601 bp, Human; identical to SEQ ID NO: 23844

SEQ ID NO: 173097 - DNA, 601 bp, Human; identical to SEQ ID NO: 23845

SEQ ID NO: 173098 - DNA, 601 bp, Human; identical to SEQ ID NO: 23846

SEQ ID NO: 173099 - DNA, 601 bp, Human; identical to SEQ ID NO: 23847

SEQ ID NO: 173100 - DNA, 601 bp, Human; identical to SEQ ID NO: 23848

SEQ ID NO: 173101 - DNA, 601 bp, Human; identical to SEQ ID NO: 23849

SEQ ID NO: 173102 - DNA, 601 bp, Human; identical to SEQ ID NO: 23850

SEQ ID NO: 173103 - DNA, 601 bp, Human; identical to SEQ ID NO: 21429

SEQ ID NO: 173104 - DNA, 601 bp, Human; identical to SEQ ID NO: 21430

SEQ ID NO: 173105 - DNA, 601 bp, Human
tttgactttttaataatatgagcagttctttgatctgtctttccaaagaaaaaaatatggaagaatacgtaagggaatatttaatctagtggcctctgtgtaacttgatgactctagtatttggtatttgagaatccctggtatttgattagaaaagcagcaaaatactcatatagatttatatacagaaatttacagttgcaaaataatttaaactttatctaacttgagcctgcaggcagctcctgggagataggcagaacagagattttattattattatcattgctattagtagtartagggttattgttactacaatcatctgcaaggtgaggctgagcagtatccagtgacttgtctcagatcccagagttatgacgtggcagagccagaaccagaaggctgctctttcgacgtctagtccagagctctccctgctttactgacctcctccatgaatgctctgacttcacacatgtttctttccaggtaccttccaggtatgtaaggaaaggtgtttgggtagtttatttacagtcagaggcagcattggggtgggaaggacgctgagttggaatctggaggtggtatgtgatgt

SEQ ID NO: 173106 - DNA, 601 bp, Human
tgtctttgtagaatggatactttatccccagggtctcggcaggaggaggtgagggccatgatggtgaggccgagctgcccaatggttagatctgcagagaagagaacacaacggttagacagagacatcctcaggggacagctctccaggagccagtgatgagttctctgctttttatctagagcattttgactttttaataatatgagcagttctttgatctgtctttccaaagaaaaaaatatggaagaatacgtaagggaatatttaatctagtggcctctgtgtaacttgatgactgtagtatttggtatttgagaatccctggtatttgattagaaaagcagcaaaatactcatatagatttatatacagaaatttacagttgcaaaataatttaaactttatctaacttgagcctgcaggcagctcctgggagataggcagaacagagattttattattattatcattgctattagtagtagtagggttattgttactacaatcatctgcaaggtgaggctgagcagtatccagtgacttgtctcagatcccagagttatgacgtggcagagccagaaccagaaggctgctcttt

SEQ ID NO: 173107 - DNA, 601 bp, Human
atattagacacctattgattccagatttcaggatgcctaaataagttccagatagaggcagtaaaaagggtagggagagattatgtattctgacaagaaatccacatggcctgtggtatttggatgtagacagggtcctgccttttgataggaaaagctctaattcccaggtacagcttatcaaagtgtacttggcaggtgataaaatccaaacagaattcacaaaccaagttagcaaaagtaaacacttcactgtctggtgataaattgaagcaaggttatttttagagagtcacacataaaaaaaaaaaatccccaaaccatcttttatatctcttccagactgcctttttctttccaaaaagcttctagaccagagcactgggaatgttcttgtaaaattcagccatggaaaaaacagggttttgttctatgacaaagtctccttgactgtgacatagaaatgaactctatttttattagtcacttctatatgtggtccattgaagtggaaatttttttttttttgctcttatgtttaacatgaaccaattcttaggctgcttatatccttttctaatttttaatgtatgaaatctca

SEQ ID NO: 173108 - DNA, 601 bp, Human
aacttctttgggcctaagggttctatctgtaaaatgagaataactaaatatgtcttatggttttattgggtgcaagtatctgctatctactgcatgggttcttgacttaggtcatcacctctaagagatgactgtccaatttattttttgcatgtcctgacctcttttcctagtacttcctctatgcctccaaaagcctgcctttctgtttctttctttctttctttttctttctttctttctttctttctttctttctttctttctttctttctttctttctttctttctttctttcttccttccttccttccttccttccttccttccttcctttttctttctttctctttctttctctctctcaattccttctttccttccttttttttgttttttttttttttgagacagagtctcactctgtctcccaggctggagagcagtgggcacgatcttggctcactgcaacctccacctcccaggctcaagcaatcttcccgtctcaacctcctgggtagctgggaccacaggcacgcaccaccacgcctggctaatttttgtacttttagtagagatgaggtttcgccatgttggccag

SEQ ID NO: 173109 - DNA, 601 bp, Human
tctttactgcttcctctttttgcaaactataaacatgccctaaaagttaattttctcctctgtgatttatttctgtattttcccctaccttgagaggggcatggaaagaacatgagcatcagattcagtccaacctgggttccactctcaactctattagttacatgttatgtgatcttaggaatgttactaacttctttgggcctaagggttctatctgtaaaatgagaataactaaatatgtcttatggttttattgggtgcaagtatctgctatctactgcatgggttcttgacttargtcatcacctctaagagatgactgtccaatttattttttgcatgtcctgacctcttttcctagtacttcctctatgcctccaaaagcctgcctttctgtttctttctttctttctttttctttctttctttctttctttctttctttctttctttctttctttctttctttctttctttctttctttctttcttccttccttccttccttccttccttccttcctttttctttctttctctttctttctctctctcaattccttctttccttccttttttttgttttttttttttttgag

SEQ ID NO: 173110 - DNA, 601 bp, Human
ggaacagaaaaccaaatactgcatgttcttacttataagtgggagcaaaatgatgagaacacatgaatacacagaggggaacaacacacacaggggcctatcagagggtacaggttgggaggagggacaggatcaggagaaataactaatgggtagtagaattaatacctgggtgatgaaataatctgtacaacaaacccccatgacacagtttacctatgtaacaaacatgcaaatgtaccccaaacttaaaataaaagttaagtttaaaaaaaagagaaaatgggccaggtgtggcggmtcatgcctgcaatcccagcactttgggaggctgaagagggcagattgcttgagcccaggagttcgagaccagccttggcaatatagtgaaaccccgtctctaacaaaaatacaaaaattagccagtctcataacctgatctcaaaataaataaataaataaataaattttaaaaaagcaaacatacaaatgactaatgaatatgaaattacttcacttagaatgaaatgaaatgaaaatgaatggattttgaaaacacctattaataatcaaatttaaaaaatgtaaattcccccaaatg

SEQ ID NO: 173111 - DNA, 601 bp, Human
ggcctcccaaagtgaattactttctttttaaaaaaattctgggtgtttaaaaaatttttaatttttgtgggtacatagtaggtgtgtatgtttatggggtatatgggatattttgatagagacatttcttgggatgaaggtgatgggaaaactaataataataatgatgattaatatttttgaatacatgccatgcaaaaaacattgtacttaatcattctaagtatattatttccaatccttacaataacccaataaatgattaatgcaatttccattttaaagctgtggaaactggctyacagatttactactaatataatgcagctattaaataagagaaagagcttctagccaagtcctctgtgattccaagatctttattatatgctttgctacaactccacaaattctgactggcaagattttgctaaatacatgattgattctaagaaaaacatctcctccactgtaatattggataatgaagcatctttaccaacctatagccttggctgtactgtgactttatttgcctttacatgtctctgcatggtgacagttaacatcaggttaactaggtaacgtcatgcttagacca

SEQ ID NO: 173112 - DNA, 601 bp, Human
gctccttttagttaaccaatgcagcaaaatgaagatttttcatagaaaatatcacatatacagtttttggcagtctactaaaattgtttcaacttaactaacaaagagttaagtaagaaggtatcaggagaaaaagcacgaatagatccaaattctgaggaataatattcccaagactggcccaccaataaaataattatttctcaaaattttaaggtagccaattaaaaggcaaaagaacaactgttacgcctctaggacagaatttttcaaccttggccagataattctttgttttggyggctgtttggtatattataggaggttcagcagcatcccaggcctctactctctagatgccatagcacctccctcccttcagctgtgacaaccaaaaatgtctccagacattgccaaatgtcccctggggaggagaatcaaccctggttgagaaccatcactccagcagaaatactgcatgaagacgagaagcttgagacctctaggaaataggtgataatcaaatgacacagcataatgatgacaaacaaaatctgtgcataaaaggggcaaaaagaaagttccccaggcaggtgttctt

SEQ ID NO: 173113 - DNA, 601 bp, Human
tgcatcctcaagaaatgggtattagccacagcagaaaaaaagtggcaagtgttaatagggaactgacaaaagtctaggcagaaagagcagtgtgtacaaatgccctgagggaaaggacaggatgcctgaaggaaatcctaatgactagaacttgggatgcgtggggtagagcctcgcccatggggaggagttaccaagccccctaaggtatctggactatgatgaaagcaatgaagatccagtaaaggattttcagctgaggactgacatgactacatttgacatttttcaaaaatcactytgacaacagtgtagacagactggaggaagacatgacggggcagagaggtcagcccaaacaccatctttgccatggggatggtcatctgtctggtttgaatgagcgatttttgcttctgtgttccctaagcctttgtctgtgtcgtactttccataatactatcacagaaaataatgttttctacctgttttcatgtctgtctcttttaaactacacacttcttgaaaacagaaactatgatgtatttatctttgcatgtccccagtgcatctagcataggaatttgctcaaaaataactg

SEQ ID NO: 173114 - DNA, 601 bp, Human
ggctggtctcgaactcctgacctcaagtgatccgcctgcctcagcctcccaaagtgctgggatttttttacaggtgtgggccaccgcgcatggcaccagaagctgtttctaagcaggaactacattcctgagactgcaatgacatgcctttccagtccactttcccactactcccttcaaggcacctaatactccagacaagtggggtttcttttcaagcccccaataaactaattattattttaggtttatcctaaggctactcatggccttttcttatctgaaggtcaacctttttttcttttgagacagggtcttgctctcacccaggctggagtgcagtggtgagatcatggctcactgcagcctcaacctcccggtctcaagtgatcctcccaccttagcctcccaagtagttgggactacaggcacacataaccatgctggctaacttattactattttgttttgagagacagtctcgcttgttgtcaaggctggaatgtagtggcaccatctcgactcactacaacctctgcctccagggttcaagccattctcatgcctcagcatcctgagtagctggggctacaggctcgtg

SEQ ID NO: 173115 - DNA, 601 bp, Human
agggctttgctcagtagagcggctctaatatttaacccgcaaacaacccattctccttgtcaactgttcatgtctgtgagtggcagaaatcactgttttcatttcactaactgtaagctctttgagatgggaaccatgcctcttctgttgagtgctacatacccaagatccatcagtgactggcccacagaagactatcatcaaataggtgttggatgaataagttttttaaaaaagaaatgcaatgtattttagcacaagtatacccagagaggaaatcaggtatttaaaattcttggasaatgaaagaaacagtagtaaattataagtacagctatatcctgactagttataaaagttagtttccaccctggacaaaacaattgctaaatctcagttcagttctgcatcaggccaggattctgatttctcctctgaggctggataattgtgtttctgggagtgaagtgctcatgatgggggttgagagggggctgtgcatgctcttacctttctaattctgaagccagcttaaggcgaccaagtactggataaagcaagcatgtgtgtgtttatgtgtgtgtgccaggaattgggggct

SEQ ID NO: 173116 - DNA, 601 bp, Human
aaaagagggctttgctcagtagagcggctctaatatttaacccgcaaacaacccattctccttgtcaactgttcatgtctgtgagtggcagaaatcactgttttcatttcactaactgtaagctctttgagatgggaaccatgcctcttctgttgagtgctacatacccaagatccatcagtgactggcccacagaagactatcatcaaataggtgttggatgaataagttttttaaaaaagaaatgcaatgtattttagcacaagtatacccagagaggaaatcaggtatttaaaattcwtggagaatgaaagaaacagtagtaaattataagtacagctatatcctgactagttataaaagttagtttccaccctggacaaaacaattgctaaatctcagttcagttctgcatcaggccaggattctgatttctcctctgaggctggataattgtgtttctgggagtgaagtgctcatgatgggggttgagagggggctgtgcatgctcttacctttctaattctgaagccagcttaaggcgaccaagtactggataaagcaagcatgtgtgtgtttatgtgtgtgtgccaggaattgg

SEQ ID NO: 173117 - DNA, 601 bp, Human
tgaaacatcacattgcaatacggccactgacacccaaattctgcaaataagatgttaacatctcaggcatttactactcttaagctaatacttctgaaattgttagctgcaaagacaattaagcatgtagaagctttttaaaggtccttggtaaagatcaagactgatgtatcacttagtctccttttcgtttagggaccttctgcatattaaccatgaaattagaggtaacactgcaatttcttttctccctttacatatgttagaaaacatttatgaactttttttctggctaatttcyagtttgcactatgtttgctgcatttgtgtttctgagcaaaggtgaattcattaaagaagcagtctatattgcaatatttaagaactgtagctatacctcgtgaaagactagaacctggaaatggaaagccaccaggagctcagggagttatggtaagctctgtctcttgggagctacttgttttctctaactgctttgtgctttgatctctttttgtagagcagcttttactcttcagcacacacttggccaaacatggttgctctagttcaagaaagcattgagaagctctaccatact

SEQ ID NO: 173118 - DNA, 601 bp, Human
gcaaatatcatactcaatggtgaaacacttaaagactttcttctaagatcaagaacatggcaaggatgcccactttcactgcttctattcaacatagtactggaagttttagccagggcaatcaggcaagaaaaagaaataaaaggcatccaagatggaaagaaagagataaaattatctgtgtttgcagatatgatctcatatgtgaacatgctaagaattccaccaaaaaaagaaatcctgatagaattcataaatgaggctcaatggtgcccaggctggagtgcagtggcgtgatctyggctcgctacaacctccacctcccagccgcctgccttggcctcccaaaatgccgagattacagcctctgcccggccgccaccccgtctgggaagtgaggagcgtctctgcctggctgcccatcgtctgggatgtgaggagcccctctgcctggctgcccagtctggaaagtgaggagcgtctctgcccggccgccatcccatctaggaagtgaggagcgcctcttcccggccgccatcacatctaggaagtgaggagcgtctctgcccagccgcccatcgtctgagatgtggggaccgcc

SEQ ID NO: 173119 - DNA, 601 bp, Human
taagattcagatcttagctagccttgggaatgctatagaatccctatgtaaccttggttttccaggttgagatcaagaccaagtgtccacttgttttgaattgtatctcacatgttagatggcatgatttgaccttcagcacatatactgaagtacacatgataatttacctttccaaaccaatccctcactagtacccttcatgaactcttctgcttaaatcaaaatactctactcacaattgcaaattacatatggtcggcctttctatacttgattcatttcattttccctcctttcttttttttttaaattttttgtagagacaaggtctcactatattgcccaggctagtctcaaactcctgtgctcaagtgatcctcccgccttggcctcccaaggtgttgggattataggcatgagccaacatgcccagcccattttcccttcctttctatcttctaaatcccaaaccacactttaagattcagcttaactcccacatctactgtgaggcctttcctgactgctcagaagacagtataccctcttttctaaatttgctgcaaccattgtcttaagagaaaactgacaattaatt

SEQ ID NO: 173120 - DNA, 601 bp, Human
attttttgttatatggggatttttggtaaactttatttttagtttttatttttgtgagttcatagtaggtgtatataatttgcatttatcctttgtgttgcaaacaattcaattatactcttttagttattttaaaatgtacaattaaattatttttgactgtagtcaccctgttgtgccagcaaatactagactttattctttatccccacttcttgctctctgtcccctcccctcactacccttcccagggatttttgtatcaaagatacacgtagcaaaagcatctgactggtactcwgaattatattttcttctctcaagaaattcacagggacctataaacagatttaaatccccagctattcttcagtctcccacagaaactcatgacacaaatcattatggtggtatcacacaactccccctcaaacttctcagtgatcaaacccctttttcctgaaatcttttattagtccttcctctgtgttttcccatttactttctttctttctttttttttttttttgagacggcgtttctctcttgctgcccaggctggagtgcaatggcgtgatctcggctcactgcaaactctgcc

SEQ ID NO: 173121 - DNA, 601 bp, Human
gagccatgacttggggatttcattatcattttttgttatatggggatttttggtaaactttatttttagtttttatttttgtgagttcatagtaggtgtatataatttgcatttatcctttgtgttgcaaacaattcaattatactcttttagttattttaaaatgtacaattaaattatttttgactgtagtcaccctgttgtgccagcaaatactagactttattctttatccccacttcttgctctctgtcccctcccctcactacccttcccagggatttttgtatcaaagatacaygtagcaaaagcatctgactggtactcagaattatattttcttctctcaagaaattcacagggacctataaacagatttaaatccccagctattcttcagtctcccacagaaactcatgacacaaatcattatggtggtatcacacaactccccctcaaacttctcagtgatcaaacccctttttcctgaaatcttttattagtccttcctctgtgttttcccatttactttctttctttctttttttttttttttgagacggcgtttctctcttgctgcccaggctggagtgcaatggcg

SEQ ID NO: 173122 - DNA, 601 bp, Human
gttttatggatgttgcggtatcccctgaaataagcgagagcgtgttcactgagcctgagtggggaggatgccttcaagtgtgtgtagtggggaacagcagaagccctgggctcccacagacttgcctgtgagtcctaatgaggtcgtttattagctgaatcattttggatgaattatttaattaagcagttgtcttatctggaaatggggaaagtaatatttgtccctcagagggttgatgtgagaattaatacatttgaaaccacaaaagtgcctgcaacaacacacacacacattatcaattattattattattattattattattattattattgttagggcacactgagtggagtggggtcctcagggaccttggctcttgtccagttgtccactggctcactggccttgggctcactgataggatttattctgcagtgtcttcatctttcaaatagggctaattctttcctcaagttgttcagctagggctttcttcaaagtaaaagcatgaggctcacttaggatatcattatctgtcaatctcctcttgatttcatctgatgagtgtgttggggaagatggaattaagtgaaaa

SEQ ID NO: 173123 - DNA, 601 bp, Human
tatgtgtctgtgtgtgtctgtgtaacctttgtaagtggtggtgtttgtctttaggaatccccagaccctcatttggagggaggcagttgggagaagtgggtagcaaggacaagaaaaaccaggagtcaggctgggtgcggtggctcatgcgtgtaatcccagcactttgggagaccgaggagggtggatcacacaaggtcaggagtccaagaccagcctgagctacatggtgaaaccctgtctctactaaaaatagaaaaattagctgggtgtggtggtgtgcgcctgtaatcccagctatttggaaggctgaggcaggagaatcacttgaacacaggaggcagaggctgcagtgagccgagattgcaccaccgtactccagcctggaagatagagcaagactctgtctcaaacaaacaaacaaacaaacaaaacaaacaaaacccaggtgtgtcattgtttctttgagttaaatttattgggagataatctggatttataaagaagcatctgtgtctccagagaaataattgtttaaatttggagaagagaaggtgcaagaatttgtactcgcttggttgtgccaggaggggtgctgccc

SEQ ID NO: 173124 - DNA, 601 bp, Human
cctctgatgatgattgctgtagttcacaaaggaatcagtcctctcctttctaacggattctgcctgcctttatttacccagaaaccaaggatgacctagagcagctcacgactgagattaagaaaagggccaacaacgtccggaacaaactgaagagtaagaagggaacaaagaaaacaaggccgtccccaccaccatctatctcagctcccctagggtccagctttccgaactgaaactcctcttgatggaagtgacaccacttggtccatctttgcttgtggtttgggctctgtccccrcaatgatccattgtagccccagaaatttaccttttcttaaatcctgactgtactggaaagagtccagaattgaagctaggagatgagaattaaaatgtgctttcagctgctgagtagttttgtgacttggtcctttaacttagtctttcaacttgtctctctttttttttttttgagacggagtctcactctgtcccccaggctggagtgcagtggtgtgatctcggcttattgcaacctctacctcctgggttcaggtgattctcctgcctcagcctcctgagtaactgggacgcacct

SEQ ID NO: 173125 - DNA, 601 bp, Human
agggaagtcacgttcctaattttcagggtccttatcagatggtgtttcaccgtgatcttatatttgacgctctacttcttttgttacaaagctggcaaaaagacaaccgatgaggagctggaggagatgttggagagtggcaacccggccatcttcacttctggggtgagtgccctgtgtgctcggatagcacatccctctcgtgagcagggaggccactgcggagctcatgcagtccagcaggtggagggggagctgcaggtgcagggagttcagggaggcaaggagctccccaggagcrtgcatgagggctgtggcaggggcagcctttcttgcaggggtagctaacagtctgtgtgtggcctgttgtagatcattgactcacagatttccaagcaagccctcagtgagattgagggacgacacaaggacattgtgaggctggagagcagcatcaaggagcttcacgacatgtttatggacatcgccatgctggtggagaatcaggtaagtggcagtgagtcccagcgtggggagggaggagaggaaagctcagggtctactgagaacagggagaaagggaatactggaagccagtgag

SEQ ID NO: 173126 - DNA, 601 bp, Human
caattttgctagcatatacagtttcaaaattcttttactacctttctaagttgctccttttatcattacagaattactccctttatgcctattaatgtcatttttgccttaaggtctagcttctctgatgttaccactacagcagctttttttttgttttgttttgctttttttttaattaagatttgtctacaatatcttttcccattccttttcttagttctcacaaccattttatattttgggtgtgaatcctgtaaaaatgatgtagctggattttattttaaattctaagcagatyatgttttcatttttacaaagagattccatctatttacatataatgagattaatatgttgactcatttttatcttgctattttatgtttttctactctttaaatagttatacttaaaattgcaggacacactcttatcaaaatctaaagttaatcagcgtgtctattattctccagtacaatacaaattcttaaaccattttaaatctattagctcatctggttttaaaccatccaaatttggtcactgttgcaacagtcattttaagaagcttatttaaatttattcacatgcattattt

SEQ ID NO: 173127 - DNA, 601 bp, Human
tgtttcggattttcagaaatcctttaattaggagctgggctaaagcttagttctagatgaatctataattagatttaaaagttacatctggattctgccatttatcactttatatattttgagacaattttgctagcatatacagtttcaaaattcttttactacctttctaagttgctccttttatcattacagaattactccctttatgcctattaatgtcatttttgccttaaggtctagcttctctgatgttaccactacagcagctttttttttgttttgttttgctttttttttwattaagatttgtctacaatatcttttcccattccttttcttagttctcacaaccattttatattttgggtgtgaatcctgtaaaaatgatgtagctggattttattttaaattctaagcagatcatgttttcatttttacaaagagattccatctatttacatataatgagattaatatgttgactcatttttatcttgctattttatgtttttctactctttaaatagttatacttaaaattgcaggacacactcttatcaaaatctaaagttaatcagcgtgtctattattctccagt

SEQ ID NO: 173128 - DNA, 601 bp, Human
gttgaactatccttgcattcctcagttgagtataatttggtcagaagtatttttaaaatatgtactggatagggtttgtaaaatttacttaggatttttgcaactacgtccataattgaaactagtctgtaggattcattttgtgcatgctctttttcttgttttagaagctccttccacaccctcctttaaaaaaattattctttttttctcaggaactatttgtttcttatatgttagttaaaactcaccagctaaatcatttgagtctgagcttatttttgtcagtaaatattaaaartactattacaaatttaatatctttatatagttatatttaaattttcctctttcaccttgatccagtgttaataattttacatttctaagaaataattagtattgttcacaacattcttgtgatttaaaaaatctctgaataaaaatatttatatccctctttgcattcttaatattatttacttgggaattctttctttcttaattttataaatgtcttgtccattttatgaatattttcaaagcaccagcttttggtttaattcatcttccctcttgagttttttttttttttttttgg

SEQ ID NO: 173129 - DNA, 601 bp, Human
aaatcacagaactgaacaggccattctgctgcatgagaacttcctatgactcccaaatttcaataggtaaagttgaaactctttagtatggaaaggtttcatccccatcttggtcttcttctttgcccacttttaaagacccagattaatgttacttccttagtgaaatggcgtccaaagaattaaaatcagccacaattaaaataccacagtggtattttgtacacatctcctattatagtaattacattaaaacatgttttttaaatgtctttaaaatgctctgtgcctcttaagcagratttatatgctgaggaatatattttagtcagcctatctccccatagcctaacagtgtctgcaaacaggaggtgctaaataaatgtttgctgagtgaatagatgaagaaatgaattttacatggcatcacctaagacaatgcaatgctagatggataattttattaaaaatctattatatgcaagatgctatgtgaggctctatggggttaggaaagggatagatagcattctccactcacaaaagctattaaaatcactataagaaacagtataggttatcacagaagaaatactatcag

SEQ ID NO: 173130 - DNA, 601 bp, Human
aaggctgcaccatcggcttccctacttttgaggttttgggacttggattggcttccttgctcctcaacttgcagatggcctattgtgaggccttaccttgtgatcgtgtgagtctgtactccttaacaaactccccttcatatatacatctgtcctattagttctgtccttcaagagaaccctgactaatactaatacagatgcctaagaaaaagaaaactagtaagggagattgtaacagaatgcacaaaactattcaaataactttgaatgcatattttacacattctagagatgtctrtattagacaagcactgttcaccatcatagatcgtggacatttggaagaccggagcctattgttgtggtatttctaagatctctcttttctgtttctttctgaaataactatttacactgtggagatagcctcagtgctgagtctgaaaacatattttaaatgagatcttagggaggtaaaagaggacataaacgtcaaatgtgaactcatggccctgcccatcacttatttatgacgttgatccacagatctttactttaggactccatctttctctgtactctaggttcttatatatcc

SEQ ID NO: 173131 - DNA, 601 bp, Human
tcagcttttgcaatccaagtcccaaacagacctggcagttgttgaacccctgtttctctagtcctctatttcttcgtcttcttgcttattgcatttttcctcccaagtgagaaaaaaggggaaaaagtactgtgatagtaaatattgagtgtcaacttgattggattgaaggatgcaaagtattattcctgggtgtgtctgtgagggtgttgccaaaggagattaacatttgagtcagtggactgggagaggcccacccgtcctcaatctgggtgggcaccatctaatcagctgccagcgyggctagaataaagcaggcagaggaatgtggaaagactagactggctgagttttctggcctttacctttctcccgtgctgaatgtttcctgcccttgaacatcggacttcaagttcttcagcttttggactcttggacctacaccaatggtttgccaggggttctcgggccttcagccacagactgaaggctgcaccatcggcttccctacttttgaggttttgggacttggattggcttccttgctcctcaacttgcagatggcctattgtgaggccttaccttgtgatcgtgtgagtct

SEQ ID NO: 173132 - DNA, 601 bp, Human
cttccatccgggctgtttactaagatgcctggatatgtagacttcagcttttgcaatccaagtcccaaacagacctggcagttgttgaacccctgtttctctagtcctctatttcttcgtcttcttgcttattgcatttttcctcccaagtgagaaaaaaggggaaaaagtactgtgatagtaaatattgagtgtcaacttgattggattgaaggatgcaaagtattattcctgggtgtgtctgtgagggtgttgccaaaggagattaacatttgagtcagtggactgggagaggcccacycgtcctcaatctgggtgggcaccatctaatcagctgccagcgtggctagaataaagcaggcagaggaatgtggaaagactagactggctgagttttctggcctttacctttctcccgtgctgaatgtttcctgcccttgaacatcggacttcaagttcttcagcttttggactcttggacctacaccaatggtttgccaggggttctcgggccttcagccacagactgaaggctgcaccatcggcttccctacttttgaggttttgggacttggattggcttccttgctcctcaacttgc

SEQ ID NO: 173133 - DNA, 601 bp, Human
cctagacagtagagaggcttcctgcaatttccaacttccatcctccccatgccccgacctctttccccttcttcccagccaaagcctcaggacccattgtggggaaggtagaaatgaggaacactgctgcctagaggactccatggagggagggaggggcaagtctcacccactactgacctcaagggctgcccaacacaggggctgcagccactccccagttagcagggaccagggattttcagggcctgtctcctcccaccctcttccctgtaaagagacagttccatggggaggaccrggggaagacgaggggaatggagcagacattcaccctttcacacagtaaccacatggaaaaggaggagaggaaaaatgtgagctcctgctcctgtgcacatgtgaatcagagaacccagaaaagcacagagtcccgcaccacatggagacaaacactatcaacgccctggagcccttccatccgggctgtttactaagatgcctggatatgtagacttcagcttttgcaatccaagtcccaaacagacctggcagttgttgaacccctgtttctctagtcctctatttcttcgtcttcttg

SEQ ID NO: 173134 - DNA, 601 bp, Human
tcaggacagtcgagagaaaagatgtgattaactccaaaattaaaatcagccactcttctgagtcaaccagcttataccaattgttgagatatttaaagaaaaaaatagcactatacactatagccaacaaaaagtggttcttattttatacataactttaaatttaggaaaattccctgtgtgctgacttgagcagaagaggagatgagtcagcaaatttctttttgttttccagcctgattcaataaaaacaaaaccctaaaagctgcatctgggtcctcaccacgaaaaacaatgcaargcctcggactctccttaaggggctcctgctggaaggaccagctgttctgggctgtgggttttaattagtgaacaacattgttcactccctgtctttactgtaacaaggctgactgcttggaaaggcattcaaaggaatgggggaagggaactgctgggttaaaagaaaagtcaccatttttctaattataaaagcaacatgtgcttgatgcttctggagatttgggggtgccaattaatctagctttcagttgcttccccagtggagatgatccacagagtcagatgaagatcaaaatac

SEQ ID NO: 173135 - DNA, 601 bp, Human
tgcacctggcctctgctgctatctcctctcacctgggcttcaggctgttccacaagaggcccctgcctgaccctgacagagcaggggaccctccctctcccctcctgttccctctgactacgacttcatgctggagccagtgggtgcttttcaaagcccaaacatagtcatgacacgccttggggaaggcctttattgacctcctaatgttcccctatcacaaccaaggctatcaacatggtcctcaggtcctatacgctatgactttcatcagctcctaaacacttccttcctctccccygccaccccaagtaaaactcagcatcagcctggaacgtttctcctcctgtcccctggttcatgcctcctcagcctccagctgttggttcaaatgttcctttccccataaagccttccatgatccctcagaccagattagggccccgtggcctttcctttggtgcacttagcccagatgttaattatgtttgtgcttaccaggataagggcagtcttcttcctctagcctcccctcacccatgggctcccttgtctgtttttaatccctgctgtattctcagcataagggggcatgtgaaca

SEQ ID NO: 173136 - DNA, 601 bp, Human
atatgtttccttcctttcattccgtgcacctggcctctgctgctatctcctctcacctgggcttcaggctgttccacaagaggcccctgcctgaccctgacagagcaggggaccctccctctcccctcctgttccctctgactacgacttcatgctggagccagtgggtgcttttcaaagcccaaacatagtcatgacacgccttggggaaggcctttattgacctcctaatgttcccctatcacaaccaaggctatcaacatggtcctcaggtcctatacgctatgactttcatcagctyctaaacacttccttcctctcccccgccaccccaagtaaaactcagcatcagcctggaacgtttctcctcctgtcccctggttcatgcctcctcagcctccagctgttggttcaaatgttcctttccccataaagccttccatgatccctcagaccagattagggccccgtggcctttcctttggtgcacttagcccagatgttaattatgtttgtgcttaccaggataagggcagtcttcttcctctagcctcccctcacccatgggctcccttgtctgtttttaatccctgctgtattc

SEQ ID NO: 173137 - DNA, 601 bp, Human
tcctgatcatgtctaaggggagatatgtttccttcctttcattccgtgcacctggcctctgctgctatctcctctcacctgggcttcaggctgttccacaagaggcccctgcctgaccctgacagagcaggggaccctccctctcccctcctgttccctctgactacgacttcatgctggagccagtgggtgcttttcaaagcccaaacatagtcatgacacgccttggggaaggcctttattgacctcctaatgttcccctatcacaaccaaggctatcaacatggtcctcaggtcctayacgctatgactttcatcagctcctaaacacttccttcctctcccccgccaccccaagtaaaactcagcatcagcctggaacgtttctcctcctgtcccctggttcatgcctcctcagcctccagctgttggttcaaatgttcctttccccataaagccttccatgatccctcagaccagattagggccccgtggcctttcctttggtgcacttagcccagatgttaattatgtttgtgcttaccaggataagggcagtcttcttcctctagcctcccctcacccatgggctcccttgtct

SEQ ID NO: 173138 - DNA, 601 bp, Human
aatgtgctgtggaggtaggagtcaccacgggacttgggtgaagacccaagggagagaaggcactggtgttgagtgcctcggccagtgggacagcaaagcagcctgtgagggagaggcaggcagggagagccggtgagttaggtatgtgtggagtacagcaacagcagggaaattcaatccattctcaatgatgttttaagaagaatatgatgatgagcctggcttgtggagtcctagttagggaggaggagtcaggctagcaggattgggggaaagcaaaatgaagaagcagataagctayaagtctgcctttttcatggtccaggacacatatccctcccgtgcacatgactcacaatcttcctgtgcccagctatcaccagacccccagctgacagaaaattgcaatttagttcactgcaaccttggcattatcaatattgcacaaagctttcttcagcacaccggtggcacaagcaccatcctataacatctccagcaagcctttgtctccttgcagtcagctcctctcttgctggcctgcccattgctcctttgtaatgtattttcctatgatctctagtaaatctccctttcttta

SEQ ID NO: 173139 - DNA, 601 bp, Human
attcaggcaggtgcggggtctggattaaagctaggttatactggtagttgggagaaaaagacaggtggctaaaacatcttccagctgtgaggaagggagggcctgagctggtgcagccatgtgatggtggacaggaaagggtgtggaatgtgctgtggaggtaggagtcaccacgggacttgggtgaagacccaagggagagaaggcactggtgttgagtgcctcggccagtgggacagcaaagcagcctgtgagggagaggcaggcagggagagccggtgagttaggtatgtgtggagtrcagcaacagcagggaaattcaatccattctcaatgatgttttaagaagaatatgatgatgagcctggcttgtggagtcctagttagggaggaggagtcaggctagcaggattgggggaaagcaaaatgaagaagcagataagctacaagtctgcctttttcatggtccaggacacatatccctcccgtgcacatgactcacaatcttcctgtgcccagctatcaccagacccccagctgacagaaaattgcaatttagttcactgcaaccttggcattatcaatattgcacaaagctttc

SEQ ID NO: 173140 - DNA, 601 bp, Human
atgttagctaccacattggacactatcagtaaacatttgttgaattagtgcatgaatgaatgactgaataaacataggcatgtgtgaaaaggtagggccgtcaccactgtggagggtgatactggtctaagaaatttgaatttgactgaggaggcattgggggaagctgctgatgatttgggaggatcaaaatgtaaatgcaatcttgtgatacaaatagaaagatgttttagaaggatcattcaggcaggtgcggggtctggattaaagctaggttatactggtagttgggagaaaaagwcaggtggctaaaacatcttccagctgtgaggaagggagggcctgagctggtgcagccatgtgatggtggacaggaaagggtgtggaatgtgctgtggaggtaggagtcaccacgggacttgggtgaagacccaagggagagaaggcactggtgttgagtgcctcggccagtgggacagcaaagcagcctgtgagggagaggcaggcagggagagccggtgagttaggtatgtgtggagtacagcaacagcagggaaattcaatccattctcaatgatgttttaagaagaatatgatgatg

SEQ ID NO: 173141 - DNA, 601 bp, Human
atatatgaaaagttctgtgcacagtgtcttgcctgttgttgatatttactcaatgttagctaccacattggacactatcagtaaacatttgttgaattagtgcatgaatgaatgactgaataaacataggcatgtgtgaaaaggtagggccgtcaccactgtggagggtgatactggtctaagaaatttgaatttgactgaggaggcattgggggaagctgctgatgatttgggaggatcaaaatgtaaatgcaatcttgtgatacaaatagaaagatgttttagaaggatcattcaggcmggtgcggggtctggattaaagctaggttatactggtagttgggagaaaaagacaggtggctaaaacatcttccagctgtgaggaagggagggcctgagctggtgcagccatgtgatggtggacaggaaagggtgtggaatgtgctgtggaggtaggagtcaccacgggacttgggtgaagacccaagggagagaaggcactggtgttgagtgcctcggccagtgggacagcaaagcagcctgtgagggagaggcaggcagggagagccggtgagttaggtatgtgtggagtacagcaaca

SEQ ID NO: 173142 - DNA, 601 bp, Human
agcaagaactgatttttggtgaagatcaaacaacagaatatatgaaaagttctgtgcacagtgtcttgcctgttgttgatatttactcaatgttagctaccacattggacactatcagtaaacatttgttgaattagtgcatgaatgaatgactgaataaacataggcatgtgtgaaaaggtagggccgtcaccactgtggagggtgatactggtctaagaaatttgaatttgactgaggaggcattgggggaagctgctgatgatttgggaggatcaaaatgtaaatgcaatcttgtgayacaaatagaaagatgttttagaaggatcattcaggcaggtgcggggtctggattaaagctaggttatactggtagttgggagaaaaagacaggtggctaaaacatcttccagctgtgaggaagggagggcctgagctggtgcagccatgtgatggtggacaggaaagggtgtggaatgtgctgtggaggtaggagtcaccacgggacttgggtgaagacccaagggagagaaggcactggtgttgagtgcctcggccagtgggacagcaaagcagcctgtgagggagaggcaggcaggga

SEQ ID NO: 173143 - DNA, 601 bp, Human
agcacagcatataggagctgagactctcctgtccaagagctagccaggcctgatcctgcttagcttccaagatcagatgagatcaggctcattctgggtagggtagccttagactaggagctcagattctagagtcagactatctgggtttgaatccttattaactgtgggtgtggccgagttatttagcccctcaatgtctcagtattctcatctgggtataaagatagcaagaactgatttttggtgaagatcaaacaacagaatatatgaaaagttctgtgcacagtgtcttgcctgytgttgatatttactcaatgttagctaccacattggacactatcagtaaacatttgttgaattagtgcatgaatgaatgactgaataaacataggcatgtgtgaaaaggtagggccgtcaccactgtggagggtgatactggtctaagaaatttgaatttgactgaggaggcattgggggaagctgctgatgatttgggaggatcaaaatgtaaatgcaatcttgtgatacaaatagaaagatgttttagaaggatcattcaggcaggtgcggggtctggattaaagctaggttatactgg

SEQ ID NO: 173144 - DNA, 601 bp, Human
ctctcctcatattccaggactttggttcagctgctctcccccaagagcattctctaggtgtctcccattgtaaatgaatgctacccgcttccccaatccactccatttatagactaattccattacaacaaacaccatagccagaaacgtataaccgagactcagtgttttgttccaagtgaactggaggcagtgtagcacagcatataggagctgagactctcctgtccaagagctagccaggcctgatcctgcttagcttccaagatcagatgagatcaggctcattctgggtagggtrgccttagactaggagctcagattctagagtcagactatctgggtttgaatccttattaactgtgggtgtggccgagttatttagcccctcaatgtctcagtattctcatctgggtataaagatagcaagaactgatttttggtgaagatcaaacaacagaatatatgaaaagttctgtgcacagtgtcttgcctgttgttgatatttactcaatgttagctaccacattggacactatcagtaaacatttgttgaattagtgcatgaatgaatgactgaataaacataggcatgtgtgaa

SEQ ID NO: 173145 - DNA, 601 bp, Human
agttcagttgggccttggagtgatgcacttagtgaatccccagaggcctgttctggcctctcctctcctcatattccaggactttggttcagctgctctcccccaagagcattctctaggtgtctcccattgtaaatgaatgctacccgcttccccaatccactccatttatagactaattccattacaacaaacaccatagccagaaacgtataaccgagactcagtgttttgttccaagtgaactggaggcagtgtagcacagcatataggagctgagactctcctgtccaagagctasccaggcctgatcctgcttagcttccaagatcagatgagatcaggctcattctgggtagggtagccttagactaggagctcagattctagagtcagactatctgggtttgaatccttattaactgtgggtgtggccgagttatttagcccctcaatgtctcagtattctcatctgggtataaagatagcaagaactgatttttggtgaagatcaaacaacagaatatatgaaaagttctgtgcacagtgtcttgcctgttgttgatatttactcaatgttagctaccacattggacactat

SEQ ID NO: 173146 - DNA, 601 bp, Human
gtttactggtctgagttcagttgggccttggagtgatgcacttagtgaatccccagaggcctgttctggcctctcctctcctcatattccaggactttggttcagctgctctcccccaagagcattctctaggtgtctcccattgtaaatgaatgctacccgcttccccaatccactccatttatagactaattccattacaacaaacaccatagccagaaacgtataaccgagactcagtgttttgttccaagtgaactggaggcagtgtagcacagcatataggagctgagactctccygtccaagagctagccaggcctgatcctgcttagcttccaagatcagatgagatcaggctcattctgggtagggtagccttagactaggagctcagattctagagtcagactatctgggtttgaatccttattaactgtgggtgtggccgagttatttagcccctcaatgtctcagtattctcatctgggtataaagatagcaagaactgatttttggtgaagatcaaacaacagaatatatgaaaagttctgtgcacagtgtcttgcctgttgttgatatttactcaatgttagctacca

SEQ ID NO: 173147 - DNA, 601 bp, Human
gaatgtatgttccctgaggacaggggctgcatcctcccttctgcagacttgccacagagtatgggatgtttactggtctgagttcagttgggccttggagtgatgcacttagtgaatccccagaggcctgttctggcctctcctctcctcatattccaggactttggttcagctgctctcccccaagagcattctctaggtgtctcccattgtaaatgaatgctacccgcttccccaatccactccatttatagactaattccattacaacaaacaccatagccagaaacgtataaccgasactcagtgttttgttccaagtgaactggaggcagtgtagcacagcatataggagctgagactctcctgtccaagagctagccaggcctgatcctgcttagcttccaagatcagatgagatcaggctcattctgggtagggtagccttagactaggagctcagattctagagtcagactatctgggtttgaatccttattaactgtgggtgtggccgagttatttagcccctcaatgtctcagtattctcatctgggtataaagatagcaagaactgatttttggtgaagatcaaacaaca

SEQ ID NO: 173148 - DNA, 601 bp, Human
tagaatgtatgttccctgaggacaggggctgcatcctcccttctgcagacttgccacagagtatgggatgtttactggtctgagttcagttgggccttggagtgatgcacttagtgaatccccagaggcctgttctggcctctcctctcctcatattccaggactttggttcagctgctctcccccaagagcattctctaggtgtctcccattgtaaatgaatgctacccgcttccccaatccactccatttatagactaattccattacaacaaacaccatagccagaaacgtataaccragactcagtgttttgttccaagtgaactggaggcagtgtagcacagcatataggagctgagactctcctgtccaagagctagccaggcctgatcctgcttagcttccaagatcagatgagatcaggctcattctgggtagggtagccttagactaggagctcagattctagagtcagactatctgggtttgaatccttattaactgtgggtgtggccgagttatttagcccctcaatgtctcagtattctcatctgggtataaagatagcaagaactgatttttggtgaagatcaaacaa

SEQ ID NO: 173149 - DNA, 601 bp, Human
gccatggctggctcacttccccaaagccccgactgagtgccaggctcggtgtctgtttcatcgtcacatcccacagctggttaagtgctcgagctgggattcgaacctgggtagctggactctggcttgtgatcctaaccttgacgtatcctgtctccagacagaaggtctatcttacagcctgccctttcctgacaattttatggaagaaaagtcaccaaaacagtgagttcctctgggaacgtgggtttgccccttgcattgtttggctcccaaagcatctctgttatgggcacattaygtcatatgttgttagaatgtatgttccctgaggacaggggctgcatcctcccttctgcagacttgccacagagtatgggatgtttactggtctgagttcagttgggccttggagtgatgcacttagtgaatccccagaggcctgttctggcctctcctctcctcatattccaggactttggttcagctgctctcccccaagagcattctctaggtgtctcccattgtaaatgaatgctacccgcttccccaatccactccatttatagactaattccattacaacaaacaccatagccag

SEQ ID NO: 173150 - DNA, 601 bp, Human
aactcagttatcagccgcatcccagcttctcatctgttctcagaatctacaagggatttcagaaggaacatatggtacagcgtggggaagaactgctgtgaaatgatcactggcacagcagtggccatggctggctcacttccccaaagccccgactgagtgccaggctcggtgtctgtttcatcgtcacatcccacagctggttaagtgctcgagctgggattcgaacctgggtagctggactctggcttgtgatcctaaccttgacgtatcctgtctccagacagaaggtctatcttayagcctgccctttcctgacaattttatggaagaaaagtcaccaaaacagtgagttcctctgggaacgtgggtttgccccttgcattgtttggctcccaaagcatctctgttatgggcacattacgtcatatgttgttagaatgtatgttccctgaggacaggggctgcatcctcccttctgcagacttgccacagagtatgggatgtttactggtctgagttcagttgggccttggagtgatgcacttagtgaatccccagaggcctgttctggcctctcctctcctcatattccaggact

SEQ ID NO: 173151 - DNA, 601 bp, Human
ggggcaggggtcagaagacctatagggccatttgcaatttgatggagacacacaggcctgaacaactcagttatcagccgcatcccagcttctcatctgttctcagaatctacaagggatttcagaaggaacatatggtacagcgtggggaagaactgctgtgaaatgatcactggcacagcagtggccatggctggctcacttccccaaagccccgactgagtgccaggctcggtgtctgtttcatcgtcacatcccacagctggttaagtgctcgagctgggattcgaacctgggtagytggactctggcttgtgatcctaaccttgacgtatcctgtctccagacagaaggtctatcttacagcctgccctttcctgacaattttatggaagaaaagtcaccaaaacagtgagttcctctgggaacgtgggtttgccccttgcattgtttggctcccaaagcatctctgttatgggcacattacgtcatatgttgttagaatgtatgttccctgaggacaggggctgcatcctcccttctgcagacttgccacagagtatgggatgtttactggtctgagttcagttgggccttggag

SEQ ID NO: 173152 - DNA, 601 bp, Human
ataccctgtcacttggctctaactcctaactgcaaattttcttggatattgtgtgaaaatgcacacgggggggttagcaggggcaggggtcagaagacctatagggccatttgcaatttgatggagacacacaggcctgaacaactcagttatcagccgcatcccagcttctcatctgttctcagaatctacaagggatttcagaaggaacatatggtacagcgtggggaagaactgctgtgaaatgatcactggcacagcagtggccatggctggctcacttccccaaagccccgactgmgtgccaggctcggtgtctgtttcatcgtcacatcccacagctggttaagtgctcgagctgggattcgaacctgggtagctggactctggcttgtgatcctaaccttgacgtatcctgtctccagacagaaggtctatcttacagcctgccctttcctgacaattttatggaagaaaagtcaccaaaacagtgagttcctctgggaacgtgggtttgccccttgcattgtttggctcccaaagcatctctgttatgggcacattacgtcatatgttgttagaatgtatgttccctgaggac

SEQ ID NO: 173153 - DNA, 601 bp, Human
tgtggatcaaataaacatgacatggggacgcaattcataaaatgtaaggcattgttacaaatctggaatacgaacataaatattttaaacccactctgctgtaagctctattttccacttgctattttcttccacactgacccattgctcagtgtatttttgttgaacgaatgaatgaatggatgtgcatgagagaaattgacccattagagagaagggagggttatttgcttataccctgtcacttggctctaactcctaactgcaaattttcttggatattgtgtgaaaatgcacacgrgggggttagcaggggcaggggtcagaagacctatagggccatttgcaatttgatggagacacacaggcctgaacaactcagttatcagccgcatcccagcttctcatctgttctcagaatctacaagggatttcagaaggaacatatggtacagcgtggggaagaactgctgtgaaatgatcactggcacagcagtggccatggctggctcacttccccaaagccccgactgagtgccaggctcggtgtctgtttcatcgtcacatcccacagctggttaagtgctcgagctgggattcg

SEQ ID NO: 173154 - DNA, 601 bp, Human
tttgtggatcaaataaacatgacatggggacgcaattcataaaatgtaaggcattgttacaaatctggaatacgaacataaatattttaaacccactctgctgtaagctctattttccacttgctattttcttccacactgacccattgctcagtgtatttttgttgaacgaatgaatgaatggatgtgcatgagagaaattgacccattagagagaagggagggttatttgcttataccctgtcacttggctctaactcctaactgcaaattttcttggatattgtgtgaaaatgcacaygggggggttagcaggggcaggggtcagaagacctatagggccatttgcaatttgatggagacacacaggcctgaacaactcagttatcagccgcatcccagcttctcatctgttctcagaatctacaagggatttcagaaggaacatatggtacagcgtggggaagaactgctgtgaaatgatcactggcacagcagtggccatggctggctcacttccccaaagccccgactgagtgccaggctcggtgtctgtttcatcgtcacatcccacagctggttaagtgctcgagctgggatt

SEQ ID NO: 173155 - DNA, 601 bp, Human
atgtgtgtatatgtatgtgtgtatatgggtatgcatgtgtgtgtgtgcatgtgggtgtgcatgtgtgtatatggtgtgcacatgtgtatatgtgtgcatgtgtgtatatatacatgtgtatatgctgtgcgtgtgtgtatatgtttgtatatggtgtgcagatgtgtgaatgtgtgtatatgtatgtgtgtatatggtgtgcatgtgtgtgtatatgtatgtgtgtatatggtgtgcatatatgtatatgtgtggatgtgggtgtgcatgtgtgtatatgtacatgtgtatgggtatgcaygcatgtatatgtgggcacatgtgtatatttgtgtgtgtatatgtgcatgtatctgtatgtatatgggggtgcgtgggtgtgtgtatacacgtatgtgtgtatatggtgtgcatatgtgtatatgtatgtgcatatatgggtgtgcatgtgtgtatatgtgtgtgtgtgggtatgcatgtgtatatgcattgtgtgtatatgggtgtgtatgtgtctgtgtttctgggtgtgtgtatgtacatgcatgtctgttgccagcctgcatttcagcatgactgcagtcaggtccttgttcccttg

SEQ ID NO: 173156 - DNA, 601 bp, Human
atatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggtatctgtgtatatgtatgtgtgtatatggtgtgcatgtgtgtgtctgtgtggatgtgggtgtgcatgtgtgtatatgtatgtgtgtatatgggtatgcatgtgtgtgtgtgcatgtgggtgtgcatgtgtgtatatggtgtgcacakgtgtatatgtgtgcatgtgtgtatatatacatgtgtatatgctgtgcgtgtgtgtatatgtttgtatatggtgtgcagatgtgtgaatgtgtgtatatgtatgtgtgtatatggtgtgcatgtgtgtgtatatgtatgtgtgtatatggtgtgcatatatgtatatgtgtggatgtgggtgtgcatgtgtgtatatgtacatgtgtatgggtatgcacgcatgtatatgtgggcacatgtgtatatttgtgtgtgtatatgtgcatgtatctgtatgtatatgggggtgcgtgggtgtgt

SEQ ID NO: 173157 - DNA, 601 bp, Human
tttgtatatatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggtatctgtgtatatgtatgtgtgtatatggtgtgcatgtgtgtgtctgtgtggatgtgggtgtgcatgtgtgtatatgtatgtgtgtatatgggtatgcatgtgtgtgtgtgcatgtgggtgtgcatgtgtgtatatggtktgcacatgtgtatatgtgtgcatgtgtgtatatatacatgtgtatatgctgtgcgtgtgtgtatatgtttgtatatggtgtgcagatgtgtgaatgtgtgtatatgtatgtgtgtatatggtgtgcatgtgtgtgtatatgtatgtgtgtatatggtgtgcatatatgtatatgtgtggatgtgggtgtgcatgtgtgtatatgtacatgtgtatgggtatgcacgcatgtatatgtgggcacatgtgtatatttgtgtgtgtatatgtgcatgtatctgtatgtatatgggggtgcgtg

SEQ ID NO: 173158 - DNA, 601 bp, Human
tatgcatgtgtgtatattggtgtgcatgtgtatatatgcatttgtatatatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggtatctgtgtatatgtatgtgtgtatatggtgtgcatgtgtgtgtctgtgtggatgtgggtgtgcatgtgtgtatatgtatgtgtgtatatgggtatgcaggtgtgtgtgtgcatgtgggtgtgcatgtgtgtatatggtgtgcacatgtgtatatgtgtgcatgtgtgtatatatacatgtgtatatgctgtgcgtgtgtgtatatgtttgtatatggtgtgcagatgtgtgaatgtgtgtatatgtatgtgtgtatatggtgtgcatgtgtgtgtatatgtatgtgtgtatatggtgtgcatatatgtatatgtgtggatgtgggtgtgcatgtgtgtatatgtacatgtgtatgggtatgcacgcatgtatatgtgggcacatgtgtatatttgtgtg

SEQ ID NO: 173159 - DNA, 601 bp, Human
gtatgtatatggggtgcatgggtgtgcatgtgtatatatgcatgtgtgtatatcagtgtgcatgtgtatatatgcatgtgtgtatattggtgtgcatgtgtatatatgcatttgtatatatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggtatctgtgtatatgtatgtgtgtatatggwgtgcatgtgtgtgtctgtgtggatgtgggtgtgcatgtgtgtatatgtatgtgtgtatatgggtatgcatgtgtgtgtgtgcatgtgggtgtgcatgtgtgtatatggtgtgcacatgtgtatatgtgtgcatgtgtgtatatatacatgtgtatatgctgtgcgtgtgtgtatatgtttgtatatggtgtgcagatgtgtgaatgtgtgtatatgtatgtgtgtatatggtgtgcatgtgtgtgtatatgtatgtgtgtatatggtgtgcatatatgtatatgtgtggatgtgggtgtg

SEQ ID NO: 173160 - DNA, 601 bp, Human
gtatatttgtgtgtgtgcatgtgcatgggtatgtatatggggtgcatgggtgtgcatgtgtatatatgcatgtgtgtatatcagtgtgcatgtgtatatatgcatgtgtgtatattggtgtgcatgtgtatatatgcatttgtatatatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggtrtctgtgtatatgtatgtgtgtatatggtgtgcatgtgtgtgtctgtgtggatgtgggtgtgcatgtgtgtatatgtatgtgtgtatatgggtatgcatgtgtgtgtgtgcatgtgggtgtgcatgtgtgtatatggtgtgcacatgtgtatatgtgtgcatgtgtgtatatatacatgtgtatatgctgtgcgtgtgtgtatatgtttgtatatggtgtgcagatgtgtgaatgtgtgtatatgtatgtgtgtatatggtgtgcatgtgtgtgtatatgtatgtgtgtatatggtgtgca

SEQ ID NO: 173161 - DNA, 601 bp, Human
tttatggccagatttggcggggggcctgttcccaacaaaaagctatcacctaaaatccatacatgggcggaatgcttttcctgggtaccgcagagcctcattacagtgtcactcatggcatcataagaaggtgaagtcatttccaaactcagagaaaagcccataaataggaggggtccaaaggtgggtgagcgtacatgtgtatgggtgtatgtgtgtctataggtgtgtatgtgtgtgtatgtgggcacgtgcgtatatttgtgtgtgtgcatgtgcatgggtatgtatatggggtgcrtgggtgtgcatgtgtatatatgcatgtgtgtatatcagtgtgcatgtgtatatatgcatgtgtgtatattggtgtgcatgtgtatatatgcatttgtatatatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggtatctgtgtatatgtatgtgtgtatatggtgtgcatgtgtgtgtctg

SEQ ID NO: 173162 - DNA, 601 bp, Human
gtcacagtgctgcagagattttgtttatggccagttttggggccagtttatggccagatttggcggggggcctgttcccaacaaaaagctatcacctaaaatccatacatgggcggaatgcttttcctgggtaccgcagagcctcattacagtgtcactcatggcatcataagaaggtgaagtcatttccaaactcagagaaaagcccataaataggaggggtccaaaggtgggtgagcgtacatgtgtatgggtgtatgtgtgtctataggtgtgtatgtgtgtgtatgtgggcacgtgygtatatttgtgtgtgtgcatgtgcatgggtatgtatatggggtgcatgggtgtgcatgtgtatatatgcatgtgtgtatatcagtgtgcatgtgtatatatgcatgtgtgtatattggtgtgcatgtgtatatatgcatttgtatatatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggt

SEQ ID NO: 173163 - DNA, 601 bp, Human
tgggtgggccaggtgttccttgctccattctggtaaacccacaaccttccagcgtgggtgtcatggccatcacgaacatgtcacagtgctgcagagattttgtttatggccagttttggggccagtttatggccagatttggcggggggcctgttcccaacaaaaagctatcacctaaaatccatacatgggcggaatgcttttcctgggtaccgcagagcctcattacagtgtcactcatggcatcataagaaggtgaagtcatttccaaactcagagaaaagcccataaataggagggrtccaaaggtgggtgagcgtacatgtgtatgggtgtatgtgtgtctataggtgtgtatgtgtgtgtatgtgggcacgtgcgtatatttgtgtgtgtgcatgtgcatgggtatgtatatggggtgcatgggtgtgcatgtgtatatatgcatgtgtgtatatcagtgtgcatgtgtatatatgcatgtgtgtatattggtgtgcatgtgtatatatgcatttgtatatatatgtatgtgtgtatatggtgtgcacatgtgcatatgtgtgcatgtgtgtatatgtacgtgtgtatatggtgt

SEQ ID NO: 173164 - DNA, 601 bp, Human
ggttgaaataaagggatgggttgggctacttatctgcagcaggagcatgtccttaaggcacagatcatgcatgctattgtttgtggtttaagaacacctttaagcagttttccgccctgggtgggccaggtgttccttgctccattctggtaaacccacaaccttccagcgtgggtgtcatggccatcacgaacatgtcacagtgctgcagagattttgtttatggccagttttggggccagtttatggccagatttggcggggggcctgttcccaacaaaaagctatcacctaaaatccatacatgggcggaatgcttttcctgggtaccgcagagcctcattacagtgtcactcatggcatcataagaaggtgaagtcatttccaaactcagagaaaagcccataaataggaggggtccaaaggtgggtgagcgtacatgtgtatgggtgtatgtgtgtctataggtgtgtatgtgtgtgtatgtgggcacgtgcgtatatttgtgtgtgtgcatgtgcatgggtatgtatatggggtgcatgggtgtgcatgtgtatatatgcatgtgtgtatatcagtgtgcatgtgtatatatgca

SEQ ID NO: 173165 - DNA, 601 bp, Human
tcagaaacatgagtttctctctcttttagaaaagaaaagctgccgagaccagctcggtcagggagaccctaatccagcggcactagaggaattaaagacacacacacagaaatacagaggagtggagtgggaaatcaggggtctcacagccttcagagctgagagccctgaacagagatttacccacgtatttactgacagcaagccagtgataagcattgtttctatagattgtagattaactaaaagtattccttatgggaaatgaatggatgggttgaaataaagggatgggttgggytacttatctgcagcaggagcatgtccttaaggcacagatcatgcatgctattgtttgtggtttaagaacacctttaagcagttttccgccctgggtgggccaggtgttccttgctccattctggtaaacccacaaccttccagcgtgggtgtcatggccatcacgaacatgtcacagtgctgcagagattttgtttatggccagttttggggccagtttatggccagatttggcggggggcctgttcccaacaaaaagctatcacctaaaatccatacatgggcggaatgcttttcctgg

SEQ ID NO: 173166 - DNA, 601 bp, Human
gtgattagaaaggaatgctaccagacaaagtctgttagggagtataccaaatgaaaattattctgaatgccttctttaggggaaatttgtagggtcttcccagactccttgccctatgcaatgagccaaactatcttgattaagtgcttgaatcacacaatattctagccagaaggaagctttgggccatctaaggccaacctttttcttttagccagccccttccctgaatagatggggaaaccaagacctaaataaccatcaaaggtcacagagctggttaacggtagggcaggaactraaatccaggcctctcaactctaggccagacacttccctccatacctggctgtcagaaacatgcatttctctcagaaacatgagtttctctctcttttagaaaagaaaagctgccgagaccagctcggtcagggagaccctaatccagcggcactagaggaattaaagacacacacacagaaatacagaggagtggagtgggaaatcaggggtctcacagccttcagagctgagagccctgaacagagatttacccacgtatttactgacagcaagccagtgataagcattgtttctatag

SEQ ID NO: 173167 - DNA, 601 bp, Human
gttgatcactgcatggcccttaccagccagccagctgtggccacagccctctgcagaccttccaacactgcattcctgttcctctctctgattgcctcaagggcgctaaactgtatagcctctttcttttcctcacccttatgtctctaaagacattgccgaacaagacatggtcccactaggccaggccgtctttgcctagttctgctgatccaagacattctatttctaccaacaaaacacaacacagaaaaagagccccaaacatgcataaccacaaaattacatcttttccttttcaaaaacctctaaccatgtattttatatacttattacttaacctaatgcattttcccactccagtagaacaacttttccttctgtttaatactatcaatcaaatataatggtgggtaagaggaagatggaataagaactcttgaacttgaaaattggtagccctcaactctacgccatgtgggaagtaaaatcaaacgtctgttacccaactctcagtggactagaaggaaaggcattttatatgcttaagtggtaacaaagatggcttgaccttgtgattagaaaggaatgctaccagaca

SEQ ID NO: 173168 - DNA, 601 bp, Human
acaactcacttgaagtattgcttatgagggaggaggggggtggatttcagctctcataaactgttgcttaaagtaaacaatctcacttctctcagtcattagtagagttaacaactgatttccagctttaacaccacttttgtatcaccttcagacagttgactaacaagtccgttgttcattcctgacagtgattaacttcttagattactgaccataattatgagaactccaaattctagattttccaaggcaatgacaatttcgtgaaatttaatttttttcaatatgtctcattaartgtttaaacaaatgtgattgagtttttataacataagtcaatacacagataatttcgcaactcagcaagacatggttgtcacaccatgcatcacgtggttggttgggaaatttgattatggggagtggaggagatgcagtcttcaacccctgggggtggggggtgaccctcttagccagtgacaaaggcagagagagaggagcacaggctacatcaccgctagtggccagcagtggccagtcaagacaatctccaggtgagcctgtgccctgcccaagggtgcacctctgcacgcactga

SEQ ID NO: 173169 - DNA, 601 bp, Human
tgccctgttcctcccccagagaagctgccatcttcaataagcacgtggcttaggaaaggatgcatcaggcttccatccaggccatccgggagggcaaacctcgctgccaggtcacctccttagcttttgtgtgacatatattttgaatggcttcagtgtcctctcactctagattaactcttagttgggtatgtaggggaagcatgataattctctgactatgagggggttatataattggatcataatgctctggggcatcagggggatcctagtaccttcccaggccgggcttccctgstagggattttagccctgggcacacggcaggcatcaaagcggaagacaatgcagagagtgaaaggttggcagctgctgttaggattttggctgcttaaggtaaccagaatcactgggttttgactgtcacagatctttggggtcacatatggttacagaatttcccccattttagaggaatgtgaaatgctgctctaagtagctaaatactgtttaaaaaactgaaaaccaaatggtgacaataattttaattactgacctctgaaatttcaagctcatttatactcaatctcaatttgtt

SEQ ID NO: 173170 - DNA, 601 bp, Human
tggacagctagttgttccagaaccatttgttgaaacacctactcttttttctattgaattgtcttggtgactttctccaaatcattttcttttggtaccattcttttctcaaaggtttctaggttatcattccctattttctcttcagatgaattacagaatccaattttaagctacacaataacccattgagatctcagtttgtattacactgaagtacaggtcagtttgggaagaacttatattttcataataaaccgcttgcctattcatgtacatggcaggcctcttcttttaatamggtcatttttatgtcctttagtctagttttagatttttttttccacgtggctgttggaaaatttttgttaagcttatgtataggtattgtgtagatttgttgatatcataaataagatctcttttttcctattttgtcttacatatatttatttttaatgtaaagggaagcttttgattttgtaagttggtcttatattgggcacttttgccacaccatcttatcagtttatcagtttgtagcgtatcttttttctatgttgctgattatatcaattgcaaacaatgaaagtgccgtgtg

SEQ ID NO: 173171 - DNA, 601 bp, Human
tgtagcttgaagtacaagtccaacttcattcttcggcatgtggacagctagttgttccagaaccatttgttgaaacacctactcttttttctattgaattgtcttggtgactttctccaaatcattttcttttggtaccattcttttctcaaaggtttctaggttatcattccctattttctcttcagatgaattacagaatccaattttaagctacacaataacccattgagatctcagtttgtattacactgaagtacaggtcagtttgggaagaacttatattttcataataaaccgyttgcctattcatgtacatggcaggcctcttcttttaatacggtcatttttatgtcctttagtctagttttagatttttttttccacgtggctgttggaaaatttttgttaagcttatgtataggtattgtgtagatttgttgatatcataaataagatctcttttttcctattttgtcttacatatatttatttttaatgtaaagggaagcttttgattttgtaagttggtcttatattgggcacttttgccacaccatcttatcagtttatcagtttgtagcgtatcttttttctatgt

SEQ ID NO: 173172 - DNA, 601 bp, Human
tatgtagcttgaagtacaagtccaacttcattcttcggcatgtggacagctagttgttccagaaccatttgttgaaacacctactcttttttctattgaattgtcttggtgactttctccaaatcattttcttttggtaccattcttttctcaaaggtttctaggttatcattccctattttctcttcagatgaattacagaatccaattttaagctacacaataacccattgagatctcagtttgtattacactgaagtacaggtcagtttgggaagaacttatattttcataataaacygcttgcctattcatgtacatggcaggcctcttcttttaatacggtcatttttatgtcctttagtctagttttagatttttttttccacgtggctgttggaaaatttttgttaagcttatgtataggtattgtgtagatttgttgatatcataaataagatctcttttttcctattttgtcttacatatatttatttttaatgtaaagggaagcttttgattttgtaagttggtcttatattgggcacttttgccacaccatcttatcagtttatcagtttgtagcgtatcttttttctat

SEQ ID NO: 173173 - DNA, 601 bp, Human
tttcttttttttttaagagttgtatgggtttagctattatatttacatctttagccatcttgaattaatttttgtatgtagcttgaagtacaagtccaacttcattcttcggcatgtggacagctagttgttccagaaccatttgttgaaacacctactcttttttctattgaattgtcttggtgactttctccaaatcattttcttttggtaccattcttttctcaaaggtttctaggttatcattccctattttctcttcagatgaattacagaatccaattttaagctacacaataayccattgagatctcagtttgtattacactgaagtacaggtcagtttgggaagaacttatattttcataataaaccgcttgcctattcatgtacatggcaggcctcttcttttaatacggtcatttttatgtcctttagtctagttttagatttttttttccacgtggctgttggaaaatttttgttaagcttatgtataggtattgtgtagatttgttgatatcataaataagatctcttttttcctattttgtcttacatatatttatttttaatgtaaagggaagcttttgattttgta

SEQ ID NO: 173174 - DNA, 601 bp, Human
tagcagtcactttccattccctgctcctccatctctggcaaccattaacctgctttctatctctatggatttgcccgttctgttattttatagaaatggaatcatacaataagtgccttttgtgactggcttctttcacttaagcatggtgttctcaagttcattcatactgaggcatgcattagaatgtcattccttttctacagctgaatcaccttctgccttgtggatgaaaacatattttgcttatccaagtgttgagcacatgagttgtttctactttttgactattatgagtaaygttactatgaacacatgtgtacacatttttgtaaggatgtgtttccagttctcttggatatgcactatgagtagacacgtgggtctaaaagtaaggttgctggttatatggaaactcaatgtttaactttttaaagtactgccaaactgttttgccaagcagctgaaccattttacattcctgtgagcattacacgagggctctaatttccccacatattcaccaacacttgttattgtttatcttttcaattatagccatcctagtggatataaagtggtatttcaatgtggttttggt

SEQ ID NO: 173175 - DNA, 601 bp, Human
cttttaaaagcatatataatcagtgggttttgttgtatattcacaatattatatactcatcaccactaattgattctaaaacatttctgtcacctcagaaagaaatctcatattcattagcagtcactttccattccctgctcctccatctctggcaaccattaacctgctttctatctctatggatttgcccgttctgttattttatagaaatggaatcatacaataagtgccttttgtgactggcttctttcacttaagcatggtgttctcaagttcattcatactgaggcatgcattrgaatgtcattccttttctacagctgaatcaccttctgccttgtggatgaaaacatattttgcttatccaagtgttgagcacatgagttgtttctactttttgactattatgagtaacgttactatgaacacatgtgtacacatttttgtaaggatgtgtttccagttctcttggatatgcactatgagtagacacgtgggtctaaaagtaaggttgctggttatatggaaactcaatgtttaactttttaaagtactgccaaactgttttgccaagcagctgaaccattttacattcctg

SEQ ID NO: 173176 - DNA, 601 bp, Human
gtttgtggtgccacttttgtactctctgtgctagcccactgagacagacatccatttgtctgtttctgtgccaattccacactgttccaatgactattgctctatactctattttgatatcaggtagagttaagttgtcctttaaaattaagattaaattcacttgccataaaactcaccttttaaaagcatatataatcagtgggttttgttgtatattcacaatattatatactcatcaccactaattgattctaaaacatttctgtcacctcagaaagaaatctcatattcattagcrgtcactttccattccctgctcctccatctctggcaaccattaacctgctttctatctctatggatttgcccgttctgttattttatagaaatggaatcatacaataagtgccttttgtgactggcttctttcacttaagcatggtgttctcaagttcattcatactgaggcatgcattagaatgtcattccttttctacagctgaatcaccttctgccttgtggatgaaaacatattttgcttatccaagtgttgagcacatgagttgtttctactttttgactattatgagtaacgtta

SEQ ID NO: 173177 - DNA, 601 bp, Human
cacaaatatgttcttctttattttcttctatctttatagtctgacaattagctctttaatccatctggaattaatttttgtgggactgtgaggttcaatgctaactttcccctaaaaatgagagccagctgtgctttgctgccatttttccttttctcactgatgtgacatgctaccttggcatatatcaaaggcccacagtatgtttgtggtgccacttttgtactctctgtgctagcccactgagacagacatccatttgtctgtttctgtgccaattccacactgttccaatgactaktgctctatactctattttgatatcaggtagagttaagttgtcctttaaaattaagattaaattcacttgccataaaactcaccttttaaaagcatatataatcagtgggttttgttgtatattcacaatattatatactcatcaccactaattgattctaaaacatttctgtcacctcagaaagaaatctcatattcattagcagtcactttccattccctgctcctccatctctggcaaccattaacctgctttctatctctatggatttgcccgttctgttattttatagaaatggaa

SEQ ID NO: 173178 - DNA, 601 bp, Human
gcagctcaggtgttagtctgtctccactgcaccctccttagcacacagctccttcacacacgacaacagtcatgcactttgtccagcgcagagcttggtgtccagtcattctgcccaacaaaacccaccttgactttgctaagaaaaagcaccagatgcaattgagtcatgaagaaaaccagacaccaccatgggaaaggggctaagatgatctcttggtctcaacgtagatgacaaaattctcagatcatctaaaaggcgatgaaaggagggtgatagggttaaggggttgcagggacawttattattctgttgagctttttcatattaattttagaagttctttatatactcaggatattaatactctgcctgttattacatgggaaatgtcttttaactttgcttatggtattttttgttcagagtttccagtgtatatcaatctaaatgcatttgtcgctctcttcatgcattttttgcatagctcaaggtggctgttttcagggtcacaaatatgttcttctttattttcttctatctttatagtctgacaattagctctttaatccatctggaattaatttttgtgggactgtga

SEQ ID NO: 173179 - DNA, 601 bp, Human
ggaaggtcttctaagtctaagacaaaagttcccgtgtgtcatgcctgcaatattctattctttgataatgtcacagcttacaaaaagaaaccacagcacagacacttccttagtgaagacagatatcagtccggaatcaaggttaattttatcatcgagcaaaggttatgctgcagccccaattaagtggcagactggcaagaagtggctgagtatactcagtactcctcactcagatcctctggacgccagctgggtgcaggtctctgcagagaaaggtacatgcatcttctcagggttycctctgagaagctcctcttttgagcagctcaggtgttagtctgtctccactgcaccctccttagcacacagctccttcacacacgacaacagtcatgcactttgtccagcgcagagcttggtgtccagtcattctgcccaacaaaacccaccttgactttgctaagaaaaagcaccagatgcaattgagtcatgaagaaaaccagacaccaccatgggaaaggggctaagatgatctcttggtctcaacgtagatgacaaaattctcagatcatctaaaaggcgatgaaaggagggtgat

SEQ ID NO: 173180 - DNA, 601 bp, Human
aaatgtaataaaacaaggcctaaatctgtggcttatgaaaacgggaaagcagatgagaggaagtgggggtgaagaaggaaggaggggacctcactgaattacccaattgagagctgaaagtctatctcggcaggaaagaaaaataggaaggtcttctaagtctaagacaaaagttcccgtgtgtcatgcctgcaatattctattctttgataatgtcacagcttacaaaaagaaaccacagcacagacacttccttagtgaagacagatatcagtccggaatcaaggttaattttatcatygagcaaaggttatgctgcagccccaattaagtggcagactggcaagaagtggctgagtatactcagtactcctcactcagatcctctggacgccagctgggtgcaggtctctgcagagaaaggtacatgcatcttctcagggtttcctctgagaagctcctcttttgagcagctcaggtgttagtctgtctccactgcaccctccttagcacacagctccttcacacacgacaacagtcatgcactttgtccagcgcagagcttggtgtccagtcattctgcccaacaaaacccaccttg

SEQ ID NO: 173181 - DNA, 601 bp, Human
gaggaggagagaatcccatttcagttataacacatttttgcccacttataataaatcaactgcctcttgtttttaactatagaattttccattgcataaaatattgttctacagtcttaatatttaatgcaaagcccaacatgacccagccagggtctatgtcgggaatatctgatttacttacagattaccaacagcggtttttaaatgaaccctagtttcactcttgtctctctggcaccctacaggaaagccctgatacagaacgttttacaaaatccagcagcaaaacaaatcacaytgacatcgccattttaccctcatgtaaattgtcttttgtaatgagatgaagaactgtagggggtatttaagcacactgtgaaatgtaataaaacaaggcctaaatctgtggcttatgaaaacgggaaagcagatgagaggaagtgggggtgaagaaggaaggaggggacctcactgaattacccaattgagagctgaaagtctatctcggcaggaaagaaaaataggaaggtcttctaagtctaagacaaaagttcccgtgtgtcatgcctgcaatattctattctttgataatgtcaca

SEQ ID NO: 173182 - DNA, 601 bp, Human
atgagaggaggccctttaagatttacattaagccagcagcttcaacattggtatgtaatgttctatcttttagcactgggaattataaagcatcagagccacataaatggaaaataattcacaaaatgcttggatgtagaaactcaaccagttcagtcgcttttaccccaccaggcctgaggatggcactgtaagagggggcatgaacatgaggctaagatcctgggtggccatgctcttgtaagcagtggtagagagggcctccgtgttctcttgcctaggtggaggtgtagctgagctgggagcccccatcactcactctcagtgctttagcacgagcaggaaaagacagaggttgcctgcagtagatggctgaagactagagccgccatggtcatggccacttacctgagaccagaacacgtgctgagactgactgctgaatcagaatatccccgtacatgtccatggtagtaacagtgaccctaaaggggaggaggagagaatcccatttcagttataacacatttttgcccacttataataaatcaactgcctcttgtttttaactatagaattttccattgcataaaatattgtt

SEQ ID NO: 173183 - DNA, 601 bp, Human
aggaagcgggctgtgagtaacacctggggttgacttgtctagcatgggaaggtaattgtttcctgcatcatgcccgtagcatagtagcaaaccccctaccaatccatgcctctattcaactcaccttggttgttgctaaattagtttccttactttgtttcctaatgagaggaggccctttaagatttacattaagccagcagcttcaacattggtatgtaatgttctatcttttagcactgggaattataaagcatcagagccacataaatggaaaataattcacaaaatgcttggatgyagaaactcaaccagttcagtcgcttttaccccaccaggcctgaggatggcactgtaagagggggcatgaacatgaggctaagatcctgggtggccatgctcttgtaagcagtggtagagagggcctccgtgttctcttgcctaggtggaggtgtagctgagctgggagcccccatcactcactctcagtgctttagcacgagcaggaaaagacagaggttgcctgcagtagatggctgaagactagagccgccatggtcatggccacttacctgagaccagaacacgtgctgagactgac

SEQ ID NO: 173184 - DNA, 601 bp, Human
caaatccagtaaaaaggctgaaacagctggaaatttatcaaacaaaatgattttcctggggagcacataagggccacctgatggccaataactgtgatgtggaaggaagcgggctgtgagtaacacctggggttgacttgtctagcatgggaaggtaattgtttcctgcatcatgcccgtagcatagtagcaaaccccctaccaatccatgcctctattcaactcaccttggttgttgctaaattagtttccttactttgtttcctaatgagaggaggccctttaagatttacattaagcyagcagcttcaacattggtatgtaatgttctatcttttagcactgggaattataaagcatcagagccacataaatggaaaataattcacaaaatgcttggatgtagaaactcaaccagttcagtcgcttttaccccaccaggcctgaggatggcactgtaagagggggcatgaacatgaggctaagatcctgggtggccatgctcttgtaagcagtggtagagagggcctccgtgttctcttgcctaggtggaggtgtagctgagctgggagcccccatcactcactctcagtgctttagc

SEQ ID NO: 173185 - DNA, 601 bp, Human
tcttccctcccatggaatcatgctttggtgccttgggccaaagttacccaggactctgaggatacaaacatttagttcacaaactcgataagcaaatccagtaaaaaggctgaaacagctggaaatttatcaaacaaaatgattttcctggggagcacataagggccacctgatggccaataactgtgatgtggaaggaagcgggctgtgagtaacacctggggttgacttgtctagcatgggaaggtaattgtttcctgcatcatgcccgtagcatagtagcaaaccccctaccaatccrtgcctctattcaactcaccttggttgttgctaaattagtttccttactttgtttcctaatgagaggaggccctttaagatttacattaagccagcagcttcaacattggtatgtaatgttctatcttttagcactgggaattataaagcatcagagccacataaatggaaaataattcacaaaatgcttggatgtagaaactcaaccagttcagtcgcttttaccccaccaggcctgaggatggcactgtaagagggggcatgaacatgaggctaagatcctgggtggccatgctcttgt

SEQ ID NO: 173186 - DNA, 601 bp, Human
ttgggtctgtgtctgctaacttggagagacagacagggttgggtgacaaaagaaagccgtagaatgatgtatatgatgtgactctatgtttgtaaaaataaacaaatacacaccccaatctctgactatgtgtttacatgcacaagggatgagaaagctgggaggggaattcccagcttgcatttttatctgagtgggactggaacgggatgaacgaggaagaggaatagctttgtgtacttatttttagttacatgaaaggaccaacgctggtaaatacttagagataaatcagatgtaktgagcaatggggaacatgtgagcaaatagaactctcattctctgctggctggagtagaagtgagggcagcaaagaataaactggtaggtgtgtggttgttgtgtgtgtcacatgcatattctcatcctccatgatcccacacagaacctgcaaagacgtcacaggaactgctgatgcgcagaatgtgattctgctttttaactcaagcaggtatatccttccagggccttctctctcttccctcccatggaatcatgctttggtgccttgggccaaagttacccaggactctgaggatac

SEQ ID NO: 173187 - DNA, 601 bp, Human
aggcctgccccaccacctcttaccagagttactctgaagacacctacccaagcctccgcttctgtgcacattccctacagtctatttccagcctggcagctggagtgcccctgtaaaaatgtgaagtcagaccacatcacttcagctccaagctccctggcacccatcactgggggggaggccaaaggacatctgatcaccttcgtgacccctggtgatcctacctttccacttcccttctgacctcatttctctctactgcctccctgtccctgtccactctagttatgctggccacctygctgctctgggaatatcccaggcatctttctgcttcaggagctttgcacatgctcttctctctgatatgctacctacctcatctaaagggctcacctcacctccttccgaacctccctgactacctgttgcctttcctgtcctccatctcagctttgtctttctccatgatccttgacatcatgtatcttactctatgtccattgtctgttccttccactaggaagtgctccaggaagaatgcattttgttcagtgccgtgcccccagaacctagaacagaactggcaatgaggaagcac

SEQ ID NO: 173188 - DNA, 601 bp, Human
agtgctaggattacaggcgtgagccaccgtgcccccgggcagcttttctcttctttacacacaatgaccttaatgccaaattgaaggctgaaaatatccagccttcaacacatgacctttgaagaaagaggtccacctttcaggccccagagaggcacaatagtaaagtgtggacttccctttccaagtgtgtgtggtccttactaccatggccttgtgtatctctgccctggtctctacaggagctgcaaagctttgcaaggaattatcccaggagtgctgcatgaacaccccccccccmcaactagtccagtcccagaatcaaagaacaaagactgtctcatgatgctcactagaggtgggcacagggcttggctttcctagaggtcactgcatttgtttactgtttctcccctggcacccatcacaggggagaaacaaactcaaactttgtttgaacatgcaaacttcccaccatgcaaactggggctcagagaggcccagtgacctgtccatcgtcacacagctaattcaccaccctgactatcatgttctagggtgagaacatctacctggggtcccagagtatccattttgaatt

SEQ ID NO: 173189 - DNA, 601 bp, Human
tcagtttgaattcgtgttttttttttttttttagttgtagtcttactctgtcgccaggttggagtgcagtggtacaatctcggctcactgcaacccccgcctcccgggttcaagcagttttctgcctcagcctcccaagtagctgggactacaggagcatgccaccacgcccagctaattttcgtatttttagtagagatgggttttcaccatgttggccagaatggtctcgatctcttgaccttgtgatccacccgcctcggcctcccaaagtgctaggattacaggcgtgagccaccgygcccccgggcagcttttctcttctttacacacaatgaccttaatgccaaattgaaggctgaaaatatccagccttcaacacatgacctttgaagaaagaggtccacctttcaggccccagagaggcacaatagtaaagtgtggacttccctttccaagtgtgtgtggtccttactaccatggccttgtgtatctctgccctggtctctacaggagctgcaaagctttgcaaggaattatcccaggagtgctgcatgaacaccccccccccacaactagtccagtcccagaatcaaagaac

SEQ ID NO: 173190 - DNA, 601 bp, Human
atcttggactttacaggctcaagaactgtgagaaataaaattctatggtttaagccaaccagtctatggtattttgctatggcagcccatgctaagatagtgcctgagaatgaaagtaacacagaagaaggtagaggcttgagatagaaaatagaccgtgataatattagctaggaccctgtatccagccatgcctagatttttcagtagcataagcctatctccacattattttgtttttctttaagtcagtttgaattcgtgttttttttttttttttagttgtagtcttactctgtcrccaggttggagtgcagtggtacaatctcggctcactgcaacccccgcctcccgggttcaagcagttttctgcctcagcctcccaagtagctgggactacaggagcatgccaccacgcccagctaattttcgtatttttagtagagatgggttttcaccatgttggccagaatggtctcgatctcttgaccttgtgatccacccgcctcggcctcccaaagtgctaggattacaggcgtgagccaccgtgcccccgggcagcttttctcttctttacacacaatgaccttaatgccaaatt

SEQ ID NO: 173191 - DNA, 601 bp, Human
cttgtcagctcattgatcttggactttacaggctcaagaactgtgagaaataaaattctatggtttaagccaaccagtctatggtattttgctatggcagcccatgctaagatagtgcctgagaatgaaagtaacacagaagaaggtagaggcttgagatagaaaatagaccgtgataatattagctaggaccctgtatccagccatgcctagatttttcagtagcataagcctatctccacattattttgtttttctttaagtcagtttgaattcgtgttttttttttttttttagttgkagtcttactctgtcgccaggttggagtgcagtggtacaatctcggctcactgcaacccccgcctcccgggttcaagcagttttctgcctcagcctcccaagtagctgggactacaggagcatgccaccacgcccagctaattttcgtatttttagtagagatgggttttcaccatgttggccagaatggtctcgatctcttgaccttgtgatccacccgcctcggcctcccaaagtgctaggattacaggcgtgagccaccgtgcccccgggcagcttttctcttctttacacacaatga

SEQ ID NO: 173192 - DNA, 601 bp, Human
gcctcaggaggaaaaatcaatcttgtcagctcattgatcttggactttacaggctcaagaactgtgagaaataaaattctatggtttaagccaaccagtctatggtattttgctatggcagcccatgctaagatagtgcctgagaatgaaagtaacacagaagaaggtagaggcttgagatagaaaatagaccgtgataatattagctaggaccctgtatccagccatgcctagatttttcagtagcataagcctatctccacattattttgtttttctttaagtcagtttgaattcgtgttttttttttttttttagttgtagtcttactctgtcgccaggttggagtgcagtggtacaatctcggctcactgcaacccccgcctcccgggttcaagcagttttctgcctcagcctcccaagtagctgggactacaggagcatgccaccacgcccagctaattttcgtatttttagtagagatgggttttcaccatgttggccagaatggtctcgatctcttgaccttgtgatccacccgcctcggcctcccaaagtgctaggattacaggcgtgagccaccgtgcccccgggcagcttt

SEQ ID NO: 173193 - DNA, 601 bp, Human
aactgcctattatggactgagtgtttatataccctgcaaattcatatgttagagccatggcccccatgtgatggtatcgggagatggggcctttgggagctgatcaggctcagatgagatcatgagggaagccccatgatgggattcgtgcccttataagggacaccagagcttcctccctctgtacacgcacaaagagaggtcacgtgagcacacagcaagctaatgactgcctggaagccaagagaaaaggcctcaggaggaaaaatcaatcttgtcagctcattgatcttggactttmcaggctcaagaactgtgagaaataaaattctatggtttaagccaaccagtctatggtattttgctatggcagcccatgctaagatagtgcctgagaatgaaagtaacacagaagaaggtagaggcttgagatagaaaatagaccgtgataatattagctaggaccctgtatccagccatgcctagatttttcagtagcataagcctatctccacattattttgtttttctttaagtcagtttgaattcgtgttttttttttttttttagttgtagtcttactctgtcgccaggttggagt

SEQ ID NO: 173194 - DNA, 601 bp, Human
cataacctgtttgatcagactactaagctccccactgacaactctgattgtttcacagatgagccagtggcctagtcagagccactgggatgtgtttagatgacctccactgagcttgggagagaggcccttattcttcttcttgctttttgagcatggaagcctcatgctgccaacaaaacaaaacaacaactgcctattatggactgagtgtttatataccctgcaaattcatatgttagagccatggcccccatgtgatggtatcgggagatggggcctttgggagctgatcaggctyagatgagatcatgagggaagccccatgatgggattcgtgcccttataagggacaccagagcttcctccctctgtacacgcacaaagagaggtcacgtgagcacacagcaagctaatgactgcctggaagccaagagaaaaggcctcaggaggaaaaatcaatcttgtcagctcattgatcttggactttacaggctcaagaactgtgagaaataaaattctatggtttaagccaaccagtctatggtattttgctatggcagcccatgctaagatagtgcctgagaatgaaagtaacaca

SEQ ID NO: 173195 - DNA, 601 bp, Human
aggacacctcgtgctcaggtgtcaccaaccccatttaaaaaggaaataactatgatgacaaccagtctctagtgtacgatctgatcgagataccacttcctcatctagcaagtgagcttggctcaggtcttttaaagcacaggtaggccctgaagaaattcagcttcagtcgaacctctgtgcctgcaggtgatgaagacttggggctcattccaatgccaagagcccatgagactcctcctgccagatacctgagtcagagctgagagagcggggcaagagaaccagaaaaattagggaragacaaccttttccctccaggagctcatgctccagccaggagctgaagcagtgggaacgtggcatttaggaacaaactcagaagacgggtgcatggctgttttgatgccccagcaggagcatgacagggctggacgtctatcccattacaaagtacagtgggtcggttcctctgggccaggagctggattctcttcccatctcagtgacagtttgatgtctgtgccctgcagagttgcagattatctgaagctcatggctgtgcctccaggctccctggctggcaggaatgagagcacca

SEQ ID NO: 173196 - DNA, 601 bp, Human
gtgaggacacctcgtgctcaggtgtcaccaaccccatttaaaaaggaaataactatgatgacaaccagtctctagtgtacgatctgatcgagataccacttcctcatctagcaagtgagcttggctcaggtcttttaaagcacaggtaggccctgaagaaattcagcttcagtcgaacctctgtgcctgcaggtgatgaagacttggggctcattccaatgccaagagcccatgagactcctcctgccagatacctgagtcagagctgagagagcggggcaagagaaccagaaaaattagrgaaagacaaccttttccctccaggagctcatgctccagccaggagctgaagcagtgggaacgtggcatttaggaacaaactcagaagacgggtgcatggctgttttgatgccccagcaggagcatgacagggctggacgtctatcccattacaaagtacagtgggtcggttcctctgggccaggagctggattctcttcccatctcagtgacagtttgatgtctgtgccctgcagagttgcagattatctgaagctcatggctgtgcctccaggctccctggctggcaggaatgagagca

SEQ ID NO: 173197 - DNA, 601 bp, Human
gtagaatgaggtatggcagttaccaaggcatgggcaaggaaggataggggccttaagacagggacgtaaacacatatttacaaagcacctgctatgctaccagaactacaatgtatgaggaaatgcatgacagcacatggctgagccagatggtgaggagatggggacaccaggagaggcttcttggaggaggaagcagtgtttgacttgggccttgagggaagagtggatcttccaaagtcaaaagggagggcagggagtagtgtgtcccaggcagaggggcagcaccacgcatgtggcrgcatgctctggaaacagccaaaaaaacagcatggcgggaatagggtggtttcctcaggaaggggatggtgggactgaaaaagaagattggatccaaattatgcaagaggtttaccagaaaaaaaattgaacgggggtcagccaggcttgggtttaagatctagttttgcccactatcactgagaggccatgaggaagtcacttttgtggtctctgctttttacctgtaaaccaaggagcatgagacctgctcgtggcttgtgtgagcttcccatgaggacaaggaaaggtgaggtgccaa

SEQ ID NO: 173198 - DNA, 601 bp, Human
tgcacgtcaaagcttcttgctgactcgtgcacatgtccaacaatatctgcaaacagctgaggtgggcccccagggatggctctcacaggagtttacccggatgtccaaagatctccatgggaggaagcagaagggagaagggaagcagtgtggaaacctggctagagacacctggccagaggttggaggagagccaggtgggctagtcagacaggtgctgatggagcgagcaccacaagtgcaaaggtgaaggtcaaagtggctttaccgccattccatgccaatttcctccttcatatgwtctactgcactttaaatagtttttaaaaagtggattggccaaaattaaggtttatgaactgcctgacctttgggagggcacatctattcctgcactacttactgagtacttgtaacatgccagggtctaggacacagccgtgttggggcacccagtccctgccttcctggaactcccagtgtagcagacaggaaggtgaaggcaaggccacctccatgcacctgaccttctgggtgttagacctatacgttgcaggcacctcgtagaatgaggtatggcagttaccaaggcatgggcaag

SEQ ID NO: 173199 - DNA, 601 bp, Human
gttcaagaccagccggacaacatggcgaaactccatctctattaaaaatacaaaaagtagctgggtgtggtggcacgcacctgtagtcccagctacttgggaggctgatgtgggagaatcgcttgaacccaggaggcagaggttgcagtgagccgagatgtgccactgtactccagcctgggtgacagaacgagagtccctctcaaaaacaaaaaaaacaaaaacaggcaaggggaaagtggaaatgaataccatcaattctgccctaaaaagaaaatggcagtaacatttcattttgtaytgcaacattttctattttacatcggatctaaataagctgaacacttaactgtaaaacatgtcaccacattctaatcatgagaagcaaattactgaaaaagtttttctacatagtggaatatttctagcaattgttacttagtcgtaaaaatattctcttatcttcttttatcttttaagtcatccaaaggccagatgttgagaaatcaggatgaaggccttccctttactgcaaacaattggcagcctataataagcttaattaaataattgctttggactgtcttgggtataattaatc

SEQ ID NO: 173200 - DNA, 601 bp, Human
ttggttttcatttctctctttgctaaggtggggcagtgaagtgctttaatttaaaaggtgcttcctgatgttgagagaaaggttttctttggagaaatgacaatttgggtaacagcaaactggcatctctgaattcccatgtgtctagtaccttatgttatttagcgaggtgaccactatctctccactttagaaagacacaaaattttcatgtaaaattcatctgactggaaatggacccttctaatacagtgactactaaccttttgtgagacatgaacctcctcagactcttcctagrataattcacatacatacctgtaggggctaagggaaaatgtcctcctttgccctctgaaagttcactacaaatcaactgacaaaaggcagaaatattatgggagaaaaggcatacaattttattttaacagtcatagcacaggtgaattgtagaagaatgattactcaatgggggcacagatggttatacacccttcttcttaggagaaagggagatagggaagtatggataattttagggggtgagtaaatgatttttaggggaattcattgggctggaagaacatacaatggcctggga

SEQ ID NO: 173201 - DNA, 601 bp, Human
cctcggcctgcagcttggttttcatttctctctttgctaaggtggggcagtgaagtgctttaatttaaaaggtgcttcctgatgttgagagaaaggttttctttggagaaatgacaatttgggtaacagcaaactggcatctctgaattcccatgtgtctagtaccttatgttatttagcgaggtgaccactatctctccactttagaaagacacaaaattttcatgtaaaattcatctgactggaaatggacccttctaatacagtgactactaaccttttgtgagacatgaacctcctyagactcttcctaggataattcacatacatacctgtaggggctaagggaaaatgtcctcctttgccctctgaaagttcactacaaatcaactgacaaaaggcagaaatattatgggagaaaaggcatacaattttattttaacagtcatagcacaggtgaattgtagaagaatgattactcaatgggggcacagatggttatacacccttcttcttaggagaaagggagatagggaagtatggataattttagggggtgagtaaatgatttttaggggaattcattgggctggaagaacat

SEQ ID NO: 173202 - DNA, 601 bp, Human; identical to SEQ ID NO: 27524

SEQ ID NO: 173203 - DNA, 601 bp, Human; identical to SEQ ID NO: 27525

SEQ ID NO: 173204 - DNA, 601 bp, Human; identical to SEQ ID NO: 27526

SEQ ID NO: 173205 - DNA, 601 bp, Human; identical to SEQ ID NO: 27527

SEQ ID NO: 173206 - DNA, 601 bp, Human; identical to SEQ ID NO: 27528

SEQ ID NO: 173207 - DNA, 601 bp, Human; identical to SEQ ID NO: 27529

SEQ ID NO: 173208 - DNA, 601 bp, Human; identical to SEQ ID NO: 27530

SEQ ID NO: 173209 - DNA, 601 bp, Human; identical to SEQ ID NO: 27531

SEQ ID NO: 173210 - DNA, 601 bp, Human; identical to SEQ ID NO: 27532

SEQ ID NO: 173211 - DNA, 601 bp, Human; identical to SEQ ID NO: 27533

SEQ ID NO: 173212 - DNA, 601 bp, Human; identical to SEQ ID NO: 27534

SEQ ID NO: 173213 - DNA, 601 bp, Human; identical to SEQ ID NO: 27535

SEQ ID NO: 173214 - DNA, 601 bp, Human; identical to SEQ ID NO: 27536

SEQ ID NO: 173215 - DNA, 601 bp, Human; identical to SEQ ID NO: 27537

SEQ ID NO: 173216 - DNA, 601 bp, Human; identical to SEQ ID NO: 27538

SEQ ID NO: 173217 - DNA, 601 bp, Human; identical to SEQ ID NO: 27539

SEQ ID NO: 173218 - DNA, 601 bp, Human; identical to SEQ ID NO: 27540

SEQ ID NO: 173219 - DNA, 601 bp, Human; identical to SEQ ID NO: 27541

SEQ ID NO: 173220 - DNA, 601 bp, Human; identical to SEQ ID NO: 27542

SEQ ID NO: 173221 - DNA, 601 bp, Human; identical to SEQ ID NO: 27543

SEQ ID NO: 173222 - DNA, 601 bp, Human; identical to SEQ ID NO: 27544

SEQ ID NO: 173223 - DNA, 601 bp, Human; identical to SEQ ID NO: 27545

SEQ ID NO: 173224 - DNA, 601 bp, Human
aaccacaaacagaaagatgcccctgaagcctctgcccaaatgggggcgatgaacatgaggaatcagtcacttgctgtaagaagatgcctcctgatggctcccatgaaaggacaatcccctgatgagctgtgtggttctgctcagttcttgtttcaagggcaactcaatgccctacaaactatttcccaggaggcccacaaggctattgcttgaaaaagcacagacacattctttaacaattcctccctctactgggtcttttaaaccgcagtagcaggtatcccctcacaccacgcttgtsccctggccagcaagtcttcacagagatgagtcactgggctgctcagagcacttgcctcttgccccagtgtctccttttgggaaacccagagagcaggcttgggctggaatgttccatgaaagtcagtgttcataaggtttcaaggtataataaagaagatagcattgtatccagcgcatgcttcccgttactaatgagaatcttcttaaactagcacaaagttctagtttgggataggccctttatagatataagaacacatctgaatctctaatccctccaaggtgcatctgtttccac

SEQ ID NO: 173225 - DNA, 601 bp, Human
catattactttttagggtggcctcccttttggagagacacacatgttagtatcttgagttttgcaatatttcatttcctatcggttagtactttgactttgtgtacagatccttggtttctgtcattacacactcacaaagcaacttcctcaacaaagtcttggtgactcccttgaattatgcttaagagggaaccacaaacagaaagatgcccctgaagcctctgcccaaatgggggcgatgaacatgaggaatcagtcacttgctgtaagaagatgcctcctgatggctcccatgaaasgacaatcccctgatgagctgtgtggttctgctcagttcttgtttcaagggcaactcaatgccctacaaactatttcccaggaggcccacaaggctattgcttgaaaaagcacagacacattctttaacaattcctccctctactgggtcttttaaaccgcagtagcaggtatcccctcacaccacgcttgtcccctggccagcaagtcttcacagagatgagtcactgggctgctcagagcacttgcctcttgccccagtgtctccttttgggaaacccagagagcaggcttgggctgga

SEQ ID NO: 173226 - DNA, 601 bp, Human
taaaaaacattaacaatattaacaatatgatcttcttagtcatgggaaaccatttctggaggcccataggctaatgtatttgtgcccatctgatgatcagggaaattagacacacagtgcattttctatggctatgagttcattgagagtgagaaaacacgaaggccactcagttgcacatcagtctcctgccaaactcactgtctgaaagtcacccagcgtgtggcccagcatagcgatcagggcttgtgaaatgttggaaacagaaggcatctataggcccttggcccaaccttatacyctaagaaggaaatccttgccccaaatgtccagcaaacaattactgtgcttcctctcagacacctttagtgactaggaacatattactttttagggtggcctcccttttggagagacacacatgttagtatcttgagttttgcaatatttcatttcctatcggttagtactttgactttgtgtacagatccttggtttctgtcattacacactcacaaagcaacttcctcaacaaagtcttggtgactcccttgaattatgcttaagagggaaccacaaacagaaagatgcccctgaagcc

SEQ ID NO: 173227 - DNA, 601 bp, Human
tggatggatagatggttggatgggtggatgaagactgactcactcatcttattgatgaggaatgtaagagccagggggttactaaactgcctatattattttaaaaaatggtgtgagaattgggacaaccagatctcttcaagtccagtgttcttgatctaggttttcctctcttccattggtttatcaataattaaaaaacattaacaatattaacaatatgatcttcttagtcatgggaaaccatttctggaggcccataggctaatgtatttgtgcccatctgatgatcagggaaatyagacacacagtgcattttctatggctatgagttcattgagagtgagaaaacacgaaggccactcagttgcacatcagtctcctgccaaactcactgtctgaaagtcacccagcgtgtggcccagcatagcgatcagggcttgtgaaatgttggaaacagaaggcatctataggcccttggcccaaccttataccctaagaaggaaatccttgccccaaatgtccagcaaacaattactgtgcttcctctcagacacctttagtgactaggaacatattactttttagggtggcctccctt

SEQ ID NO: 173228 - DNA, 601 bp, Human
ttatataatttttagagctgtagagtcttcatcatctgtgcattcctccccacgagcacaggggtcaaaaatatttgtttaatatgtgaacaagtgggtggagagacagatggaaagaaaggaggaaggaagggtggatgggtggatggatagatggttggatgggtggatgaagactgactcactcatcttattgatgaggaatgtaagagccagggggttactaaactgcctatattattttaaaaaatggtgtgagaattgggacaaccagatctcttcaagtccagtgttcttgatmtaggttttcctctcttccattggtttatcaataattaaaaaacattaacaatattaacaatatgatcttcttagtcatgggaaaccatttctggaggcccataggctaatgtatttgtgcccatctgatgatcagggaaattagacacacagtgcattttctatggctatgagttcattgagagtgagaaaacacgaaggccactcagttgcacatcagtctcctgccaaactcactgtctgaaagtcacccagcgtgtggcccagcatagcgatcagggcttgtgaaatgttggaaaca

SEQ ID NO: 173229 - DNA, 601 bp, Human
aataccggagcagccgggaaaactccaccacgggtgatggatgactgagggttgactgagccgctcgacctccccctcactgtgggcttttgtgattaattcacctacttgcttaggaagttgctttccatctgagaaaattaaaaacaccactctctggacaggaatgtgggatcataaatgagaagcaaatagaaaagatttatacaaaagcacaagctcagcaaaagagaaaactcagaaattgctaatatggtataaatcaaataaaggctattagcaaacccctggtaatgggggaaaaaaaagccttttaaatgatttgtcgagctcttaacaataccatttctacctacggtgttcaaatatctctggggcgatctggcttgcattcttcagcactgccatgaagactttccaattggaaaggatttagataaaaccatatagagtgccagaaaatatgccttgctattgtgccttcagaattatataatttttagagctgtagagtcttcatcatctgtgcattcctccccacgagcacaggggtcaaaaatatttgtttaatatgtgaacaagtgggtggagagacagatgg

SEQ ID NO: 173230 - DNA, 601 bp, Human
gccatcacacggaaactgtggacatgctgctgagtgactgctaagggcactgggagtctttccagcaatgatgagtaggaattctgaaaaagcctttaactttttgatagttccaaaatccctgtaagctaagtaataatatactacctttgtggaatgatttacaatttacagacatgtgatctcattgagtccattctcccactctctcggagacactatgaggtaagagaaccaccattttgagataataccggagcagccgggaaaactccaccacgggtgatggatgactgagggytgactgagccgctcgacctccccctcactgtgggcttttgtgattaattcacctacttgcttaggaagttgctttccatctgagaaaattaaaaacaccactctctggacaggaatgtgggatcataaatgagaagcaaatagaaaagatttatacaaaagcacaagctcagcaaaagagaaaactcagaaattgctaatatggtataaatcaaataaaggctattagcaaacccctggtaatgggggaaaaaaaagccttttaaatgatttgtcgagctcttaacaataccatttctac

SEQ ID NO: 173231 - DNA, 601 bp, Human
atttaactgacatccccaagcctccatcagtggtgggaggaggaagacacaggctggctggtgtttggatgtgggccagtttaaagtgagccatcacacggaaactgtggacatgctgctgagtgactgctaagggcactgggagtctttccagcaatgatgagtaggaattctgaaaaagcctttaactttttgatagttccaaaatccctgtaagctaagtaataatatactacctttgtggaatgatttacaatttacagacatgtgatctcattgagtccattctcccactctctcrgagacactatgaggtaagagaaccaccattttgagataataccggagcagccgggaaaactccaccacgggtgatggatgactgagggttgactgagccgctcgacctccccctcactgtgggcttttgtgattaattcacctacttgcttaggaagttgctttccatctgagaaaattaaaaacaccactctctggacaggaatgtgggatcataaatgagaagcaaatagaaaagatttatacaaaagcacaagctcagcaaaagagaaaactcagaaattgctaatatggtataaat

SEQ ID NO: 173232 - DNA, 601 bp, Human
tctacaatacttggttctttttgattctgagatgttaatatcattaaagcagttactgattcatctctgaatcacctttggagctgagactgaatttaactgacatccccaagcctccatcagtggtgggaggaggaagacacaggctggctggtgtttggatgtgggccagtttaaagtgagccatcacacggaaactgtggacatgctgctgagtgactgctaagggcactgggagtctttccagcaatgatgagtaggaattctgaaaaagcctttaactttttgatagttccaaaayccctgtaagctaagtaataatatactacctttgtggaatgatttacaatttacagacatgtgatctcattgagtccattctcccactctctcggagacactatgaggtaagagaaccaccattttgagataataccggagcagccgggaaaactccaccacgggtgatggatgactgagggttgactgagccgctcgacctccccctcactgtgggcttttgtgattaattcacctacttgcttaggaagttgctttccatctgagaaaattaaaaacaccactctctggacaggaatgt

SEQ ID NO: 173233 - DNA, 601 bp, Human
cccacagcgcccacaggcccatggtcccctgcacctgaactcccttccttccatgctttgcaggctctccatccctgtcttccttttggcctcccccaaacccccacttaaagtgggctccctcaccccatgtttcctctctttgtcctcttcctttgcttccttcacagcactccttccaacctgcaatttattacttttatttttttattttaaaaatagagacagggtcttgctatgttgcccatgctggtcttgaactcctggcctcaagcaatcctcctgccttggcctcccaaartgctgagattacaggtgtgaaccaccacacctggcccaaactgcaagttttaaattttccatttttcaactcttttcaccactagaacaccagttccaagagggcaagaaacaggcttgtcctgttcacagctgtgtccctaacacctatcagtgtgtaacagtggcaggggctcggtgaatatgacttgcagattcacctaccccacccgaggagatggccctattcctccaactctcatttaacagaaactttctgcaaaaaaaaaaaaaaaaaggaatctgtaagagtcattttttg

SEQ ID NO: 173234 - DNA, 601 bp, Human
aagaatccacgttcctgctctggccaactgggctttgctggctctggttcctccatttctacccagcatcacttccctccagccccccacagccccaaggctcctggcagcaaggtgtccccacagcgcccacaggcccatggtcccctgcacctgaactcccttccttccatgctttgcaggctctccatccctgtcttccttttggcctcccccaaacccccacttaaagtgggctccctcaccccatgtttcctctctttgtcctcttcctttgcttccttcacagcactccttccawcctgcaatttattacttttatttttttattttaaaaatagagacagggtcttgctatgttgcccatgctggtcttgaactcctggcctcaagcaatcctcctgccttggcctcccaaagtgctgagattacaggtgtgaaccaccacacctggcccaaactgcaagttttaaattttccatttttcaactcttttcaccactagaacaccagttccaagagggcaagaaacaggcttgtcctgttcacagctgtgtccctaacacctatcagtgtgtaacagtggcaggggctcggtgaa

SEQ ID NO: 173235 - DNA, 601 bp, Human
gcgtgatgagcaccgagtgtgctggtgaaggatccttcctcttcacagtttccaaatgcctatgaattacaccagaactaaactagaattcacacactattattacttgttcttctaaaggaagcctccctcttcttttttgtacagacagaaaaccccttaacttggcaaactacaatatctcagaggctgcatggtcttcttaaaaatgaggaaaccttaaaagataaatcagatcatattcctatcttgcctgagaagcttcaatgatgtcccgctgctctgcagataagaatccacrttcctgctctggccaactgggctttgctggctctggttcctccatttctacccagcatcacttccctccagccccccacagccccaaggctcctggcagcaaggtgtccccacagcgcccacaggcccatggtcccctgcacctgaactcccttccttccatgctttgcaggctctccatccctgtcttccttttggcctcccccaaacccccacttaaagtgggctccctcaccccatgtttcctctctttgtcctcttcctttgcttccttcacagcactccttccaacctgcaattt

SEQ ID NO: 173236 - DNA, 601 bp, Human
gaatccctaaaggatgctcactataggaaaaggaaaaagaaatctcaaaccaaaagaaatattttacatcaagtgtacaaggctggagaggtgagtgtggagcgtggcgtgatgagcaccgagtgtgctggtgaaggatccttcctcttcacagtttccaaatgcctatgaattacaccagaactaaactagaattcacacactattattacttgttcttctaaaggaagcctccctcttcttttttgtacagacagaaaaccccttaacttggcaaactacaatatctcagaggctgcayggtcttcttaaaaatgaggaaaccttaaaagataaatcagatcatattcctatcttgcctgagaagcttcaatgatgtcccgctgctctgcagataagaatccacgttcctgctctggccaactgggctttgctggctctggttcctccatttctacccagcatcacttccctccagccccccacagccccaaggctcctggcagcaaggtgtccccacagcgcccacaggcccatggtcccctgcacctgaactcccttccttccatgctttgcaggctctccatccctgtcttccttt

SEQ ID NO: 173237 - DNA, 601 bp, Human
tgtagctgttcctccttttttctctctctctggataaagatttccattttttcacctaacactttgaggaaggaaatgaagattttcttaaacttttcattgagaaaaaaattatcactctcaaatgaagagttaagatggaaaaataattcccttcaattccatcttggtaaaattccagcatgacaaatgtatttcataatctccaacagcaccccaaagttcgagggagaattctaacgatatgtattgtccactgattttcaggaaagcaagttctacagagtgtggactttcccgytacattgaatttctatcaattcctaccacttccaaagcccttgggggatttttttcactgaaaattgcagttcattttaccctcttaaaacaccttttcaggcagaaatctcttccaagagaaatccagttttcccacagtatgaggtaggaattttcagggagcggtctgcccagcctgtatttaattcttctgagatcggtttagactggactctattccaggatatcttttctgcctgctgcctcttctaacctttgctccctgtttgcaataaattattggtcgctttttaaaaga

SEQ ID NO: 173238 - DNA, 601 bp, Human
caggagcctgaggctgcaggctgagatccagaatgaccctgaccacctgtgggccctctggccttcctgagcctcagtgtgctcacctgtaaaatggagacgattgtacctgttctttatttttagggctgtgacaatgaaaggagatgccaaagatctttgtaaactggagaatggttctacaaagtcttatgctcacaactgcttttagatttgatatttttgatctctctcttcccactttagctaaattaagcaaagactttcaggggaaggccctgctggaaagactctactgttygaaagcaaattgtttccctcacccaggtctccatggattatgtacagaaaagcagtggactctgcctcctatttatctgggttttctctgctctattttgtttttattttcttctatttattgtattgtgtgtatcattacaaactattgtaaatccattgtagaatgatgtggaataaacaaaaaatgaaaatgctgctgctgcaattgctagatttagtacaaaagacagtggcctcagagcgttctccccagagattttgccattacacagatgaggaagagaaaacctcactctgc

SEQ ID NO: 173239 - DNA, 601 bp, Human
tgtatcagacgagctactcagcttcattgcaagaaatgactgctgaatttgtgtgggggttgttggaggagcagactctcgtagacatggacagatgcagtggttaataatggacagtgggcatgtctgaaatggtaccaccctttcttcctagcccagtagacagacctgcacagaatacgctagttctttctgctgacttagcaagcctgtaacaggatagaggcttctaatcaaacatgatagaaaaagcagtcacggtagatatctacaagcctgccaccagggctgaagtctacaygtgcccagttcttgccccactgagcaactgacactgaagttaccaccagggcaatgtggaactcaagaatgggaaagagctgtccctctcaaccctccccatccccaagcctgcgagccaaaggctcacaggtacccggtgaaaggccaaagaatggatcaggagcctgaggctgcaggctgagatccagaatgaccctgaccacctgtgggccctctggccttcctgagcctcagtgtgctcacctgtaaaatggagacgattgtacctgttctttatttttagggctgtgacaatgaa

SEQ ID NO: 173240 - DNA, 601 bp, Human
acgttaccagaaagtggacttttcacttctgagctacgatggctatttcttcctgcaccaagtcctgaaagaccaagaacccaggggcgggggacacagtgtccatattaaaaggacctcagcccatcagaggccatgtatcagacgagctactcagcttcattgcaagaaatgactgctgaatttgtgtgggggttgttggaggagcagactctcgtagacatggacagatgcagtggttaataatggacagtgggcatgtctgaaatggtaccaccctttcttcctagcccagtagacmgacctgcacagaatacgctagttctttctgctgacttagcaagcctgtaacaggatagaggcttctaatcaaacatgatagaaaaagcagtcacggtagatatctacaagcctgccaccagggctgaagtctacacgtgcccagttcttgccccactgagcaactgacactgaagttaccaccagggcaatgtggaactcaagaatgggaaagagctgtccctctcaaccctccccatccccaagcctgcgagccaaaggctcacaggtacccggtgaaaggccaaagaatggatcagga

SEQ ID NO: 173241 - DNA, 601 bp, Human
tctgctcctcctccctgaaaccaatttaagtgcaaatataatttcccagaatttttaataaagtcaccaactgagctctggtcagttgagacatgtacaggaagcttctggacgttaccagaaagtggacttttcacttctgagctacgatggctatttcttcctgcaccaagtcctgaaagaccaagaacccaggggcgggggacacagtgtccatattaaaaggacctcagcccatcagaggccatgtatcagacgagctactcagcttcattgcaagaaatgactgctgaatttgtgwgggggttgttggaggagcagactctcgtagacatggacagatgcagtggttaataatggacagtgggcatgtctgaaatggtaccaccctttcttcctagcccagtagacagacctgcacagaatacgctagttctttctgctgacttagcaagcctgtaacaggatagaggcttctaatcaaacatgatagaaaaagcagtcacggtagatatctacaagcctgccaccagggctgaagtctacacgtgcccagttcttgccccactgagcaactgacactgaagttaccaccagggca

SEQ ID NO: 173242 - DNA, 601 bp, Human
aacacctgggccccagaatgcagccatctgcagcacattataattcatggtcttaacttgtgaactttgacctctgctcctcctccctgaaaccaatttaagtgcaaatataatttcccagaatttttaataaagtcaccaactgagctctggtcagttgagacatgtacaggaagcttctggacgttaccagaaagtggacttttcacttctgagctacgatggctatttcttcctgcaccaagtcctgaaagaccaagaacccaggggcgggggacacagtgtccatattaaaaggacytcagcccatcagaggccatgtatcagacgagctactcagcttcattgcaagaaatgactgctgaatttgtgtgggggttgttggaggagcagactctcgtagacatggacagatgcagtggttaataatggacagtgggcatgtctgaaatggtaccaccctttcttcctagcccagtagacagacctgcacagaatacgctagttctttctgctgacttagcaagcctgtaacaggatagaggcttctaatcaaacatgatagaaaaagcagtcacggtagatatctacaagcctgcca

SEQ ID NO: 173243 - DNA, 601 bp, Human
atccttagtaggccatttccattgttaatagcaaacacctgggccccagaatgcagccatctgcagcacattataattcatggtcttaacttgtgaactttgacctctgctcctcctccctgaaaccaatttaagtgcaaatataatttcccagaatttttaataaagtcaccaactgagctctggtcagttgagacatgtacaggaagcttctggacgttaccagaaagtggacttttcacttctgagctacgatggctatttcttcctgcaccaagtcctgaaagaccaagaacccagkggcgggggacacagtgtccatattaaaaggacctcagcccatcagaggccatgtatcagacgagctactcagcttcattgcaagaaatgactgctgaatttgtgtgggggttgttggaggagcagactctcgtagacatggacagatgcagtggttaataatggacagtgggcatgtctgaaatggtaccaccctttcttcctagcccagtagacagacctgcacagaatacgctagttctttctgctgacttagcaagcctgtaacaggatagaggcttctaatcaaacatgatagaaa

SEQ ID NO: 173244 - DNA, 601 bp, Human
cttctcttcccaagtgagagcgaggtcctcttacagtatgagggggcaggggaccgcagtgtggggaatggacattgcttggacaagctgctgaccaaaaattctagggccatcttcaggaaaatcttcaggtctttccccagttatgcccaacaataaaaactttcaatcaccacacacagaatttatgtgcaaccaagtagcacgcctggtaggccagggcggtggcatttgtactcgcaggtgaccggcctcatgttcagtgccgtggcaggcctgctgtggatgcaaggaggtcatmtcattttaggggctttttactccatcctgcctggagcggggctggccaggagctaccatttgtttagtgaaaccctgctggggaccagaagcctggcagacattctctcactgacacctctgggagccaattatgactcctattttagagatgaggaagctgagtgcaggcagcttgggttccttgccgggaccctgcagtttctgcgtggagactgaaagcacagatctgactagaaggcctgtgttcttcccactcaaccacaccgcctcgagggctatcaggagctgccccagggca

SEQ ID NO: 173245 - DNA, 601 bp, Human
gagcttttccaaaaacaacttagccattcttagttcacagccagttctacatattcctagtcccttgagaagcataagcccaacatgaattccctcttctcttcccaagtgagagcgaggtcctcttacagtatgagggggcaggggaccgcagtgtggggaatggacattgcttggacaagctgctgaccaaaaattctagggccatcttcaggaaaatcttcaggtctttccccagttatgcccaacaataaaaactttcaatcaccacacacagaatttatgtgcaaccaagtagcaygcctggtaggccagggcggtggcatttgtactcgcaggtgaccggcctcatgttcagtgccgtggcaggcctgctgtggatgcaaggaggtcatatcattttaggggctttttactccatcctgcctggagcggggctggccaggagctaccatttgtttagtgaaaccctgctggggaccagaagcctggcagacattctctcactgacacctctgggagccaattatgactcctattttagagatgaggaagctgagtgcaggcagcttgggttccttgccgggaccctgcagtttct

SEQ ID NO: 173246 - DNA, 601 bp, Human
cattccataactagcttgctgagcttttccaaaaacaacttagccattcttagttcacagccagttctacatattcctagtcccttgagaagcataagcccaacatgaattccctcttctcttcccaagtgagagcgaggtcctcttacagtatgagggggcaggggaccgcagtgtggggaatggacattgcttggacaagctgctgaccaaaaattctagggccatcttcaggaaaatcttcaggtctttccccagttatgcccaacaataaaaactttcaatcaccacacacagaatktatgtgcaaccaagtagcacgcctggtaggccagggcggtggcatttgtactcgcaggtgaccggcctcatgttcagtgccgtggcaggcctgctgtggatgcaaggaggtcatatcattttaggggctttttactccatcctgcctggagcggggctggccaggagctaccatttgtttagtgaaaccctgctggggaccagaagcctggcagacattctctcactgacacctctgggagccaattatgactcctattttagagatgaggaagctgagtgcaggcagcttgggttcctt

SEQ ID NO: 173247 - DNA, 601 bp, Human
cgcctcccgggttcaagcgattctcctgcctcagcttcctgagtagctgggattacaggtgcacaccaccatgcctggctaatttttttgtatttttattagagatggggttttgccatgttggccaggctggtctcaaactcctgacctcgggtgatccacccacctcggcctcccaaagtgctgggattacaggcgtgagccaccatgccggccacaacttttatcattcattccataactagcttgctgagcttttccaaaaacaacttagccattcttagttcacagccagttctayatattcctagtcccttgagaagcataagcccaacatgaattccctcttctcttcccaagtgagagcgaggtcctcttacagtatgagggggcaggggaccgcagtgtggggaatggacattgcttggacaagctgctgaccaaaaattctagggccatcttcaggaaaatcttcaggtctttccccagttatgcccaacaataaaaactttcaatcaccacacacagaatttatgtgcaaccaagtagcacgcctggtaggccagggcggtggcatttgtactcgcaggtgaccggcctc

SEQ ID NO: 173248 - DNA, 601 bp, Human
gaagcaaaacagcctgttccattctggaagggccagtttttctttagctcaacaagagcatgtagttaggagcacaaccaaccaatgaagcaatccacaaacaaaacaaaaacgccatttagatggctgttacctgctacgcagctgtggttgtcttctgttcctgaaagcttttttctggcccttttcctaaagctcatgtcacatgagctcaccccacatcttccgtccatttcctggccacagccaagtccaggcactgagctcagagtgagacgtggccacaaattgtgggatccaytctctggagaagacaatctaatgactgtttttttttttttttttttttttttttatgtggagtttcgctctgtagcccaggttggagttcagtggtgcgatctcggctcaccgtaacttccgcctcccgggttcaagcgattctcctgcctcagcttcctgagtagctgggattacaggtgcacaccaccatgcctggctaatttttttgtatttttattagagatggggttttgccatgttggccaggctggtctcaaactcctgacctcgggtgatccacccacctcggcctcccaaa

SEQ ID NO: 173249 - DNA, 601 bp, Human
aagttgcagggaaccggggatgggaatccatccagatttttcagtttaaactgattgggggaaaaaaacaaaacaaaacaaaaaacaacctcatatcgtccacagctgacaaatgattagatggtaaagggctaactggttttggaaaatatgttgctgacattctgcttcccactggtttctttttgcagaccaaaatggagttttgtttttctcctgacagcagatgccacagattcggcagacccaggaggctcttctttacctgggcgtgtggtgagaactcaagtccgaagcctawgtctgagcagcctatctgtacttcattgagcctctgttttcacatctataaaatagggataacaactacctcattgcactgaagtggaggctaaacgagcttcaaacaaaaagatcaaagtctggttaacttccaagcactgtgaaatgctagctcctagtactgacaggcaaaagatgtgtctttctttctcccattgggagttgccctgactgcgaatccccccgtatatgatagtgctcaagaacatttccaatatggtatagaatgtagtacttgtagccaaaatagagcacgctt

SEQ ID NO: 173250 - DNA, 601 bp, Human
aacagccaggcagcggctgagaacagcttggagccgacataactgtgtgataggaaaagccaaagttgcagggaaccggggatgggaatccatccagatttttcagtttaaactgattgggggaaaaaaacaaaacaaaacaaaaaacaacctcatatcgtccacagctgacaaatgattagatggtaaagggctaactggttttggaaaatatgttgctgacattctgcttcccactggtttctttttgcagaccaaaatggagttttgtttttctcctgacagcagatgccacagattsggcagacccaggaggctcttctttacctgggcgtgtggtgagaactcaagtccgaagcctaagtctgagcagcctatctgtacttcattgagcctctgttttcacatctataaaatagggataacaactacctcattgcactgaagtggaggctaaacgagcttcaaacaaaaagatcaaagtctggttaacttccaagcactgtgaaatgctagctcctagtactgacaggcaaaagatgtgtctttctttctcccattgggagttgccctgactgcgaatccccccgtatatgatagt

SEQ ID NO: 173251 - DNA, 601 bp, Human
aatcaggctggattcaaggggggctgcaggtcagggtcctgctgcttcctgtgactctgcggcctcattaataaacacgcactgagtctaggttccccacctccaagctcaggggctcacatctgtctgagtgctgacggcaggaaaggagtggaagtgaccgaggaagaaggatggaacagccaggcagcggctgagaacagcttggagccgacataactgtgtgataggaaaagccaaagttgcagggaaccggggatgggaatccatccagatttttcagtttaaactgattgggggaaaaaaacaaaacaaaacaaaaaacaacctcatatcgtccacagctgacaaatgattagatggtaaagggctaactggttttggaaaatatgttgctgacattctgcttcccactggtttctttttgcagaccaaaatggagttttgtttttctcctgacagcagatgccacagattcggcagacccaggaggctcttctttacctgggcgtgtggtgagaactcaagtccgaagcctaagtctgagcagcctatctgtacttcattgagcctctgttttcacatctataaaatagggata

SEQ ID NO: 173252 - DNA, 601 bp, Human
gttatctgacttgcaaaagctctctgggtatgatttggagacaactgcttttcttgctggaaattaggcgtctggagaaaccagctataatcaggctggattcaaggggggctgcaggtcagggtcctgctgcttcctgtgactctgcggcctcattaataaacacgcactgagtctaggttccccacctccaagctcaggggctcacatctgtctgagtgctgacggcaggaaaggagtggaagtgaccgaggaagaaggatggaacagccaggcagcggctgagaacagcttggagccracataactgtgtgataggaaaagccaaagttgcagggaaccggggatgggaatccatccagatttttcagtttaaactgattgggggaaaaaaacaaaacaaaacaaaaaacaacctcatatcgtccacagctgacaaatgattagatggtaaagggctaactggttttggaaaatatgttgctgacattctgcttcccactggtttctttttgcagaccaaaatggagttttgtttttctcctgacagcagatgccacagattcggcagacccaggaggctcttctttacctgggcgtg

SEQ ID NO: 173253 - DNA, 601 bp, Human
ccttgacagtagaagtcgggagttatctgacttgcaaaagctctctgggtatgatttggagacaactgcttttcttgctggaaattaggcgtctggagaaaccagctataatcaggctggattcaaggggggctgcaggtcagggtcctgctgcttcctgtgactctgcggcctcattaataaacacgcactgagtctaggttccccacctccaagctcaggggctcacatctgtctgagtgctgacggcaggaaaggagtggaagtgaccgaggaagaaggatggaacagccaggcagcrgctgagaacagcttggagccgacataactgtgtgataggaaaagccaaagttgcagggaaccggggatgggaatccatccagatttttcagtttaaactgattgggggaaaaaaacaaaacaaaacaaaaaacaacctcatatcgtccacagctgacaaatgattagatggtaaagggctaactggttttggaaaatatgttgctgacattctgcttcccactggtttctttttgcagaccaaaatggagttttgtttttctcctgacagcagatgccacagattcggcagacccaggag

SEQ ID NO: 173254 - DNA, 601 bp, Human
ataaaggcagtcacagcttcatattttagccatcacaaagctgccaagtaaaatattattagggcttacttttactttgaaaaatctgcagtcagaaggttcttttcttgtaggagcctattgtgcgtctcactgctatattcttgggggtgaatcacactaggccaatttatcaaccttgacagtagaagtcgggagttatctgacttgcaaaagctctctgggtatgatttggagacaactgcttttcttgctggaaattaggcgtctggagaaaccagctataatcaggctggattcaaggggggctgcaggtcagggtcctgctgcttcctgtgactctgcggcctcattaataaacacgcactgagtctaggttccccacctccaagctcaggggctcacatctgtctgagtgctgacggcaggaaaggagtggaagtgaccgaggaagaaggatggaacagccaggcagcggctgagaacagcttggagccgacataactgtgtgataggaaaagccaaagttgcagggaaccggggatgggaatccatccagatttttcagtttaaactgattgggggaaaaaaacaaaacaaa

SEQ ID NO: 173255 - DNA, 601 bp, Human
cagctgggtgattttggggaaaaaaacaccacttttaaaaagaggaatgccacttacagctccccaccataaaggcagtcacagcttcatattttagccatcacaaagctgccaagtaaaatattattagggcttacttttactttgaaaaatctgcagtcagaaggttcttttcttgtaggagcctattgtgcgtctcactgctatattcttgggggtgaatcacactaggccaatttatcaaccttgacagtagaagtcgggagttatctgacttgcaaaagctctctgggtatgattyggagacaactgcttttcttgctggaaattaggcgtctggagaaaccagctataatcaggctggattcaaggggggctgcaggtcagggtcctgctgcttcctgtgactctgcggcctcattaataaacacgcactgagtctaggttccccacctccaagctcaggggctcacatctgtctgagtgctgacggcaggaaaggagtggaagtgaccgaggaagaaggatggaacagccaggcagcggctgagaacagcttggagccgacataactgtgtgataggaaaagccaaagttgcag

SEQ ID NO: 173256 - DNA, 601 bp, Human
aaatggtgatacctgcggcccaggaaaaaaaagtgctgctttcagctcagaggcagagaatttatctccaaagccgtggcagggtgactgtggcccccgctacgatgtgacctcttttgttagccttgctttcctttttctctaatatttaactaccagggacacttgaggcaagtttaccatgttgaatgcaaggttaaaaataaaaagaggatgaaacagacagctgggtgattttggggaaaaaaacaccacttttaaaaagaggaatgccacttacagctccccaccataaaggcartcacagcttcatattttagccatcacaaagctgccaagtaaaatattattagggcttacttttactttgaaaaatctgcagtcagaaggttcttttcttgtaggagcctattgtgcgtctcactgctatattcttgggggtgaatcacactaggccaatttatcaaccttgacagtagaagtcgggagttatctgacttgcaaaagctctctgggtatgatttggagacaactgcttttcttgctggaaattaggcgtctggagaaaccagctataatcaggctggattcaaggggggct

SEQ ID NO: 173257 - DNA, 601 bp, Human
tgagagactggtgcaaagcaataaaactggagaattactcaggaaagaagccctttagcacgatcctttcccttggcgtgagaatgctttaaaatggtgatacctgcggcccaggaaaaaaaagtgctgctttcagctcagaggcagagaatttatctccaaagccgtggcagggtgactgtggcccccgctacgatgtgacctcttttgttagccttgctttcctttttctctaatatttaactaccagggacacttgaggcaagtttaccatgttgaatgcaaggttaaaaataaaaagaggatgaaacagacagctgggtgattttggggaaaaaaacaccacttttaaaaagaggaatgccacttacagctccccaccataaaggcagtcacagcttcatattttagccatcacaaagctgccaagtaaaatattattagggcttacttttactttgaaaaatctgcagtcagaaggttcttttcttgtaggagcctattgtgcgtctcactgctatattcttgggggtgaatcacactaggccaatttatcaaccttgacagtagaagtcgggagttatctgacttgcaaaagctc

SEQ ID NO: 173258 - DNA, 601 bp, Human
cacaatgttgtgtagccatcactactaactgcagaacttccccccacccctcaaacaaaccccacatccatgaagccatcactcctcattctccattccccacccagcccctgccaaccacgaatctgctttctgtctctacagatcgcctgttctgttcatttcatgtacacggaatcctacaccatgtggccttttgtgtttggctcctttcccttagaatagtgttctcgaggttcagccacatggtagcatgcatcggaacctcattccttcttatggctggatgatattccattgyaagtgagaccataccacaatttgctatctgctcatctgttaatgatccaggtgattttgatgcccattagagactggaaacaacttccctagatttaaaattcaaatgctgttgtacctatttgtgtcgtgacaataaaaaatgcaatctagactcaccatgggccacttgtcatatcctaaaaaataattctgttttgctctcttgtcccatcttctaagaaaagcccaatgtatggcattttgaaaacctgacctgattttgtgatcacatgaaagatgtgccaatggacaacaggca

SEQ ID NO: 173259 - DNA, 601 bp, Human
cacttcgaaatatgtaatccaatgtttttttccagcacattcacaatgttgtgtagccatcactactaactgcagaacttccccccacccctcaaacaaaccccacatccatgaagccatcactcctcattctccattccccacccagcccctgccaaccacgaatctgctttctgtctctacagatcgcctgttctgttcatttcatgtacacggaatcctacaccatgtggccttttgtgtttggctcctttcccttagaatagtgttctcgaggttcagccacatggtagcatgcatyggaacctcattccttcttatggctggatgatattccattgcaagtgagaccataccacaatttgctatctgctcatctgttaatgatccaggtgattttgatgcccattagagactggaaacaacttccctagatttaaaattcaaatgctgttgtacctatttgtgtcgtgacaataaaaaatgcaatctagactcaccatgggccacttgtcatatcctaaaaaataattctgttttgctctcttgtcccatcttctaagaaaagcccaatgtatggcattttgaaaacctgacctga

SEQ ID NO: 173260 - DNA, 601 bp, Human
taaaattcatcctttaagtcacttcgaaatatgtaatccaatgtttttttccagcacattcacaatgttgtgtagccatcactactaactgcagaacttccccccacccctcaaacaaaccccacatccatgaagccatcactcctcattctccattccccacccagcccctgccaaccacgaatctgctttctgtctctacagatcgcctgttctgttcatttcatgtacacggaatcctacaccatgtggccttttgtgtttggctcctttcccttagaatagtgttctcgaggttcakccacatggtagcatgcatcggaacctcattccttcttatggctggatgatattccattgcaagtgagaccataccacaatttgctatctgctcatctgttaatgatccaggtgattttgatgcccattagagactggaaacaacttccctagatttaaaattcaaatgctgttgtacctatttgtgtcgtgacaataaaaaatgcaatctagactcaccatgggccacttgtcatatcctaaaaaataattctgttttgctctcttgtcccatcttctaagaaaagcccaatgtatggca

SEQ ID NO: 173261 - DNA, 601 bp, Human
tgaatgctgaaacacagaaggtgattgattaatcctcaatgtaccgatttaaacacaggagacaaatcctgctgtgatcccacatatgcctggaccagtggttctcaaagtgtgctcccaggacaagcagcaccaggaactttctagaaatgcacattctcaagccccactcagacctactaagtcagaaaactcaaggtaggggcctagcaacctgtattttaataagctctgcagacgatttgctaaattgatgttgaatttacacaacataaaattcatcctttaagtcacttcgaartatgtaatccaatgtttttttccagcacattcacaatgttgtgtagccatcactactaactgcagaacttccccccacccctcaaacaaaccccacatccatgaagccatcactcctcattctccattccccacccagcccctgccaaccacgaatctgctttctgtctctacagatcgcctgttctgttcatttcatgtacacggaatcctacaccatgtggccttttgtgtttggctcctttcccttagaatagtgttctcgaggttcagccacatggtagcatgcatcggaacctca

SEQ ID NO: 173262 - DNA, 601 bp, Human
ggagtacctgcttttagctaggtgatatggtggtgctttctcatggtaatatttttcttcttttatacttttttttgaatttaaaattttggaacaatccaatgaaacagttattattgctccatttgcaaatgaggtgaagggatttgacagttcacagttaggggatggcagtactagatttcaccaattcttatgattccacgttcaggtactaaaaaccattttctttattaccagtgccagttcagcactggatgaccagcagtgaatgctgaaacacagaaggtgattgattaaycctcaatgtaccgatttaaacacaggagacaaatcctgctgtgatcccacatatgcctggaccagtggttctcaaagtgtgctcccaggacaagcagcaccaggaactttctagaaatgcacattctcaagccccactcagacctactaagtcagaaaactcaaggtaggggcctagcaacctgtattttaataagctctgcagacgatttgctaaattgatgttgaatttacacaacataaaattcatcctttaagtcacttcgaaatatgtaatccaatgtttttttccagcacattc

SEQ ID NO: 173263 - DNA, 601 bp, Human
taatttttttggcataactatttatggagtacctgcttttagctaggtgatatggtggtgctttctcatggtaatatttttcttcttttatacttttttttgaatttaaaattttggaacaatccaatgaaacagttattattgctccatttgcaaatgaggtgaagggatttgacagttcacagttaggggatggcagtactagatttcaccaattcttatgattccacgttcaggtactaaaaaccattttctttattaccagtgccagttcagcactggatgaccagcagtgaatgcygaaacacagaaggtgattgattaatcctcaatgtaccgatttaaacacaggagacaaatcctgctgtgatcccacatatgcctggaccagtggttctcaaagtgtgctcccaggacaagcagcaccaggaactttctagaaatgcacattctcaagccccactcagacctactaagtcagaaaactcaaggtaggggcctagcaacctgtattttaataagctctgcagacgatttgctaaattgatgttgaatttacacaacataaaattcatcctttaagtcacttcgaaatatgtaa

SEQ ID NO: 173264 - DNA, 601 bp, Human
gccttcatgtgtcaccatattctggccacaacattataaattcccaagactagtaattgagttaaaatatataatttttttggcataactatttatggagtacctgcttttagctaggtgatatggtggtgctttctcatggtaatatttttcttcttttatacttttttttgaatttaaaattttggaacaatccaatgaaacagttattattgctccatttgcaaatgaggtgaagggatttgacagttcacagttaggggatggcagtactagatttcaccaattcttatgattccaygttcaggtactaaaaaccattttctttattaccagtgccagttcagcactggatgaccagcagtgaatgctgaaacacagaaggtgattgattaatcctcaatgtaccgatttaaacacaggagacaaatcctgctgtgatcccacatatgcctggaccagtggttctcaaagtgtgctcccaggacaagcagcaccaggaactttctagaaatgcacattctcaagccccactcagacctactaagtcagaaaactcaaggtaggggcctagcaacctgtattttaataagctctgcag

SEQ ID NO: 173265 - DNA, 601 bp, Human
gcagtccaaggctgtgttgtaagttctcgctgccttcatgtgtcaccatattctggccacaacattataaattcccaagactagtaattgagttaaaatatataatttttttggcataactatttatggagtacctgcttttagctaggtgatatggtggtgctttctcatggtaatatttttcttcttttatacttttttttgaatttaaaattttggaacaatccaatgaaacagttattattgctccatttgcaaatgaggtgaagggatttgacagttcacagttaggggatggcartactagatttcaccaattcttatgattccacgttcaggtactaaaaaccattttctttattaccagtgccagttcagcactggatgaccagcagtgaatgctgaaacacagaaggtgattgattaatcctcaatgtaccgatttaaacacaggagacaaatcctgctgtgatcccacatatgcctggaccagtggttctcaaagtgtgctcccaggacaagcagcaccaggaactttctagaaatgcacattctcaagccccactcagacctactaagtcagaaaactcaaggtaggggc

SEQ ID NO: 173266 - DNA, 601 bp, Human
ggccaggtgcatcacctgctccccaggtgctgactctgcctacatacctctgatgatggcagaatacaactttgagtggcaaattcacaactctctcatttattcactcacttatggagcaatagttttcaagtgtctattatactcaaagcactgaagaggatcccaattccaatatgacctgaacctggtcccatgccccccttgccaagctccttccttaagggatgtgcccaccctcctatctcatttcctctccagccgttctccaaggcccatataattccactcctccagaaayggtctttgaagtcccaaacccccagaaacatatcttttatgccacataaatggagtctgagtggaactgtgcagtccaaggctgtgttgtaagttctcgctgccttcatgtgtcaccatattctggccacaacattataaattcccaagactagtaattgagttaaaatatataatttttttggcataactatttatggagtacctgcttttagctaggtgatatggtggtgctttctcatggtaatatttttcttcttttatacttttttttgaatttaaaattttggaacaatccaat

SEQ ID NO: 173267 - DNA, 601 bp, Human
acatcctaagtagccactggttacctagtgcctagagcaaagcaggtgccaatgctcagcaaggccaggtgcatcacctgctccccaggtgctgactctgcctacatacctctgatgatggcagaatacaactttgagtggcaaattcacaactctctcatttattcactcacttatggagcaatagttttcaagtgtctattatactcaaagcactgaagaggatcccaattccaatatgacctgaacctggtcccatgccccccttgccaagctccttccttaagggatgtgcccaccytcctatctcatttcctctccagccgttctccaaggcccatataattccactcctccagaaacggtctttgaagtcccaaacccccagaaacatatcttttatgccacataaatggagtctgagtggaactgtgcagtccaaggctgtgttgtaagttctcgctgccttcatgtgtcaccatattctggccacaacattataaattcccaagactagtaattgagttaaaatatataatttttttggcataactatttatggagtacctgcttttagctaggtgatatggtggtgctttct

SEQ ID NO: 173268 - DNA, 601 bp, Human
aatggtaacaccatcttaatccacacatattagaatattttctacatcctaagtagccactggttacctagtgcctagagcaaagcaggtgccaatgctcagcaaggccaggtgcatcacctgctccccaggtgctgactctgcctacatacctctgatgatggcagaatacaactttgagtggcaaattcacaactctctcatttattcactcacttatggagcaatagttttcaagtgtctattatactcaaagcactgaagaggatcccaattccaatatgacctgaacctggtcccrtgccccccttgccaagctccttccttaagggatgtgcccaccctcctatctcatttcctctccagccgttctccaaggcccatataattccactcctccagaaacggtctttgaagtcccaaacccccagaaacatatcttttatgccacataaatggagtctgagtggaactgtgcagtccaaggctgtgttgtaagttctcgctgccttcatgtgtcaccatattctggccacaacattataaattcccaagactagtaattgagttaaaatatataatttttttggcataactattt

SEQ ID NO: 173269 - DNA, 601 bp, Human
taatggtaacaccatcttaatccacacatattagaatattttctacatcctaagtagccactggttacctagtgcctagagcaaagcaggtgccaatgctcagcaaggccaggtgcatcacctgctccccaggtgctgactctgcctacatacctctgatgatggcagaatacaactttgagtggcaaattcacaactctctcatttattcactcacttatggagcaatagttttcaagtgtctattatactcaaagcactgaagaggatcccaattccaatatgacctgaacctggtccyatgccccccttgccaagctccttccttaagggatgtgcccaccctcctatctcatttcctctccagccgttctccaaggcccatataattccactcctccagaaacggtctttgaagtcccaaacccccagaaacatatcttttatgccacataaatggagtctgagtggaactgtgcagtccaaggctgtgttgtaagttctcgctgccttcatgtgtcaccatattctggccacaacattataaattcccaagactagtaattgagttaaaatatataatttttttggcataactatt

SEQ ID NO: 173270 - DNA, 601 bp, Human
atctaatctttgacaaaaattgacaaaaataaacaatggtgaaaggactccctattcaataataaatgctgctgggataactggctaaccatatgcagaagattgaaactgaacccctacctctcaccatttacaaaaattaactcaagatggattaaagatttaaaggtgtttttcataagaactccaaacccttattcccccacctttttatttttttaaagcaaactgctttttaagcaggcaaaggtctgctcctcatctcccttttgctgctctaagatagtctcatttgatcaaracacagaactaagtatggaaaacttacagcaaacccaatgactgccccccaatacaaaaaatttaataaatgaaaattacttcaaatcttaagagataagggaaatttgccagtagcgaatattagattcctctaatggtaacaccatcttaatccacacatattagaatattttctacatcctaagtagccactggttacctagtgcctagagcaaagcaggtgccaatgctcagcaaggccaggtgcatcacctgctccccaggtgctgactctgcctacatacctctgatgatggca

SEQ ID NO: 173271 - DNA, 601 bp, Human
gattggaagaatcaatattgttaacatgttcatactacccaaagcaatgtacagattacaatgtaaataacaatgtaatttttcacagaattagaaaaaactatcctaaaattcatatggaaccaaaaaggagcctgaataaccaaagctatcttaggcaaaaagaacaaagccagaggtatcatattatctgactttaaactatattataaggctacagtaaccaaaacagcatggtagtggtacaaaaacagacacatagaccaatggaacagaatagagaccccagaaataaaccccsacacctataaccatctaatctttgacaaaaattgacaaaaataaacaatggtgaaaggactccctattcaataataaatgctgctgggataactggctaaccatatgcagaagattgaaactgaacccctacctctcaccatttacaaaaattaactcaagatggattaaagatttaaaggtgtttttcataagaactccaaacccttattcccccacctttttatttttttaaagcaaactgctttttaagcaggcaaaggtctgctcctcatctcccttttgctgctctaagatagtc

SEQ ID NO: 173272 - DNA, 601 bp, Human
tccaatccactgttgaagggcacctaggttgattccatgtcttcgctattgtgaatagcgctataatgaaagtatgagggcacgtgtctttttggtagaatgagttattttcttttggatatatacacagtagtggggttgctgggtcaaatgggagttctgttttaagttcttcgagaaactgccaaactgctttccacagtggctagccttgccagcatctgttatttctgactttttaataatcgccattctgactggtgtgagatggtatctcactgtggttttgatttgcatttcyctgatgattagtgttgttgaacattttttcatatggtcacttgtatgtctccttttgagaggtgtctgtttatgtcctttgcccatttttaaattgaactatttgttttttacttgttgatttaagttccttgtagattctggatattagacctttgtcagatgcatagtttgtgaatattttctcccattctgtaggctgtctgttggtaatttctttggctgtgcagaagctctttaattaggtcccacttgtcaatttttgtttatgttgcaattgcttttggggactcagccataa

SEQ ID NO: 173273 - DNA, 601 bp, Human
ccatctaatagtccccagtgtctgttgtactcatctttacatctacgtgtattcaatgtttagtgcccacttataagtgagaacacgtggtatttgacttgctattcttgcactaatttgcttaggataatggcctccggctccatccatgttgctgcaaaggacataatttcgttcttttgatggctgtgtagtattccataccacgttttctttatccaatccactgttgaagggcacctaggttgattccatgtcttcgctattgtgaatagcgctataatgaaagtatgagggcacrtgtctttttggtagaatgagttattttcttttggatatatacacagtagtggggttgctgggtcaaatgggagttctgttttaagttcttcgagaaactgccaaactgctttccacagtggctagccttgccagcatctgttatttctgactttttaataatcgccattctgactggtgtgagatggtatctcactgtggttttgatttgcatttccctgatgattagtgttgttgaacattttttcatatggtcacttgtatgtctccttttgagaggtgtctgtttatgtcctttgcc

SEQ ID NO: 173274 - DNA, 601 bp, Human
gctcttcctgcagacacacacccagagaggcaacccattttctacttggcatcattcttagataggtcaaggtcatgctgatggtgagaagatcccatggagtgtcaatacactgggagctgtgcctctgtatgggccaggcactgggaatgactgaaggtatttttatttattttaaataatttcaacttttattagcaatgaaggggtacatgtgcaaatttgtcacatggatatattgcatgatgctggggtctggggtcctgtcacccaggtagtgagcatagtacccaataggtgktttttcagctcttgctcccctcccatcctcccccatctaatagtccccagtgtctgttgtactcatctttacatctacgtgtattcaatgtttagtgcccacttataagtgagaacacgtggtatttgacttgctattcttgcactaatttgcttaggataatggcctccggctccatccatgttgctgcaaaggacataatttcgttcttttgatggctgtgtagtattccataccacgttttctttatccaatccactgttgaagggcacctaggttgattccatgtcttcgctattg

SEQ ID NO: 173275 - DNA, 601 bp, Human
tgataggatatttatgaaccctatttgggcagttagaggaagtcaggctttagaggaagaaaatcagaacagcctatcacacatcattccattattccccaagtatttattcaacaccgactaggtgccaggcattgttctaggctttggggatatgggaatgaagagaacaaaaaaatctcagccctcatggagcttgcattcagtggggccaacagataataggcaagctaagggaacagaatgagttagaaagagtagaattaaggagaaaaaaataaaagagcaagggaagagggtrtgtattgaacttttagggacagtggacctcaccaggaaacctcaccagtaagagggtcatttgagcccctcacccgaagggaagaaggtgtgagtgcacctcgggaaagagctggtacaagtgtctgcagacaggactggcctggaggaacttactcaacagtgggaaacagtctgctcttcctgcagacacacacccagagaggcaacccattttctacttggcatcattcttagataggtcaaggtcatgctgatggtgagaagatcccatggagtgtcaatacactgggagctgtgc

SEQ ID NO: 173276 - DNA, 601 bp, Human
atgtgtaggagaggagaacagaacagatcatcattggcaaagatcatcattgtatttttgtgtctgcattgggtgttgtcagactgtatagtgatctgtgtaataatctatttctacttcccttagcttttcctcattctgctgaaggacaactcccaagtgttaacaaaattctttctcatttagaatcatgcatacataaatggtcgtcatccaattcacgggttttcaaccttgctctgaggaacagcatcctagcattaattcttcagggatgcctctgttttaaaaggaaagtagygatgtcctcctcagatgcgaaatgaggtcttgatgaattcaccaacactgaacagatcctttctcagggctcctttccacatggcctgagctcaccagcatgccgcctgccttccaggtcaggacaattcaaacttccagcaactcctgaccatgggtgacagctccagccatgagcaggtgtgagtggcttctcttcccaccaacctggggtttttctgacttgctcaggcgacccagcaaggtcaatggggagtccagcagcccttccacaaacattcctgccatttcctcggactgg

SEQ ID NO: 173277 - DNA, 601 bp, Human
tcattctcactcagtgatacgcaacttagttctgtgacaaaccattatcagttcattctagaagggaagtgatttctagaaaatattagagttaattaggaaagactctaggataaatgttaagtctcaggaagggtttatagccagaatcacagcaattaagagaagcctggaaaagagtggtctgaattggcctgtttcccaaaggagcagagaacgtccgtagaccccagggattggagagctgagaccagctccgttcactaagctcagacatgccttccccatctcattcctttcaaagcaacaaacacacaaacattgggttttttgggggtttcccatccaaataggatgaaggagaacagtttaagtccaggatttaaacttcagaatgtgtaggagaggagaacagaacagatcatcattggcaaagatcatcattgtatttttgtgtctgcattgggtgttgtcagactgtatagtgatctgtgtaataatctatttctacttcccttagcttttcctcattctgctgaaggacaactcccaagtgttaacaaaattctttctcatttagaatcatgcatacataaatggt

SEQ ID NO: 173278 - DNA, 601 bp, Human
gaggtacagatggaaacttcttctgtatctgagagttttcctaggacatatatgtctccaggcctgatctaggagatgaaacatcattctcactcagtgatacgcaacttagttctgtgacaaaccattatcagttcattctagaagggaagtgatttctagaaaatattagagttaattaggaaagactctaggataaatgttaagtctcaggaagggtttatagccagaatcacagcaattaagagaagcctggaaaagagtggtctgaattggcctgtttcccaaaggagcagagaaygtccgtagaccccagggattggagagctgagaccagctccgttcactaagctcagacatgccttccccatctcattcctttcaaagcaacaaacacacaaacattgggttttttgggggtttcccatccaaataggatgaaggagaacagtttaagtccaggatttaaacttcagaatgtgtaggagaggagaacagaacagatcatcattggcaaagatcatcattgtatttttgtgtctgcattgggtgttgtcagactgtatagtgatctgtgtaataatctatttctacttccctt

SEQ ID NO: 173279 - DNA, 601 bp, Human
tggccaaaccaacgcaagctgctacgctcccctgatgatggtagaccagcggccacttaatgattgagcttggtgaattttgagatcatgctgatttccaggaccaaactgataacactgcaccatcctctccgagtggtttcccttttcttccccaagtatataaggcatactattaggcacagatttttaatgaccaggtatttattttttcttaacttcattttctgagaccgagtctcactctgttgcccatgctggagtgcagtgtctcactgcaacctccgcctcccggattcargtaactctcctgcctcagcctctcaagtagctgggattacaggcgcccaccaccatgcctggctaattttgtatttttagtagagatggggtttcaccatgttggccaggctggcctcaaactcctgagctcaggtgatctgcccgcctcggcctcccaaagtgctgggattataggcatgagcctttaagcctggcccttaactttttttttttaactttaattgtaggttcaggggtacatgggcaggtttgttatgtaggtagactgcatgttagcgaggtttggtgtacagattat

SEQ ID NO: 173280 - DNA, 601 bp, Human
ggatctcaatcaattggccaaaccaacgcaagctgctacgctcccctgatgatggtagaccagcggccacttaatgattgagcttggtgaattttgagatcatgctgatttccaggaccaaactgataacactgcaccatcctctccgagtggtttcccttttcttccccaagtatataaggcatactattaggcacagatttttaatgaccaggtatttattttttcttaacttcattttctgagaccgagtctcactctgttgcccatgctggagtgcagtgtctcactgcaacctccrcctcccggattcaagtaactctcctgcctcagcctctcaagtagctgggattacaggcgcccaccaccatgcctggctaattttgtatttttagtagagatggggtttcaccatgttggccaggctggcctcaaactcctgagctcaggtgatctgcccgcctcggcctcccaaagtgctgggattataggcatgagcctttaagcctggcccttaactttttttttttaactttaattgtaggttcaggggtacatgggcaggtttgttatgtaggtagactgcatgttagcgaggttt

SEQ ID NO: 173281 - DNA, 601 bp, Human
agtcttcttgtatccttgttctgggaatggttcttacctctggctccccacagtcacactcctctccttcttccacaaatctgttcccacacttctggcccccgaaagactccctgacttccggcaggttaaacaggcacacccccattcctttctccaggctggtctccaagtccttcctgctgcaactgctgaacaccatgggaaatgggtacctgagaaaggagagcccagaacagtaagtcacagggcatggaatggctttgtctgcccttcttgtgcccacaagaaggcacccacyggccacatctgcccaggtgttcactggtggtctcaatgaacaatgcatatcaaaaaactcagatatgcagtgtcaagtgaggcacattcagttccatcccgacatccattccgtacagtgccaacgcggctgatgaagaagtgctttatcaaaaaagaaatgatctttcgatggttttcaaatcaataagttcaggcagagtctcattaaagacattattaatagttctgggtgaaatgatgctacgaaaagtgaattcgtagggactgtagcttgtaatacaaacacataacaatgtcc

SEQ ID NO: 173282 - DNA, 601 bp, Human; identical to SEQ ID NO: 27546

SEQ ID NO: 173283 - DNA, 601 bp, Human; identical to SEQ ID NO: 27547

SEQ ID NO: 173284 - DNA, 601 bp, Human; identical to SEQ ID NO: 27548

SEQ ID NO: 173285 - DNA, 601 bp, Human; identical to SEQ ID NO: 27549

SEQ ID NO: 173286 - DNA, 601 bp, Human; identical to SEQ ID NO: 27550

SEQ ID NO: 173287 - DNA, 601 bp, Human; identical to SEQ ID NO: 27551

SEQ ID NO: 173288 - DNA, 601 bp, Human; identical to SEQ ID NO: 27552

SEQ ID NO: 173289 - DNA, 601 bp, Human; identical to SEQ ID NO: 27553

SEQ ID NO: 173290 - DNA, 601 bp, Human; identical to SEQ ID NO: 27554

SEQ ID NO: 173291 - DNA, 601 bp, Human
cttctgtatcccccggggcgcacagtaggtgctcctgcagctcctgttggaccgcactgagcttcttaaggccaggctccaggcagtgtccatttctgtgcaccccatgcccagtgcggcctcagaccctccctgggagtcaatcactcccgactgaacacaccggatgctgtgtggacagcgcccgccaggagtgggggctaaccaaaacagagcacatgcccccagtcccacagcccaggtctgccagtgcctctcctgatgccgagcttgtggcggccacgtacctggtccccagagygtgacacactgctgctcgtgagtctggcagatgccattgtagcagtagccgtccacatcctgacatgagtgcccatcgtgcaggtacacgttggctgggcagtgagggctggcccctgtgcagaactctgggaggtcacaggagttgctggagtccctgcacgctgttcctgcaggcttcagctggaaggagagggccatttatgacacatgcacccggggaaagggagaggcagctctcagcattactcctgggctggagtggacaaggccataagtcccacataaggggtgaggattt

SEQ ID NO: 173292 - DNA, 601 bp, Human
tcccggggcacacaggtgctcctgcatcttctgtatcccccggggcgcacagtaggtgctcctgcagctcctgttggaccgcactgagcttcttaaggccaggctccaggcagtgtccatttctgtgcaccccatgcccagtgcggcctcagaccctccctgggagtcaatcactcccgactgaacacaccggatgctgtgtggacagcgcccgccaggagtgggggctaaccaaaacagagcacatgcccccagtcccacagcccaggtctgccagtgcctctcctgatgccgagcttgyggcggccacgtacctggtccccagagcgtgacacactgctgctcgtgagtctggcagatgccattgtagcagtagccgtccacatcctgacatgagtgcccatcgtgcaggtacacgttggctgggcagtgagggctggcccctgtgcagaactctgggaggtcacaggagttgctggagtccctgcacgctgttcctgcaggcttcagctggaaggagagggccatttatgacacatgcacccggggaaagggagaggcagctctcagcattactcctgggctggagtggacaaggcca

SEQ ID NO: 173293 - DNA, 601 bp, Human
ctatgctatctgagggcaggagtcatggtggattcatccctgccatccctcggggcacgcagtaggtgctcctgcagctcccgtatctcccggggcacacaggtgctcctgcatcttctgtatcccccggggcgcacagtaggtgctcctgcagctcctgttggaccgcactgagcttcttaaggccaggctccaggcagtgtccatttctgtgcaccccatgcccagtgcggcctcagaccctccctgggagtcaatcactcccgactgaacacaccggatgctgtgtggacagcgcccrccaggagtgggggctaaccaaaacagagcacatgcccccagtcccacagcccaggtctgccagtgcctctcctgatgccgagcttgtggcggccacgtacctggtccccagagcgtgacacactgctgctcgtgagtctggcagatgccattgtagcagtagccgtccacatcctgacatgagtgcccatcgtgcaggtacacgttggctgggcagtgagggctggcccctgtgcagaactctgggaggtcacaggagttgctggagtccctgcacgctgttcctgcaggcttcagctgg

SEQ ID NO: 173294 - DNA, 601 bp, Human
acaaaggggcattactaaaatctcagtggtggtgggaaagttctgtctgtctgtccaactacgtgctatgctatctgagggcaggagtcatggtggattcatccctgccatccctcggggcacgcagtaggtgctcctgcagctcccgtatctcccggggcacacaggtgctcctgcatcttctgtatcccccggggcgcacagtaggtgctcctgcagctcctgttggaccgcactgagcttcttaaggccaggctccaggcagtgtccatttctgtgcaccccatgcccagtgcggccycagaccctccctgggagtcaatcactcccgactgaacacaccggatgctgtgtggacagcgcccgccaggagtgggggctaaccaaaacagagcacatgcccccagtcccacagcccaggtctgccagtgcctctcctgatgccgagcttgtggcggccacgtacctggtccccagagcgtgacacactgctgctcgtgagtctggcagatgccattgtagcagtagccgtccacatcctgacatgagtgcccatcgtgcaggtacacgttggctgggcagtgagggctggcccctgtgc

SEQ ID NO: 173295 - DNA, 601 bp, Human
tctgaccccagaaggtggggcatggaggagagacacgcaggggatggattcttcccttttgcatctgagcttctgcttcattttggagctttggtggagctttagagcaacacctccctcttcagggtgactgtgcattgtgggagtaacacatgggcattgggtcacagtaacccaggttcaaatcctagcccggagacctggggaaactgacatttggtctcagagtttgagcatcatcttctgtaaagcttcatagtccccacttcaggggcttgttggagggtcagaagagacaaastgtgccaagtgcccagcctgaactggtgaaatggtgaactgatggtctcttgtttgacgcaaccaccccactttcccatttgagagccactcactgctgctctcaggccttccgattacagacacactcatgcttcaagtctgatcagggccttccccatggagccctgggcccctcacttggttggggtcctcttatgagtacaaaggggcattactaaaatctcagtggtggtgggaaagttctgtctgtctgtccaactacgtgctatgctatctgagggcaggagtcatggtggat

SEQ ID NO: 173296 - DNA, 601 bp, Human
aaacccaggcttcgaggtttagtcatcaatttctgttccactttatttccctcatcactcctaaaaccaaagcctcacaacaaaagtctgacaaaggtcctatcaggtttccctcccgctagagatcctgcctgattctgcttggctttcagcctgggcctggccgaccacaagaggccttgccagagctggggtctctggcctgggctgaggtcatttctgcagccagcaggaggagggagtgacaaaggactcaaccacattatcataagggaaagagaactgcaggacagggtggggsctgcacttgtggatttcacggttggactcctgggagctggacacaggcattgaatctcaaatggttctggggtgacggggccttggagtccagggctgcccaatgaggccttggatctctgaccccagaaggtggggcatggaggagagacacgcaggggatggattcttcccttttgcatctgagcttctgcttcattttggagctttggtggagctttagagcaacacctccctcttcagggtgactgtgcattgtgggagtaacacatgggcattgggtcacagtaacccaggttca

SEQ ID NO: 173297 - DNA, 601 bp, Human
gtggtcaaaggcccattccaagagctccctggcatcaagggccacagtgggttgcagccttccctgctctctgctctcccaaggaagtctgtataatgatctgaagaactgaggaggggcgggcaggacagaccaaaacccaggaagtcacaagcccgaggtggcttcccaagcctggtctctgtgctgtggctttcaggaaccctgagccaaagataaagcctcttcaccaaaactttacatttgttaccaacagtcctgatgccatggatgttccatgctgtgtgcagtggccacacaygacaccacccaccaccaccccagcaaaggcctcctggttaccagggagagagtgggtgggagagagtagagctaagccaggagctcccagggaagccccctccttaggaagaggacgtggctacctgggtgctcagacctccagcctccccctccatcatggggatgatgagagcccaagcaggtgacttcctattgctcttgcttttgaaaagctcagtctgtgggtcaggttgtcagtctgtctgcctgtctggttctctctctggtcaggcagctacagaaggactagactgatgag

SEQ ID NO: 173298 - DNA, 601 bp, Human
cgacaaggggaggaaggagcacactgcactcccaaaggaggtggtcaaaggcccattccaagagctccctggcatcaagggccacagtgggttgcagccttccctgctctctgctctcccaaggaagtctgtataatgatctgaagaactgaggaggggcgggcaggacagaccaaaacccaggaagtcacaagcccgaggtggcttcccaagcctggtctctgtgctgtggctttcaggaaccctgagccaaagataaagcctcttcaccaaaactttacatttgttaccaacagtcctkatgccatggatgttccatgctgtgtgcagtggccacacacgacaccacccaccaccaccccagcaaaggcctcctggttaccagggagagagtgggtgggagagagtagagctaagccaggagctcccagggaagccccctccttaggaagaggacgtggctacctgggtgctcagacctccagcctccccctccatcatggggatgatgagagcccaagcaggtgacttcctattgctcttgcttttgaaaagctcagtctgtgggtcaggttgtcagtctgtctgcctgtctggttct

SEQ ID NO: 173299 - DNA, 601 bp, Human
taaacgccaaccacagtttgaactgtgaataacatttgtatgtttgaaatcaacataggaagtcttgagataccagatttgtgggacaaaaatcagtgagaaaaaaattatactctcagccaacgagaacgtacgttatcaacaacaaaaacaattagaacaacaaataaatgaacaaaaaacccaaaggcattctcaaagtgtattgctttgccagttagaagttgcaggcatgtgttttgaattttctgttgttttatttgtagaaagatttggaagcaggattgttttattgaaatayaacgccagattgagaaaagcccatttcaaaagggaatcattagttggaaggaagggcttcgtccagtcagtgtttgggtcgccagatctggagggtgagtaatggacatcctgaatgtaactggagaattctgggcaactcagcaactcgggcaaggtcactggggtgcaaatgtcaagggccggtggggcaaggactcaaggactcttagagctctgagttcctacatttcccaggaggcctgtgatgaccccagtgcatacgtgatccagatcctgaagcatttgctcctgggtgggg

SEQ ID NO: 173300 - DNA, 601 bp, Human
agtaaccatgctggtggttctcacaaaaaacattggtaaaagtaaatttgctacctaaacaaaaatatccagctatatttcagaaggagtaaaggtcatgtcatattgacagaaaatctttgtagatattaagactaaactgggcaaagagagctaaacgccaaccacagtttgaactgtgaataacatttgtatgtttgaaatcaacataggaagtcttgagataccagatttgtgggacaaaaatcagtgagaaaaaaattatactctcagccaacgagaacgtacgttatcaacaacmaaaacaattagaacaacaaataaatgaacaaaaaacccaaaggcattctcaaagtgtattgctttgccagttagaagttgcaggcatgtgttttgaattttctgttgttttatttgtagaaagatttggaagcaggattgttttattgaaatataacgccagattgagaaaagcccatttcaaaagggaatcattagttggaaggaagggcttcgtccagtcagtgtttgggtcgccagatctggagggtgagtaatggacatcctgaatgtaactggagaattctgggcaactcagcaa

SEQ ID NO: 173301 - DNA, 601 bp, Human
tcacttgatgggacaaaagggagactttcctgacttctaaacaataagacttctggcaaaaatctctttttttcccatctgtggccacaggagttgtaggtgattcataaatgcactgccccaagtgggtcacaataaaccaagctcatgtaaaccagatttgcaaataaacactgagtattcaccagcccataaaaatggtctggtcagctcacactgcagaaaccaaacattagattctggtgagtgataaaatagaaaaaactaacacatttcgggaattctctgatgccagttgttygtgactatagatgtgtagttatctgtaagattaattgccaaggaatattttcagtaaccatgctggtggttctcacaaaaaacattggtaaaagtaaatttgctacctaaacaaaaatatccagctatatttcagaaggagtaaaggtcatgtcatattgacagaaaatctttgtagatattaagactaaactgggcaaagagagctaaacgccaaccacagtttgaactgtgaataacatttgtatgtttgaaatcaacataggaagtcttgagataccagatttgtgggacaaaaatc

SEQ ID NO: 173302 - DNA, 601 bp, Human
tccaaatgaacaaatttgatcatttctttctcacttgatgggacaaaagggagactttcctgacttctaaacaataagacttctggcaaaaatctctttttttcccatctgtggccacaggagttgtaggtgattcataaatgcactgccccaagtgggtcacaataaaccaagctcatgtaaaccagatttgcaaataaacactgagtattcaccagcccataaaaatggtctggtcagctcacactgcagaaaccaaacattagattctggtgagtgataaaatagaaaaaactaacayatttcgggaattctctgatgccagttgtttgtgactatagatgtgtagttatctgtaagattaattgccaaggaatattttcagtaaccatgctggtggttctcacaaaaaacattggtaaaagtaaatttgctacctaaacaaaaatatccagctatatttcagaaggagtaaaggtcatgtcatattgacagaaaatctttgtagatattaagactaaactgggcaaagagagctaaacgccaaccacagtttgaactgtgaataacatttgtatgtttgaaatcaacataggaagtc

SEQ ID NO: 173303 - DNA, 601 bp, Human
cagttttatcttcagagtgctataacttatatttgtaattgtagtttggaagttcccaatgtcattatgttttttttgaaagagaaatgatggcatcttgaattaagcccacaatttactcaatctaatcttacttaaaatgactccacgatgcaaatgtacttccccagttcagtcaaatcagctcctccttccctgtgtcactgatttccctaacccctgccactaacatccacagacaaaggcatttttacagacaactggagactgtattgtccttcccatctctcttcttcagacrgacctttgtattcatcagaaaatgaagtccaaatgaacaaatttgatcatttctttctcacttgatgggacaaaagggagactttcctgacttctaaacaataagacttctggcaaaaatctctttttttcccatctgtggccacaggagttgtaggtgattcataaatgcactgccccaagtgggtcacaataaaccaagctcatgtaaaccagatttgcaaataaacactgagtattcaccagcccataaaaatggtctggtcagctcacactgcagaaaccaaacattagattctgg

SEQ ID NO: 173304 - DNA, 601 bp, Human
taggtattttgccattatcaaaagataaaatttagcctttcagagggaattttgacaccatactatattttataatgatgtagaaagtgatggattttaattaccagttttatcttcagagtgctataacttatatttgtaattgtagtttggaagttcccaatgtcattatgttttttttgaaagagaaatgatggcatcttgaattaagcccacaatttactcaatctaatcttacttaaaatgactccacgatgcaaatgtacttccccagttcagtcaaatcagctcctccttccctgtgtcactgatttccctaacccctgccactaacatccacagacaaaggcatttttacagacaactggagactgtattgtccttcccatctctcttcttcagacagacctttgtattcatcagaaaatgaagtccaaatgaacaaatttgatcatttctttctcacttgatgggacaaaagggagactttcctgacttctaaacaataagacttctggcaaaaatctctttttttcccatctgtggccacaggagttgtaggtgattcataaatgcactgccccaagtgggtcacaataaa

SEQ ID NO: 173305 - DNA, 601 bp, Human
cgacagctgcctcatgctcatgtctcaggtgctgaactgacctgggtcacggcctaccccctgcacctgagcatgcttagtgagatttccctttaaaactgggacaatggaggcaggcagcagatatttgtatgctttttgttgcatctatactgattcagggaaagaaatgaaaaattcggagtagaatgacttggaaacctctgagggagcagttcctcaagaaataaatctcagtgaagtttggccagtaaaactgactccactctgccattaattcatccagtggcttgaacgatgygaggttctaaaggttaactttctgtctacctccaggaaggcaataacggtcaccttctaagagtttcattcatttgagctttcacccaaaacatgagggagtgagggatgccatatcatactttaccactgaaatatggccaggacgtgatgtccctgaggcacagcaatgatagggctcactgccacatggcaaagaaaaggggcatttgcaggagaggcaggctatgatttcatcagccatgtaaacacggggataggacagatgcatttctctatggaatcaaaggcccgaatgcat

SEQ ID NO: 173306 - DNA, 601 bp, Human
ccactcttccaacactttttaatagagaaagtgagcactttctctattagcccagtgggtgtatattcataacctccacaactgaaccacccactctattgcttatgaaagtgaacccttaaaagctcttttaccagaataaccaaaatgggatgaagtcacagccgaagaataatatttaagcatgtgatagatgcacctgcctttttttaaacctgattttgtcaggcagccttgatgaacctgcgtggatgcaggatgatgagcgccaaagcgccttcccacctgctctgcgacatcyaaaaggtgtggctgagagagtgacaggtcagtggttagcgattctttttgctgactactttcagggggaagccttgttttatagctgggcatgtatggggtctaagaaaaatacctaatgcctatcagtcttcagcctttttagattgccccctcctgtctgactgatctactcagtaaccatgcttcagagttggaagaacaaaggcttggaactcgggctgatctggcattcaatgtccaaaaggccttgttgtacaagctctcgaggttctgtcccctcatctgtaaaatggggaca

SEQ ID NO: 173307 - DNA, 601 bp, Human
cacttccggctttctcaagatgctgacattttttcttctgttatgttatcgctggaaatcttgtttctaggttcaagtacccactcttccaacactttttaatagagaaagtgagcactttctctattagcccagtgggtgtatattcataacctccacaactgaaccacccactctattgcttatgaaagtgaacccttaaaagctcttttaccagaataaccaaaatgggatgaagtcacagccgaagaataatatttaagcatgtgatagatgcacctgcctttttttaaacctgatkttgtcaggcagccttgatgaacctgcgtggatgcaggatgatgagcgccaaagcgccttcccacctgctctgcgacatccaaaaggtgtggctgagagagtgacaggtcagtggttagcgattctttttgctgactactttcagggggaagccttgttttatagctgggcatgtatggggtctaagaaaaatacctaatgcctatcagtcttcagcctttttagattgccccctcctgtctgactgatctactcagtaaccatgcttcagagttggaagaacaaaggcttggaactcggg

SEQ ID NO: 173308 - DNA, 601 bp, Human
atggtacacgccccagcagaaggccacctggcatttcaggagcaccgccattctcccaaagacaaaccctcagaaaggcttgtggccaattcgaatatgtgaatttttaccaacacagatgacacagtcaagcatcatcttataatatgctgtcaattaacttaatgagaaacagttaaaagaatcacattttaatttagattgtcttaaaaaaaaaacctctcccacaccgtggaacaattttactgagatgacgtttcctttggtctcagtctttttattttttttgagagagagtttygctcttgttgcccgggctcgagtgcaatggtgtgatctcggctcactgcaacctctgcctcccgggttcaagctattctcctgcctcagcctctcatttagctggaattacaggtgcccaccaccacgactggctaatattttgtatttttagtagagatggggtttcaccatgttggccagggtggtctcgaactcctgacctcaggtgattcacccacctcagcctcccaaaatgctgggattacaggcgtgagccaccgtacctggcctggtctcagtcttcttgctttccatggca

SEQ ID NO: 173309 - DNA, 601 bp, Human
accaggtgtgtgtaagatgcaatgccttgtttaccaataacgcagaagcatggtacacgccccagcagaaggccacctggcatttcaggagcaccgccattctcccaaagacaaaccctcagaaaggcttgtggccaattcgaatatgtgaatttttaccaacacagatgacacagtcaagcatcatcttataatatgctgtcaattaacttaatgagaaacagttaaaagaatcacattttaatttagattgtcttaaaaaaaaaacctctcccacaccgtggaacaattttactgagaygacgtttcctttggtctcagtctttttattttttttgagagagagtttcgctcttgttgcccgggctcgagtgcaatggtgtgatctcggctcactgcaacctctgcctcccgggttcaagctattctcctgcctcagcctctcatttagctggaattacaggtgcccaccaccacgactggctaatattttgtatttttagtagagatggggtttcaccatgttggccagggtggtctcgaactcctgacctcaggtgattcacccacctcagcctcccaaaatgctgggattacaggc

SEQ ID NO: 173310 - DNA, 601 bp, Human
gtttcagacacgtgagctcacaaacagctcaacaggagcctgggaggagagttggacgaggttggactggggagtacagaaggataaaaacaaagagaggaagggggagagagagaggacgagaaagagaccaacctcaacagggattgaagaggctgcaaatgtactggcaaagcaaaggggaagcttgatacgtgaataccagataaagggctatcgttatgataggaagtcaagcaaaggcatggaaacagtgtgtaatcaagtataaaagcattctggaagtgaaaacactggatcyctacttgggaatccaaagctgaaacacactgagccttctgggtcagagtgtgacgtggtttggatctgtgtccccaccaagtctcatgtagaattataattcccaatgttggaggtaggacctggtaggaggcgattggatcatgggggcagtttctcttgaatggtttagcaccatcaccttggtgctattcttgggatagtgagttgagatctggtcgtttaaaagtgtgtggcacctcccttttccttctctctcttgctcctgctccggccgcgtgatgtgcctgcttctccttca

SEQ ID NO: 173311 - DNA, 601 bp, Human
tccatccatccatccatccagccagccagccacccatccatccatccatccatccatccatccatccatccagccagccagccacctgtccatccatccagccagccacccgtccatccatccagccagccagccagccacccatccatccatccagccagccagccagccatcatgttgcaggcttcaatcagacacatgtatttattcagcacctactatcttccagacattgggagtataagagggaccaaactggacaaacctcctgcttgcttgaaaattgcaaggagacacagaraaaagacccaaatgattatgttcctctaaagcccagtgttagggaatgctatgaaggtagaaacagagtaggagggttcaggggactgttgcttttaaaggcaggctggtcaaggaagacctcttagagaagacatcatgagctgaatcctaccatttaatcctacaaggtaggtctcattattccattttatggacaagaaaattagcacatcagaggttaaatatatttctcagattcacataggtaacgaaggcaggatcatctaagggtgaagccaggcttctgggctgttccctc

SEQ ID NO: 173312 - DNA, 601 bp, Human
tttcctccctccttcccttcctacttccttccatcatccatttatatacccatctatccattcatccatccatccactcgtccatccagccagccacccagccacccgtccatccatccgtccagccagccacccgtccatccatccatccatccatccatccagccagccagccacccatccatccatccatccatccatccatccatccatccagccagccagccacctgtccatccatccagccagccacccgtccatccatccagccagccagccagccacccatccatccatccakccagccagccagccatcatgttgcaggcttcaatcagacacatgtatttattcagcacctactatcttccagacattgggagtataagagggaccaaactggacaaacctcctgcttgcttgaaaattgcaaggagacacagaaaaaagacccaaatgattatgttcctctaaagcccagtgttagggaatgctatgaaggtagaaacagagtaggagggttcaggggactgttgcttttaaaggcaggctggtcaaggaagacctcttagagaagacatcatgagctgaatcctaccat

SEQ ID NO: 173313 - DNA, 601 bp, Human
agactattgagcaagtcaagaaaacatgccacattctttagaacaaaccatgccctgcggcgtggtcccttttctctccctgattggtgtcctgtttggcactttatctcacatcgcttctgatggccaggatgccgacactccagagcctcactctgactcctgcccttctctgctctccaccctggggaggctttgctttccaaggtgacaacggatttatttaagatacctcgtcccagggaacagaagatgttcttcttactaaaaacatcccccttcgttagcctgcacctgatcycttctcatcagctactagcagacatgatcatctcattcaacacacatgtgccacaccaccttgccatcatttgatgtgaacagtgtgctcagtgctccaatctctgcaatgagccagccttgcacctctccttttctcatttcttttataagccatgttagagaagcctctgcaatctcttttttcaggggcattagcccagactggacacaattctctgtcatggagaaagatgaggtccctagctcctcacatcacatgccctttccttccatctgttccacatctgccttgctcaca

SEQ ID NO: 173314 - DNA, 601 bp, Human
tttgctctctttaacaacatcccacacaattccggtgaggaaatgcaagccagggcaggctccaaaggagcaatgaagatatcttctatgatatttttagtcccataaagctccctataagagaaagtactaccttcttttaataccttctattttatttgcaaggcagagatttctctcagaggccatggagtcataaaccctggtaatccctatgtacaacatgacggttcccagcaaagagggtcatggcagccagagagctcagaaatggccatttttagcacatcttccagccacrgagagagcacatataatcagcatttgcagccaaagttctggaggactcctgaatcctggacatagtgatgtctgttgaagactattgagcaagtcaagaaaacatgccacattctttagaacaaaccatgccctgcggcgtggtcccttttctctccctgattggtgtcctgtttggcactttatctcacatcgcttctgatggccaggatgccgacactccagagcctcactctgactcctgcccttctctgctctccaccctggggaggctttgctttccaaggtgacaacggattta

SEQ ID NO: 173315 - DNA, 601 bp, Human
tgtggaatgagatctgatccagggcagaaaggaggtggctggctggctggctggctgcagagaaggggaagtttgctctctttaacaacatcccacacaattccggtgaggaaatgcaagccagggcaggctccaaaggagcaatgaagatatcttctatgatatttttagtcccataaagctccctataagagaaagtactaccttcttttaataccttctattttatttgcaaggcagagatttctctcagaggccatggagtcataaaccctggtaatccctatgtacaacatgacgrttcccagcaaagagggtcatggcagccagagagctcagaaatggccatttttagcacatcttccagccacggagagagcacatataatcagcatttgcagccaaagttctggaggactcctgaatcctggacatagtgatgtctgttgaagactattgagcaagtcaagaaaacatgccacattctttagaacaaaccatgccctgcggcgtggtcccttttctctccctgattggtgtcctgtttggcactttatctcacatcgcttctgatggccaggatgccgacactccagagcct

SEQ ID NO: 173316 - DNA, 601 bp, Human
gcagaattgactctctcaaagcagatcccaggggcaggtttagcacctgaaacagaagcagaactgcattttcatctcctgcaggtgattttttttttttcatggctgtaggcctctcaaatggttacggggagacgtgctcaaagcaatcacacccagtgtctgtcccgactcatggtgggagctggccaggggaagcctagggtgtcagcagctcgcatcctctcttgactcggcctctggcagagcacatgttccaatgcttactcttccttaggtctgctctctgggcttgtggcaygtgtggcctctcaggaaatgaggcctggctgtggaatgagatctgatccagggcagaaaggaggtggctggctggctggctggctgcagagaaggggaagtttgctctctttaacaacatcccacacaattccggtgaggaaatgcaagccagggcaggctccaaaggagcaatgaagatatcttctatgatatttttagtcccataaagctccctataagagaaagtactaccttcttttaataccttctattttatttgcaaggcagagatttctctcagaggccatggagtcataaa

SEQ ID NO: 173317 - DNA, 601 bp, Human; identical to SEQ ID NO: 27555

SEQ ID NO: 173318 - DNA, 601 bp, Human; identical to SEQ ID NO: 27556

SEQ ID NO: 173319 - DNA, 601 bp, Human; identical to SEQ ID NO: 27557

SEQ ID NO: 173320 - DNA, 601 bp, Human; identical to SEQ ID NO: 27558

SEQ ID NO: 173321 - DNA, 601 bp, Human; identical to SEQ ID NO: 27559

SEQ ID NO: 173322 - DNA, 601 bp, Human; identical to SEQ ID NO: 27560

SEQ ID NO: 173323 - DNA, 601 bp, Human; identical to SEQ ID NO: 27561

SEQ ID NO: 173324 - DNA, 601 bp, Human; identical to SEQ ID NO: 27562

SEQ ID NO: 173325 - DNA, 601 bp, Human; identical to SEQ ID NO: 27563

SEQ ID NO: 173326 - DNA, 601 bp, Human; identical to SEQ ID NO: 27564

SEQ ID NO: 173327 - DNA, 601 bp, Human; identical to SEQ ID NO: 27565

SEQ ID NO: 173328 - DNA, 601 bp, Human; identical to SEQ ID NO: 27566

SEQ ID NO: 173329 - DNA, 601 bp, Human; identical to SEQ ID NO: 27567

SEQ ID NO: 173330 - DNA, 601 bp, Human; identical to SEQ ID NO: 27568

SEQ ID NO: 173331 - DNA, 601 bp, Human; identical to SEQ ID NO: 27569

SEQ ID NO: 173332 - DNA, 601 bp, Human; identical to SEQ ID NO: 27570

SEQ ID NO: 173333 - DNA, 601 bp, Human; identical to SEQ ID NO: 27571

SEQ ID NO: 173334 - DNA, 601 bp, Human; identical to SEQ ID NO: 27572

SEQ ID NO: 173335 - DNA, 601 bp, Human; identical to SEQ ID NO: 27573

SEQ ID NO: 173336 - DNA, 601 bp, Human; identical to SEQ ID NO: 27574

SEQ ID NO: 173337 - DNA, 601 bp, Human; identical to SEQ ID NO: 27575

SEQ ID NO: 173338 - DNA, 601 bp, Human; identical to SEQ ID NO: 27576

SEQ ID NO: 173339 - DNA, 601 bp, Human; identical to SEQ ID NO: 27577

SEQ ID NO: 173340 - DNA, 601 bp, Human; identical to SEQ ID NO: 27578

SEQ ID NO: 173341 - DNA, 601 bp, Human; identical to SEQ ID NO: 27579

SEQ ID NO: 173342 - DNA, 601 bp, Human; identical to SEQ ID NO: 27580

SEQ ID NO: 173343 - DNA, 601 bp, Human; identical to SEQ ID NO: 27581

SEQ ID NO: 173344 - DNA, 601 bp, Human; identical to SEQ ID NO: 27582

SEQ ID NO: 173345 - DNA, 601 bp, Human; identical to SEQ ID NO: 27583

SEQ ID NO: 173346 - DNA, 601 bp, Human; identical to SEQ ID NO: 27584

SEQ ID NO: 173347 - DNA, 601 bp, Human; identical to SEQ ID NO: 27585

SEQ ID NO: 173348 - DNA, 601 bp, Human; identical to SEQ ID NO: 27586

SEQ ID NO: 173349 - DNA, 601 bp, Human; identical to SEQ ID NO: 27587

SEQ ID NO: 173350 - DNA, 601 bp, Human; identical to SEQ ID NO: 27588

SEQ ID NO: 173351 - DNA, 601 bp, Human; identical to SEQ ID NO: 27589

SEQ ID NO: 173352 - DNA, 601 bp, Human; identical to SEQ ID NO: 27590

SEQ ID NO: 173353 - DNA, 601 bp, Human; identical to SEQ ID NO: 27591

SEQ ID NO: 173354 - DNA, 601 bp, Human; identical to SEQ ID NO: 27592

SEQ ID NO: 173355 - DNA, 601 bp, Human
aaaaatgagatgatatacataaacaatacagtgctaagtttggtacggagacactctgtatataggtggtatagttcttgtaaataattttgaaataaaatgatgagagagtataactgatgcttcttagggtgaccatctgtcttagattgcctgtctctattttactgtacaggcctaattattactagtccctctgctattctcaatagtgtcatcgtttagttgcatgagtggtctaactattcaaatacttaaaaaattataactagtaaattaaaatatatgacactcttattattatactccaggcaccaaactaactgctttatgtggattatctcatttaaccatctgagtagctgaattatctccattttacagaggcaccgagaagttaagcaacttatctaagctcacacattaacaagtagcagaatctggatttgaactacatcctatcatattagtactgaaagcatacctgggcctgcctaagtgcaggcttggctggcaggggtctggcagggacgctaggtgcacgtggagcccggtggaggggaggaagcactcgctgagttgactggggctgagggacatt

SEQ ID NO: 173356 - DNA, 601 bp, Human
ttccaaaaacagcataaaaatgagatgatatacataaacaatacagtgctaagtttggtacggagacactctgtatataggtggtatagttcttgtaaataattttgaaataaaatgatgagagagtataactgatgcttcttagggtgaccatctgtcttagattgcctgtctctattttactgtacaggcctaattattactagtccctctgctattctcaatagtgtcatcgtttagttgcatgagtggtctaactattcaaatacttaaaaaattataactagtaaattaaaatatrtgacactcttattattatactccaggcaccaaactaactgctttatgtggattatctcatttaaccatctgagtagctgaattatctccattttacagaggcaccgagaagttaagcaacttatctaagctcacacattaacaagtagcagaatctggatttgaactacatcctatcatattagtactgaaagcatacctgggcctgcctaagtgcaggcttggctggcaggggtctggcagggacgctaggtgcacgtggagcccggtggaggggaggaagcactcgctgagttgactg

SEQ ID NO: 173357 - DNA, 601 bp, Human
cagcaacaaattgagatattttgttgtatttatcaaactggtaaaagttaaaatttagtgttagcaaagtcatggtgagaaagacaataacaatgtgggaacgcaaatgtatatgagttctgaaaaaatatttttatattatgaggcttaaaatggtcatacaatctttcaacccaatattttacttttaagaatctctcctaggggaataaagaggtcccaagatttacctctctagaactttctaacagcaaaaaatgatacatcaatacatgcccaataatttgcaagtacttaaacrtttatattcaagtatagtgttattattaaataggatttttaatgccattgtaaatgggactaatttttaaggcaaaacaaagcagcatataaaactgtgtacaaataaattatgttaaaatacacaattataaacaaaaaatattaatagcagtgaaaaattaccagtgattatctcctacttatttgcttgttttctcctcccttcaagttttctattgtgaaatatcattcgttattgcagcaaacagaaatggttacttccaaaaacagcataaaaatgagatgatatacataaaca

SEQ ID NO: 173358 - DNA, 601 bp, Human
gtccaacatctcctcttggtaactgacagaactactagacagcaacaaattgagatattttgttgtatttatcaaactggtaaaagttaaaatttagtgttagcaaagtcatggtgagaaagacaataacaatgtgggaacgcaaatgtatatgagttctgaaaaaatatttttatattatgaggcttaaaatggtcatacaatctttcaacccaatattttacttttaagaatctctcctaggggaataaagaggtcccaagatttacctctctagaactttctaacagcaaaaaatgayacatcaatacatgcccaataatttgcaagtacttaaacatttatattcaagtatagtgttattattaaataggatttttaatgccattgtaaatgggactaatttttaaggcaaaacaaagcagcatataaaactgtgtacaaataaattatgttaaaatacacaattataaacaaaaaatattaatagcagtgaaaaattaccagtgattatctcctacttatttgcttgttttctcctcccttcaagttttctattgtgaaatatcattcgttattgcagcaaacagaaatggttact

SEQ ID NO: 173359 - DNA, 601 bp, Human
aatctacaggaacacagaaaaagcacaatgaaacaaaaaccagagagaacaaacagaataatattaacatggtagacttaaatccaaacatatcaacaattgcattaaatatgaatgttctaaacacacctattaaaatatagtgactggctaaatggatgaaaaaatctatatgctgtctacaagaaacgcttttcaaatgtaattccataggtatgttaaaaggatggaaaaattcatactttgctttttatcctgtttttagaagtaaccatttctgtttgctgcaatcatgaatgaygtttcctattgtgaaatatcattcatgattgcaaaaagacaacactaatactaatcaaaataaaactggagtggatataataatatcagataaagtagattttagaacaaagattaccagagctaaacagagacatgacataatgataaaagggtcactttactaagatgacacaacaatcctaattgtgtgtatcgcaaacaacagagcttcaaaatacatgaagcaaaaactgatgaactcaaaggagacacaattatagtggaaaagtccaacatctcctcttggtaactgacagaa

SEQ ID NO: 173360 - DNA, 601 bp, Human
cgagccaaaagactagagaaagagcagtccagaaacacagaagtgttttgaccatacctgaccttactccagctcaacacttgaaaaaagccatgcctccctcctgctcctcaccaggcatcatagcctagagactggcagatctctactttctatcacttcttgcaataacatgccacatcccttccctggaacagagactatgggtagaacttttagtggatttctcatcaccatggagtccagaaggaaggggaacaacatttttaaagtactgaatggagaaaacagtcaacgcagrattctatatccagcaaaactatcctctaggaataaatacattctcagataaaggaaaatgaagagaatttgtcacctacagatttgctttaaaaaatggctaaagaaagtttttcagacagaaaataataagcaaagttaagttttaaagattatgtttggctgaaagcaaaattacaacatctgcagtgactctcagtacacataaaggtagtatttaagacatctgtattataaaaggaagaggaaaagcgacctaaaaggtgatagtttctgtattctacttaaagtgaagaaatat

SEQ ID NO: 173361 - DNA, 601 bp, Human
tttttttttaaaagggccagtttgccagcataccattggctaatggatacataaaaagtagttcaagtgtaccagtaatcaaaaaaatacaaggagaaatgaggtctggacaaggtggaataagtacatttcaccctatttctcctgctaagtgcaacaaaaatgtctggacataaagtatgctggctagggatctcagaactcaaggaactacccagtggtgtgtttgtgtgtgtgtgttcttttatatatcttggcctgggctctggataggcccacaactggaaaagcctgctatctygagccaaaagactagagaaagagcagtccagaaacacagaagtgttttgaccatacctgaccttactccagctcaacacttgaaaaaagccatgcctccctcctgctcctcaccaggcatcatagcctagagactggcagatctctactttctatcacttcttgcaataacatgccacatcccttccctggaacagagactatgggtagaacttttagtggatttctcatcaccatggagtccagaaggaaggggaacaacatttttaaagtactgaatggagaaaacagtcaacgcaga

SEQ ID NO: 173362 - DNA, 601 bp, Human
caaacagaacatttatagaaaatgaaatggtttctataaagacctagcttacagtttaaatgtgaggtggaccaagatggtgtttgtggtagtgttttcttctggaatgcttagtacattgggacaaatgaagcaggattagctgtgtgtcacgttgtcctgggcagggcatgaggaaccccaaagtacaaaatgtcagtggattcaatttgtgctgccaaacaagagtcacctccaaatattctccacacctgcatggaattaatttccgttccctatgtgtgatgggagagaaatcacmcacttaatctatatcatatgtcttagaaaagttccagacagacaccagcctggagtgagaaatgtggatttttcagtgactgatgtttaaagggtaacatttccttagtttcataaaacagaatgaaggactttttcgggcctgctttaaaggaaatcttgcaagagtccctgctggtggagaaaaaaacaccagcagtaggaataccttcctctgataacatggtctgttagccccagtttgacatggtacacaggtgagttgcttaaaataaataaaaaagttcaggatgaggggtac

SEQ ID NO: 173363 - DNA, 601 bp, Human
gaaagtttggacttaacctctgaactggccagcacctgactgatctacaatcgtggcttaaattaattggctttgctcacatctgcatcctgaccaggcatttgaaggagtagctgctgtttaccagtaacagccccagctcatcattcatcaccttttataaaggtttgaggaggaagaggaatttggacttccttgtaatagctgccaccgtcttcccatggcaacttaaacaaagtagccttttcttagatgagactgtgccagactggtgagtcttgtgttataaaatattatatgttgcatataatacagacagataaaagttgttgattaggagaaatgttgtgttttgacagcatcactgaactgaagatctccacctctgcagaaaatgcatagagccttctttaagatgcagtgaacagctagatgaatacactgaattatttttcctctaatatagctgatgggatgaaaaaagtttgtttccttgatcaagactggggagttaggatgagaagcttgaattccaagggtccttttaccatgaaggaagtggtacattgcaaaggtatgtttgtggacaagagggtacatt

SEQ ID NO: 173364 - DNA, 601 bp, Human
ccaagaccttggtagctgtgttttagatttacagggggaatggactcattgtcattaatccgtaactgagtgtgatggcgccatggagaatgacactgtgacaactgattttttactattttaagtccacatcaattcagcatatttcctacacatctattatgttcgaggggctggacttagctgtgcctgggatcagtctatgccttcagaagtagggcagagctggcatactggtaactccaggctacggcagcaggtgatcagaggtcctggagggaggactgtggagaggtcttakgggagggtgagatctggaatgcagggaaagggcacagaaggacactcaccagcacctttaccagttattagcctgtgctttgtgtgtagcaacagaagctctcataaaactcagttttcttgtatttcatcttcttcaggagaacatactaacaaatgggtcttctttttctcattacaaattggcatttctgatgagcaaggacctaatccccagatttctaggctctgcaagtgcaggtttcaatatcagacacccacacaggtccagaagggcacatgcccttatccattcggagcc

SEQ ID NO: 173365 - DNA, 601 bp, Human
ggggggtagagctgagacttttcattgtatcccaaattgcgttttataaaagcctagtaacagtgacgattgcttctgggaagggagactggtgacaggtgtgaaggagactgttttccgaatgaccctttatactgttgagatttttaattataggcctatattacctattagcaaatgtaaaggctaaaatatcaggcatctgctttttatgtaattttcatgtttatagtaacaaataagtgggaaacaaatacccctttgaaccctgtaatcacgtgaacaacttcccttgaaaacrtgttctgagaagttcccttcagggagagatcatgcttccgtggataactgatacccttaaagacatttgatgtttgtgtctgatgaataattagtatatgatgccaaagaaagttcagctaaagtttctggaagtattgggtaggtggcagggagagtccaagaccttggtagctgtgttttagatttacagggggaatggactcattgtcattaatccgtaactgagtgtgatggcgccatggagaatgacactgtgacaactgattttttactattttaagtccacatcaattcagca

SEQ ID NO: 173366 - DNA, 601 bp, Human
atttccataatctctcctagcagagaggtgggtggggggtagagctgagacttttcattgtatcccaaattgcgttttataaaagcctagtaacagtgacgattgcttctgggaagggagactggtgacaggtgtgaaggagactgttttccgaatgaccctttatactgttgagatttttaattataggcctatattacctattagcaaatgtaaaggctaaaatatcaggcatctgctttttatgtaattttcatgtttatagtaacaaataagtgggaaacaaatacccctttgaacmctgtaatcacgtgaacaacttcccttgaaaacatgttctgagaagttcccttcagggagagatcatgcttccgtggataactgatacccttaaagacatttgatgtttgtgtctgatgaataattagtatatgatgccaaagaaagttcagctaaagtttctggaagtattgggtaggtggcagggagagtccaagaccttggtagctgtgttttagatttacagggggaatggactcattgtcattaatccgtaactgagtgtgatggcgccatggagaatgacactgtgacaactgat

SEQ ID NO: 173367 - DNA, 601 bp, Human
gaaaatttccataatctctcctagcagagaggtgggtggggggtagagctgagacttttcattgtatcccaaattgcgttttataaaagcctagtaacagtgacgattgcttctgggaagggagactggtgacaggtgtgaaggagactgttttccgaatgaccctttatactgttgagatttttaattataggcctatattacctattagcaaatgtaaaggctaaaatatcaggcatctgctttttatgtaattttcatgtttatagtaacaaataagtgggaaacaaatacccctttsaaccctgtaatcacgtgaacaacttcccttgaaaacatgttctgagaagttcccttcagggagagatcatgcttccgtggataactgatacccttaaagacatttgatgtttgtgtctgatgaataattagtatatgatgccaaagaaagttcagctaaagtttctggaagtattgggtaggtggcagggagagtccaagaccttggtagctgtgttttagatttacagggggaatggactcattgtcattaatccgtaactgagtgtgatggcgccatggagaatgacactgtgacaac

SEQ ID NO: 173368 - DNA, 601 bp, Human
ttgcacagcaattgtgctttcaggaatttatccatcttgggcaagattatgcctgtgtgacgtagcaaatgattgaaaacaacccatctgggaatctggaagggacaggttaaagaagtcatggtatagcttcacaaataatgatgtagccagtgaaaagaatgaagcagatgtataaaactaataaggaataaccaaagtagaagaaagtacataatgtgttgccatttgaattcaaaacaaggatgtaagatgagtgacagcaagttgacggttgctgaagttgagtgatgggtagatmgggtttcactgtactcttctctccaattttgagtgtttgaaaatttccataatctctcctagcagagaggtgggtggggggtagagctgagacttttcattgtatcccaaattgcgttttataaaagcctagtaacagtgacgattgcttctgggaagggagactggtgacaggtgtgaaggagactgttttccgaatgaccctttatactgttgagatttttaattataggcctatattacctattagcaaatgtaaaggctaaaatatcaggcatctgctttttatgtaattttcatg

SEQ ID NO: 173369 - DNA, 601 bp, Human
aaatgcaaatcaaaaccacaatgagctaccatctcatgccagtcagaatggcaattattaaaaagttaacagatgctagaaaggttgcagagcaaaaggaatgcttttacactgttggtgggagtgtaaattagttcaaccattgtggaagacagtgtgatgattcctcaaagacctagcagcagagatgccatttgacccaggaatcccattattgggtatatacccaaaggaatagaaatcattctattatacacgcatgcatatgttcactgcagcactattcacaatagcaaagacrtggaatcaacctaagtgcccatcagtgatatactgggtaagaaaatgtggtaaatatacaccatggaatactatgcagccataaaaaggaatgagatcatgtcttttgcagagacatggatggagctggaggccattatcctcagcaaactaatgcaggaacagaaaaccaaataccccatgttttcacttattaagtgggagctgaatgatgagaacacatggacacaatggggcagggggaggaggaaagcatcaggacgaatagctaatggatgcccagcttaatacctgggtgatg

SEQ ID NO: 173370 - DNA, 601 bp, Human
agccaacaaacatgaaaaaaagctcaacatcactgatcattagagaaatgcaaatcaaaaccacaatgagctaccatctcatgccagtcagaatggcaattattaaaaagttaacagatgctagaaaggttgcagagcaaaaggaatgcttttacactgttggtgggagtgtaaattagttcaaccattgtggaagacagtgtgatgattcctcaaagacctagcagcagagatgccatttgacccaggaatcccattattgggtatatacccaaaggaatagaaatcattctattatacrcgcatgcatatgttcactgcagcactattcacaatagcaaagacatggaatcaacctaagtgcccatcagtgatatactgggtaagaaaatgtggtaaatatacaccatggaatactatgcagccataaaaaggaatgagatcatgtcttttgcagagacatggatggagctggaggccattatcctcagcaaactaatgcaggaacagaaaaccaaataccccatgttttcacttattaagtgggagctgaatgatgagaacacatggacacaatggggcagggggaggaggaaagcat

SEQ ID NO: 173371 - DNA, 527 bp, Human
cccgggtgaagacactgatacagacacatagaccaatggaacaaaatagagaacccaggaataagactgcacgcctacaaccatctgatcttcaacaaacctgagaaaaagcaatggggaaaggattccctatttaataaatagtctggaagaactggatagccatatgcagaaaattgaagctggaccccttccttacaccatatacaaaaataaactcaggatcrattaaagacttacatataaaacccaaaactataaaaaccttaggagaaaatctaggcaacaccatcgaggacataggcatgcgaaaagatttcatgacaacatcaagagcaaaaattgacaaacgggatctaattaaagagtgtctgcagcaaaagaaacacagaatgaacaacctacagaatgggagaaagtttttcaatctatccatctgacaaaggtctaatagctagcatctataaggaatttaaaattacaagaaaacagtaaaaagtgggcaaaagacatgaacagacacttct

SEQ ID NO: 173372 - DNA, 601 bp, Human
tctacaagtgattggggtacccaaaagaggcgggcagaacagagcccccccagcaaattgcagcagccttacggaagagtggccagactgttaaacagaaaacgacccacaaaaatctcatccaaaggtgtcagcaacctcgaagatcaaaggtagataagcccacaaagatggaaaacatacttcaggatataatccaggataacttcccctacctggcaagacaggccaacattcaaattcaggaaatccagagaaggtaagatactccatgagaagatcaaccccaagacacataatyatcagattttccaaggtcaaaatgaaagaaaaaatgctaagggcagccagagagaaaaaccaggtcccctacaaaggaaagcctatcagactaacagcagacctcccagtggaaacccaataagctagaagagcttggggaccaatattcaacattctttaaagattttccaacccagaatttcatatctggcccaatatcatctagataatgaagaaagacccattggtgtgctgtcttcaagaaactcatgtgcaaagacacacacaggctcaaaacaaagggatggaggaaaattta

SEQ ID NO: 173373 - DNA, 601 bp, Human
tgttagagctaaaaaacacactatacgaacttcacaatcacaagtattaacagcagaatagatgaagcagaggaaaaaatctcggagcttgaagactatccttctgaaataagatgggcagacaagaatagagaaaaaagaatgaaaaggaatgaacaggtcgtcttgagaaataccggattatgtagagagaccaaatctacaagtgattggggtacccaaaagaggcgggcagaacagagcccccccagcaaattgcagcagccttacggaagagtggccagactgttaaacagaaaaygacccacaaaaatctcatccaaaggtgtcagcaacctcgaagatcaaaggtagataagcccacaaagatggaaaacatacttcaggatataatccaggataacttcccctacctggcaagacaggccaacattcaaattcaggaaatccagagaaggtaagatactccatgagaagatcaaccccaagacacataattatcagattttccaaggtcaaaatgaaagaaaaaatgctaagggcagccagagagaaaaaccaggtcccctacaaaggaaagcctatcagactaacagcagac

SEQ ID NO: 173374 - DNA, 601 bp, Human
tcacatttgtagaggggacattaaagtgatgtttccaagatctaatggtagcaagaggaagatcatataagactttgagctggttgaaggtaggggagaatgagaaaccagacaaatctaataaaacataggccaatcaaggacaaataaaataaatggtattaaggattactaggtggtcatctagaaaaaaataaaatttgattatacactaaatgggattgattcaggaaacaaatagacacatggagaacaaaaaaaaaaaagcagggtgaggcaatggcccacctgggagtgacayggagccaagggaaccctcaccatgggaagtggtacaagaaaaactgaggctactggggtctggagcagacccccagcaaattgcagcagccttacagaagagtggccagactgttaaacagaaaacaacaataaccccatccaaaggtcagcaaccttaaagatcaaaggtagataagcccacaaagatgagaaagaatcaacacaaaaacactgaaaactcaaaaagccagagtgccactttttctccaaatcatggcaacacctctccagcaagtgcaaagaactgggctggggctga

SEQ ID NO: 173375 - DNA, 601 bp, Human
attttcatgtaactgtcacaaagtcccaaaagcaagtactattatttcacatttgtagaggggacattaaagtgatgtttccaagatctaatggtagcaagaggaagatcatataagactttgagctggttgaaggtaggggagaatgagaaaccagacaaatctaataaaacataggccaatcaaggacaaataaaataaatggtattaaggattactaggtggtcatctagaaaaaaataaaatttgattatacactaaatgggattgattcaggaaacaaatagacacatggagaacaaaaaaaaaaaagcagggtgaggcaatggcccacctgggagtgacacggagccaagggaaccctcaccatgggaagtggtacaagaaaaactgaggctactggggtctggagcagacccccagcaaattgcagcagccttacagaagagtggccagactgttaaacagaaaacaacaataaccccatccaaaggtcagcaaccttaaagatcaaaggtagataagcccacaaagatgagaaagaatcaacacaaaaacactgaaaactcaaaaagccagagtgccactttttctccaaatc

SEQ ID NO: 173376 - DNA, 601 bp, Human
atggatacatatttatacaaaaatattgaaaacagtaagcaaacttatgacagtgcttgtatctggagggaggctaatgtagtgactttaatgtttcacttcttttgaaaaaggatatatatctgaaacttaaataggcatgtacatctagaaagatgtaaaactagttatttctatgtagaataaatgtgagtaaattttagtttttacttttctatattttaaatattttaaaaaataacttcaatctttgggctaaggaggaaaacagaagagaatatatagactatttaaaaaatayacactacaaattggaaccagtgagcaaggtgtaaagcaatgtttagaggaaagttcttaataatattttcatgtaactgtcacaaagtcccaaaagcaagtactattatttcacatttgtagaggggacattaaagtgatgtttccaagatctaatggtagcaagaggaagatcatataagactttgagctggttgaaggtaggggagaatgagaaaccagacaaatctaataaaacataggccaatcaaggacaaataaaataaatggtattaaggattactaggtggtcatctagaaa

SEQ ID NO: 173377 - DNA, 601 bp, Human
aagcatacagggaaacaaggaaccaggagtgagaagtgatagaaacttcagcagtaacatatccaaagacttcagatttgggtattattggaaaaagttttcttactatgtttaaagaagtacaagacaagctagcatagttgaattagaaccaaagagaacttctagaagcaaaaaaagtacaacatagatgagtgcaaattgcatgaaggtaagtacagtttgataccacttacgtaaagtttaaaacacgaaacactatattcatggatacatatttatacaaaaatattgaaaacaktaagcaaacttatgacagtgcttgtatctggagggaggctaatgtagtgactttaatgtttcacttcttttgaaaaaggatatatatctgaaacttaaataggcatgtacatctagaaagatgtaaaactagttatttctatgtagaataaatgtgagtaaattttagtttttacttttctatattttaaatattttaaaaaataacttcaatctttgggctaaggaggaaaacagaagagaatatatagactatttaaaaaatatacactacaaattggaaccagtgagcaaggtgtaa

SEQ ID NO: 173378 - DNA, 601 bp, Human
atttaaaaaagtgaactcatggaaaaaaaaaaaaaaagcatacagggaaacaaggaaccaggagtgagaagtgatagaaacttcagcagtaacatatccaaagacttcagatttgggtattattggaaaaagttttcttactatgtttaaagaagtacaagacaagctagcatagttgaattagaaccaaagagaacttctagaagcaaaaaaagtacaacatagatgagtgcaaattgcatgaaggtaagtacagtttgataccacttacgtaaagtttaaaacacgaaacactatattmatggatacatatttatacaaaaatattgaaaacagtaagcaaacttatgacagtgcttgtatctggagggaggctaatgtagtgactttaatgtttcacttcttttgaaaaaggatatatatctgaaacttaaataggcatgtacatctagaaagatgtaaaactagttatttctatgtagaataaatgtgagtaaattttagtttttacttttctatattttaaatattttaaaaaataacttcaatctttgggctaaggaggaaaacagaagagaatatatagactatttaaaaaata

SEQ ID NO: 173379 - DNA, 601 bp, Human
ttaagaatcttctagaagtaaatacatactataatctatccccaggatactacaaggagcattcttctggtgctggacagaccgagggagaaaaataaacctgtcaccacaaattgtccttgaggacttgaagctgaaatcacatcacctgggtatttcaataagctccaagccattttaaagtggtctcaaactggtactgcctccaggcacctggcagaggcaaaatagccctttatggaagaacacacctgcatcctaggccttgaagaactataatttaaaaaagtgaactcatggaaaaaaaaaaaaaaagcatacagggaaacaaggaaccaggagtgagaagtgatagaaacttcagcagtaacatatccaaagacttcagatttgggtattattggaaaaagttttcttactatgtttaaagaagtacaagacaagctagcatagttgaattagaaccaaagagaacttctagaagcaaaaaaagtacaacatagatgagtgcaaattgcatgaaggtaagtacagtttgataccacttacgtaaagtttaaaacacgaaacactatattcatggatacatatttatacaaaa

SEQ ID NO: 173380 - DNA, 601 bp, Human
caggttaagaatcttctagaagtaaatacatactataatctatccccaggatactacaaggagcattcttctggtgctggacagaccgagggagaaaaataaacctgtcaccacaaattgtccttgaggacttgaagctgaaatcacatcacctgggtatttcaataagctccaagccattttaaagtggtctcaaactggtactgcctccaggcacctggcagaggcaaaatagccctttatggaagaacacacctgcatcctaggccttgaagaactataatttaaaaaagtgaactcmtggaaaaaaaaaaaaaaagcatacagggaaacaaggaaccaggagtgagaagtgatagaaacttcagcagtaacatatccaaagacttcagatttgggtattattggaaaaagttttcttactatgtttaaagaagtacaagacaagctagcatagttgaattagaaccaaagagaacttctagaagcaaaaaaagtacaacatagatgagtgcaaattgcatgaaggtaagtacagtttgataccacttacgtaaagtttaaaacacgaaacactatattcatggatacatatttatac

SEQ ID NO: 173381 - DNA, 601 bp, Human
atagatcagaatataaatgtcgtaaaccctaatgtaggtatcatggaactcgccaaagttgacaggcgggtcttccatttccagtaacatggcaggctctgttgttgtgccctaccccttctctgatgaccaccaagagttacaagacagcaaatgttttaagtctaagtgaaagcagcagcttggagagggagtagtaactgaagatggaggcatctgccaagttagggaaacctaaatgtgggttttgatactctttcacagtgaggaatagagaaatccaaccaaggtcaagacataygggcagaaaccaaatgtccaagtttaatgagagagaattctcttcctgactcctctccattcaagttgggctctacagacaagacctcaggttaagaatcttctagaagtaaatacatactataatctatccccaggatactacaaggagcattcttctggtgctggacagaccgagggagaaaaataaacctgtcaccacaaattgtccttgaggacttgaagctgaaatcacatcacctgggtatttcaataagctccaagccattttaaagtggtctcaaactggtactgcctccag

SEQ ID NO: 173382 - DNA, 601 bp, Human
ccccagagatccctgacgagctcatgcagggctggggcggcatcaatatgtttcactgtgcaaattcggtctacctctagctaaaaacaattgtgggaattatggctatagatcagaatataaatgtcgtaaaccctaatgtaggtatcatggaactcgccaaagttgacaggcgggtcttccatttccagtaacatggcaggctctgttgttgtgccctaccccttctctgatgaccaccaagagttacaagacagcaaatgttttaagtctaagtgaaagcagcagcttggagagggartagtaactgaagatggaggcatctgccaagttagggaaacctaaatgtgggttttgatactctttcacagtgaggaatagagaaatccaaccaaggtcaagacatatgggcagaaaccaaatgtccaagtttaatgagagagaattctcttcctgactcctctccattcaagttgggctctacagacaagacctcaggttaagaatcttctagaagtaaatacatactataatctatccccaggatactacaaggagcattcttctggtgctggacagaccgagggagaaaaataaacct

SEQ ID NO: 173383 - DNA, 601 bp, Human
tcatcacaggaaaatgccagagatgccccagagatccctgacgagctcatgcagggctggggcggcatcaatatgtttcactgtgcaaattcggtctacctctagctaaaaacaattgtgggaattatggctatagatcagaatataaatgtcgtaaaccctaatgtaggtatcatggaactcgccaaagttgacaggcgggtcttccatttccagtaacatggcaggctctgttgttgtgccctaccccttctctgatgaccaccaagagttacaagacagcaaatgttttaagtctaartgaaagcagcagcttggagagggagtagtaactgaagatggaggcatctgccaagttagggaaacctaaatgtgggttttgatactctttcacagtgaggaatagagaaatccaaccaaggtcaagacatatgggcagaaaccaaatgtccaagtttaatgagagagaattctcttcctgactcctctccattcaagttgggctctacagacaagacctcaggttaagaatcttctagaagtaaatacatactataatctatccccaggatactacaaggagcattcttctggtgctgga

SEQ ID NO: 173384 - DNA, 601 bp, Human
tgcttatccagagaaatctctgcaggaagactggaattcatcacaggaaaatgccagagatgccccagagatccctgacgagctcatgcagggctggggcggcatcaatatgtttcactgtgcaaattcggtctacctctagctaaaaacaattgtgggaattatggctatagatcagaatataaatgtcgtaaaccctaatgtaggtatcatggaactcgccaaagttgacaggcgggtcttccatttccagtaacatggcaggctctgttgttgtgccctaccccttctctgatgaccrccaagagttacaagacagcaaatgttttaagtctaagtgaaagcagcagcttggagagggagtagtaactgaagatggaggcatctgccaagttagggaaacctaaatgtgggttttgatactctttcacagtgaggaatagagaaatccaaccaaggtcaagacatatgggcagaaaccaaatgtccaagtttaatgagagagaattctcttcctgactcctctccattcaagttgggctctacagacaagacctcaggttaagaatcttctagaagtaaatacatactataatctatc

SEQ ID NO: 173385 - DNA, 601 bp, Human
tcattctgcctttgcaaaacctaaacctgaacctctcccagagaagtccagtgtgatcaccaagcatcatctgaagggagctgagaaatgactctaagcagattgctcacacacgataaacatttctttaaatctattttcattttaaacaaggaaatgaattcaaacctcatttttatgccctcttaacttcttccagatattgaagaaaaatccaggtatgctattaatatgctattaaatagggctgttccattcttctatattctgctcatgttctggcaatagccacatatttcarattttttagaggtttcaaaacaattttaaatccagatataaccactttgccttgaccagcatcatgaagtctcagctgttatcaacttcacatggtaaacgagagtaaacatgccctgcttatccagagaaatctctgcaggaagactggaattcatcacaggaaaatgccagagatgccccagagatccctgacgagctcatgcagggctggggcggcatcaatatgtttcactgtgcaaattcggtctacctctagctaaaaacaattgtgggaattatggctatagatcagaatata

SEQ ID NO: 173386 - DNA, 601 bp, Human
ctaggtaagatgctggcttcctgccagggcttaactgggacagaatggccatggaacagtgggggttagtccaagaagatgtgccttcactccttagacattaggcatggaggtgtggaacccatgatgcaagaagcaccagctgcacattttgaccctggaggaagggatgaaattgccatgctgtcttctaggtgttgcttttcattctgcctttgcaaaacctaaacctgaacctctcccagagaagtccagtgtgatcaccaagcatcatctgaagggagctgagaaatgactctargcagattgctcacacacgataaacatttctttaaatctattttcattttaaacaaggaaatgaattcaaacctcatttttatgccctcttaacttcttccagatattgaagaaaaatccaggtatgctattaatatgctattaaatagggctgttccattcttctatattctgctcatgttctggcaatagccacatatttcaaattttttagaggtttcaaaacaattttaaatccagatataaccactttgccttgaccagcatcatgaagtctcagctgttatcaacttcacatggt

SEQ ID NO: 173387 - DNA, 601 bp, Human
aattacatttatttagcagttggggctcagctgaaagaatgcaacaatataatcaccatttaacatatctttgtaaagcaaaggaagctaccacagaagtttgtaaatcacaagtgtccacaggtgtgtggaagataagctgagttggaacaacggacacattgggctaggaaaaagtccctgaacaagggacagacttagaagtgatatttctacattagttttcattaaaagaaacattaaatagaaaaaattccctagctaggaataaaggccatataatgtgcccaagagcatggattgtttatatattcaaccagttccacatacacacacagtatcctcactggtggagcagggatgatcatagtcccttcctcccgggtggacgtgagggttaaatgagatattgaggctcctagcacagggcctggcatgcaatataacccatgagtgttagctgctgctggattacaactattattaatggagtgaatttaccaccaaaaagcaccataaccctaccaacaaactttggataattaactaaggtaacaaatcaagctccccttcctatagataacagaaaactgtgagcaag

SEQ ID NO: 173388 - DNA, 601 bp, Human
tgaaaattacatttatttagcagttggggctcagctgaaagaatgcaacaatataatcaccatttaacatatctttgtaaagcaaaggaagctaccacagaagtttgtaaatcacaagtgtccacaggtgtgtggaagataagctgagttggaacaacggacacattgggctaggaaaaagtccctgaacaagggacagacttagaagtgatatttctacattagttttcattaaaagaaacattaaatagaaaaaattccctagctaggaataaaggccatataatgtgcccaagagcayggattgtttatatattcaaccagttccacatacacacacagtatcctcactggtggagcagggatgatcatagtcccttcctcccgggtggacgtgagggttaaatgagatattgaggctcctagcacagggcctggcatgcaatataacccatgagtgttagctgctgctggattacaactattattaatggagtgaatttaccaccaaaaagcaccataaccctaccaacaaactttggataattaactaaggtaacaaatcaagctccccttcctatagataacagaaaactgtgag

SEQ ID NO: 173389 - DNA, 601 bp, Human
agaacacccctaataaccaagtgcttcaattcaccatcataggacccagtatatatctagcaacactcaacaatgatttcaaacacttgagttgaatttctctcacagtgcctatcatatgaaaattacatttatttagcagttggggctcagctgaaagaatgcaacaatataatcaccatttaacatatctttgtaaagcaaaggaagctaccacagaagtttgtaaatcacaagtgtccacaggtgtgtggaagataagctgagttggaacaacggacacattgggctaggaaaaagyccctgaacaagggacagacttagaagtgatatttctacattagttttcattaaaagaaacattaaatagaaaaaattccctagctaggaataaaggccatataatgtgcccaagagcatggattgtttatatattcaaccagttccacatacacacacagtatcctcactggtggagcagggatgatcatagtcccttcctcccgggtggacgtgagggttaaatgagatattgaggctcctagcacagggcctggcatgcaatataacccatgagtgttagctgctgctggattacaac

SEQ ID NO: 173390 - DNA, 601 bp, Human
gagagaggggttcattggagctgtgtccagaagtcagtaagtgttggacacatctctgctcttggccccaggtgaatgtgggtgccatgtcttgtctttgaagcccggaaacactcatgaatgcacagaatgtctgttggaaatggtgctagaacctccagggagacagaacacccctaataaccaagtgcttcaattcaccatcataggacccagtatatatctagcaacactcaacaatgatttcaaacacttgagttgaatttctctcacagtgcctatcatatgaaaattacatttmtttagcagttggggctcagctgaaagaatgcaacaatataatcaccatttaacatatctttgtaaagcaaaggaagctaccacagaagtttgtaaatcacaagtgtccacaggtgtgtggaagataagctgagttggaacaacggacacattgggctaggaaaaagtccctgaacaagggacagacttagaagtgatatttctacattagttttcattaaaagaaacattaaatagaaaaaattccctagctaggaataaaggccatataatgtgcccaagagcatggattgtttatata

SEQ ID NO: 173391 - DNA, 601 bp, Human
ggttttagccaaaaatgatgctttgggacttgtgcaagtcacttgacctctttctctggaaaatgtggggaaaaagacctatctcagcattgttatgaggattaaagaaaataatgcataggaagttcccagcacacagataatagttattaatatcagcattccttcatgccgcaatttaaaaatgtttagtagaaatagaagaaaaacggcggggcgtggtagctcatgcctgtaactccagcactttgggaggccgaggcgggcggatcacctgaggtcaggagtttgagaccagccwggccaacatggtgaaactccgtctctactaaaaataccaaaaattagcctagcatggtggcacatgcctgtaatcccaggctacgcaggaggctgaggcaggagaatcgcttgaacccgggaggcagaggttgcagtgagctgagatcgtgccactgcactccagcctaggtgacagagtgagactctgtctcaaaaaaaaaaaaaaaaaaaaaatgtaagaacacatgcccctttttttcgtggggcccctcctgtggatacccatgagagaggggttcattggagctgtgtccagaag

SEQ ID NO: 173392 - DNA, 601 bp, Human
taagacttatccatggatcgtagttataaacactcaactatggggcttctggactgcccctgggccctggggtagcgttgatgttggggtttctctgtcagtgtcaccctgaggatacacactttcctgtgcttttagttaggcggcttctctgttcaccctaaaataagaagttggtgaaaatcttttcaaacatcacattcgtttcttcagttttgccaacatcacatagcaggactcgttcatctgtgggtggatgagacggtgaggatggttgtgctcagtctgccacgtgcaggcrctgttccacatgttgctctgaaggctccgcgaaatgcactgaagttcttccactagatactttctcataagctcagagaattgatgcagtggtctgaggggcaagtcaagctttgtaaacacactaaggggcagggctgtgttgaccagaagccagtgtgagggagctggccagggaaggtggggttgttccacgctaggttttagccaaaaatgatgctttgggacttgtgcaagtcacttgacctctttctctggaaaatgtggggaaaaagacctatctcagcattgttatgaggat

SEQ ID NO: 173393 - DNA, 601 bp, Human
ctagaccactgcacccctgtcctggcttggattagtcgtggttggtcccacaagagtttgagagagaaagagatgggcatggcatgtcacacaaacctgaggggtgccaggcggagcccagtctcccattgtcctggggtcctggccaaggcatgagtgagccgagttgttctggccagaggatctgcaggcagaggcttctgaggggggtttggcttacaggtcccctgcaataaacatagggttaggcagggtcactttccaggagccagcagaggcccctgagaagcagggcctgccrcttggcacaggccctgcttcctgaatatcatcctctcaccatacaaggtgggtggaggctgacctctgttaatcttcttgccaaaattttctgtaacatttaagacttatccatggatcgtagttataaacactcaactatggggcttctggactgcccctgggccctggggtagcgttgatgttggggtttctctgtcagtgtcaccctgaggatacacactttcctgtgcttttagttaggcggcttctctgttcaccctaaaataagaagttggtgaaaatcttttcaaacatcaca

SEQ ID NO: 173394 - DNA, 601 bp, Human; identical to SEQ ID NO: 27593

SEQ ID NO: 173395 - DNA, 601 bp, Human; identical to SEQ ID NO: 27594

SEQ ID NO: 173396 - DNA, 601 bp, Human; identical to SEQ ID NO: 27595

SEQ ID NO: 173397 - DNA, 601 bp, Human; identical to SEQ ID NO: 27596

SEQ ID NO: 173398 - DNA, 601 bp, Human; identical to SEQ ID NO: 27597

SEQ ID NO: 173399 - DNA, 601 bp, Human; identical to SEQ ID NO: 27598

SEQ ID NO: 173400 - DNA, 601 bp, Human; identical to SEQ ID NO: 27599

SEQ ID NO: 173401 - DNA, 601 bp, Human; identical to SEQ ID NO: 27600

SEQ ID NO: 173402 - DNA, 601 bp, Human; identical to SEQ ID NO: 27601

SEQ ID NO: 173403 - DNA, 601 bp, Human
ggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcaggtaacctgtaatgaaatgaattatttaaaacgtttgagctaactttggtcgtatgaactgaacaccagagcttttaatgatgcatgacaaggcttaaagccagcctctgatcacgcttctrttcctcttcagtatcccgtgctctgttcaccttgcttcctccctgtcttactcctctccaactctgtttacgggttcctgaattgctagttgtagcctgatggctagtcttagagcttgtgttttatttaggtattagtgtgtgatagtctcatgggatagaagtagctttggaatagttgtgcatattattaataacatgtcctaactagacaattttagggatttcttagcaagattcttaaaaaattaagttggcttattaattgagtgcctcagaacaggagcctttcctttgcac

SEQ ID NO: 173404 - DNA, 601 bp, Human
tcccacaaacagtagtcattctaagcatatttgtgaggtggtaaacaaatctttcgtgttcttcaggatttcaaagtgagatctttttgttaaaatttctgtcaaatagagggtagaatggttaccagaggccgggaagggtagtcaggggctgggagtaggtggggatggttaatgggtacaaaacaaaaaatagttaaaaagactgaataagacctactattcgatagcacaatagggtgactgtagtcaataataattgtacattttaaagtaacttagactgtaattggatgatttrtaactcaaaggatgcttgaggggatggttacctcctctgtggtgtgtttatttcacatggcatgcctgtttcaaaacatctcatgtaacctataaatatgtacacctactatgtactcacaaaaattttaaaaattgtatttcagagaaaaaattctgtcaagtgactacagtaattttgcctcagtgttttaagctgggcactaccatagcttacccataggaactgaattggcaaaacatataccaacctattaatagctatgaacgtgtgttgtatgattgacttgtttcttcttta

SEQ ID NO: 173405 - DNA, 601 bp, Human
tagcttacccataggaactgaattggcaaaacatataccaacctattaatagctatgaacgtgtgttgtatgattgacttgtttcttctttacgcttttcccataattctttgtatagtttctcaatggaggcatattttcttaatcactttttaggaaaacttttagaccatgtgcttatagaaatgggatatggcttgaaacccagtggacaagattctaagaaggaaaatgcagatcaaagtgagtatagattgatattgaacggtatagcgacttcagttattgaagaccatctacstactaaacaaaggcacaactttagcactgttaagacttgttaacgataaacatcctatgagcaatttaaatacgctgttttatatttagtagtatatcatttctaatctcaatctttcctgcctgttctcctcctctgtccattttccacatgaatccttaacatggtaatcatcagagattatgaagtattaaatatcataacactttagagttagggtttgtttttttttttttttttttgagatggagtttcactcttgttgtccaagctggagtgcaatggcatggtctcggctcc

SEQ ID NO: 173406 - DNA, 601 bp, Human
aaggaaaatgcagatcaaagtgagtatagattgatattgaacggtatagcgacttcagttattgaagaccatctacctactaaacaaaggcacaactttagcactgttaagacttgttaacgataaacatcctatgagcaatttaaatacgctgttttatatttagtagtatatcatttctaatctcaatctttcctgcctgttctcctcctctgtccattttccacatgaatccttaacatggtaatcatcagagattatgaagtattaaatatcataacactttagagttagggtttgtttttttttttttttttttgagatggagtttcactcttgttgtccaagctggagtgcaatggcatggtctcggctccctgtaacctctgcctccctggttcaagtgattctcctacctcagcctccggaggagctgggattacaggctcccgctagcacgcccagctaattttttgtatttttagtagagacagggtttcaccatgttggccaggctggtctcaaactcctgacctgagagtgattcgcccgcctcagcctcccaaagtgctgggattacaggcgtgagccactacgccct

SEQ ID NO: 173407 - DNA, 601 bp, Human
ttttcttccttcttgggtattccaccagtaattaatagggctgtaaaattctgttccagtaggacagtgtttctgatgactgtttactcctgtaaaagcttgtgtgtgtggtttatttagattaacaagagaaccaagaaattttgctttcagcattttacttcctcattgcctaatcacctgtgtttgtattatctttttgatcctttactttgctcctgtactgattgctttaggagtagatataattcattgtctcttactcattcatccagaggtgattgctagagtaacagtgccrtggttggacacatcctatcacataagcacactggaatcatccttaaatctaccttcttacctcccatcctttgccctaattggttgccaagtctttattgattcttcttcccaagtatcccttgtatatgtcttttttctttctttccctactaccattttcttagctcaggaatcctcatcattcatggacaattgaaacaattttccaatgtcatagtttatctccctatctgcattcttagagtacttgcctatgtgatatgcctaagaacacacatcttggtgggacagctctgat

SEQ ID NO: 173408 - DNA, 601 bp, Human
gtatccagtggaaggaacaagaaaaccactgagcaatatcttcttcgctaaggcactgtgaaggtgccttcatgaaggctaaggccagtacagacaagcagaagaaattatgtgggatagagaaattaggtgtgatagagaagtgcagggtgcaacggaagcaggtgggagggtacctaagacttgcaataaagccatctggaagtgatgccacacggagcaggaaataaccaggtgctgccagtggggagtatgttgcaagaaaacgaacatgtgttaaggcctagagatagggaaaaarcatgagcaggcctgagaaactgaaaaataagtagggctagatttgactgctggtgaagaggtataggatggggaagtattggtcaggaggtaagctagagcggatcattaaaggtcgcaggagctgtgttaaggggtttggacatgattctgaagccaacatagagaatggagccttgagatacctctggattcagtttgttggattcaagtaatgttggtgggtatggaagaatcagatttggaagtcagaaaagatgagatatggtatattaagagttccctttaaaccaccttctta

SEQ ID NO: 173409 - DNA, 601 bp, Human
tatattaagagttccctttaaaccaccttcttaaaaatttagctgtgcctctgtcacacaattaaatcagtcctcctgtcctgccccttcttgacctagcctggctgaaagcctttacaacttggtctctaatgtcagcataccgagctagcgacatcaccatgcttttgtcccctctcctcctactgtgttcctaagcccagctgcactcagcctggcattatgattgtgcaccctcttgtgctatttatgacactgtagctcctgattgaacatcttctgtctcctacaagatttagamtatctagaggcaaagactgtggccttttacttaactacttcttagtagttacttaactacttgcttagtatggcatctgacatacattagatgtttaagatacaatttttttttttttttgagacagagtctcgctctgtcaccaggctagagtgcagtgctgtgatctcagctccctgcaacctccgcctcctaggttcaagtgattctcctgcttcagcctcccaagtggctgggactagtaggtgggagctgcacgccaccatgcccagctgatttttttgtatttttagtagagac

SEQ ID NO: 173410 - DNA, 601 bp, Human
cagcataccgagctagcgacatcaccatgcttttgtcccctctcctcctactgtgttcctaagcccagctgcactcagcctggcattatgattgtgcaccctcttgtgctatttatgacactgtagctcctgattgaacatcttctgtctcctacaagatttagaatatctagaggcaaagactgtggccttttacttaactacttcttagtagttacttaactacttgcttagtatggcatctgacatacattagatgtttaagatacaatttttttttttttttgagacagagtctcgytctgtcaccaggctagagtgcagtgctgtgatctcagctccctgcaacctccgcctcctaggttcaagtgattctcctgcttcagcctcccaagtggctgggactagtaggtgggagctgcacgccaccatgcccagctgatttttttgtatttttagtagagacagtgtttcaccatgttggccaggatggtctccatctcctgacctcgtgaactgcccgcctcggcctcccaaagtgctctgattacaagcgtgagccacacctggccagatataatttttaaaagctggcacagct

SEQ ID NO: 173411 - DNA, 601 bp, Human
cttttgtcccctctcctcctactgtgttcctaagcccagctgcactcagcctggcattatgattgtgcaccctcttgtgctatttatgacactgtagctcctgattgaacatcttctgtctcctacaagatttagaatatctagaggcaaagactgtggccttttacttaactacttcttagtagttacttaactacttgcttagtatggcatctgacatacattagatgtttaagatacaatttttttttttttttgagacagagtctcgctctgtcaccaggctagagtgcagtgctgygatctcagctccctgcaacctccgcctcctaggttcaagtgattctcctgcttcagcctcccaagtggctgggactagtaggtgggagctgcacgccaccatgcccagctgatttttttgtatttttagtagagacagtgtttcaccatgttggccaggatggtctccatctcctgacctcgtgaactgcccgcctcggcctcccaaagtgctctgattacaagcgtgagccacacctggccagatataatttttaaaagctggcacagctactcaggaggctgaggtgggaggagggct

SEQ ID NO: 173412 - DNA, 601 bp, Human
accttaagcctggagatagagaaccagaatctcagcccccttactccagtttagtgctctttccaccattatgcatcctgtgctgtgaaacaacaggacaacagttcattttccttgctattaagtttttctcttgccttctcccttatgttgtgatttcttttggaaacattttaagaaatggtttttaatttgagcctatctcttaacttttacacttgagatcattaaatttactttggctactgttttgagccaattatccatttcaatgggatttctaacataacttcaacaatcsattgtaacacattctgagaggtcattcctagatatgaaattccctccactttttgtggtctatcccagcctcccctttgtcttcagagtcaacctataggttcatggtgagaaccatttcctttaataagtctataatctagataattattttcttatatttctgtgtttaaaacaatgaagtcagccttagttttatgtgaatgatatcttatcctttaattccttaaaacagtagtagtttttgttttccaggattctgataagttgccataatgtctctaagtcttgatgctaaaaa

SEQ ID NO: 173413 - DNA, 601 bp, Human
atttactttggctactgttttgagccaattatccatttcaatgggatttctaacataacttcaacaatcgattgtaacacattctgagaggtcattcctagatatgaaattccctccactttttgtggtctatcccagcctcccctttgtcttcagagtcaacctataggttcatggtgagaaccatttcctttaataagtctataatctagataattattttcttatatttctgtgtttaaaacaatgaagtcagccttagttttatgtgaatgatatcttatcctttaattccttaaarcagtagtagtttttgttttccaggattctgataagttgccataatgtctctaagtcttgatgctaaaaatatattccttgcatagttggaattttataaaccatgtacttttttcatttctgtgagttttctcttctgagatacttttcactgtgcttttgaagcctttccttcttaaactcttaggttagccctaattatttttctcttgacttgtgactttatgttgcttgtatcttttttgaactgttgaatgcattttaaatttctaattattttatcctaataaattgttcccta

SEQ ID NO: 173414 - DNA, 601 bp, Human
cctagatatgaaattccctccactttttgtggtctatcccagcctcccctttgtcttcagagtcaacctataggttcatggtgagaaccatttcctttaataagtctataatctagataattattttcttatatttctgtgtttaaaacaatgaagtcagccttagttttatgtgaatgatatcttatcctttaattccttaaaacagtagtagtttttgttttccaggattctgataagttgccataatgtctctaagtcttgatgctaaaaatatattccttgcatagttggaattttrtaaaccatgtacttttttcatttctgtgagttttctcttctgagatacttttcactgtgcttttgaagcctttccttcttaaactcttaggttagccctaattatttttctcttgacttgtgactttatgttgcttgtatcttttttgaactgttgaatgcattttaaatttctaattattttatcctaataaattgttccctatggggtttatcattttcactttagagtgagtaggtcctaatctaatctgatgtgtttctacttgagtataatgagacgatatctattccaaattac

SEQ ID NO: 173415 - DNA, 601 bp, Human
tcccctttgtcttcagagtcaacctataggttcatggtgagaaccatttcctttaataagtctataatctagataattattttcttatatttctgtgtttaaaacaatgaagtcagccttagttttatgtgaatgatatcttatcctttaattccttaaaacagtagtagtttttgttttccaggattctgataagttgccataatgtctctaagtcttgatgctaaaaatatattccttgcatagttggaattttataaaccatgtacttttttcatttctgtgagttttctcttctgakatacttttcactgtgcttttgaagcctttccttcttaaactcttaggttagccctaattatttttctcttgacttgtgactttatgttgcttgtatcttttttgaactgttgaatgcattttaaatttctaattattttatcctaataaattgttccctatggggtttatcattttcactttagagtgagtaggtcctaatctaatctgatgtgtttctacttgagtataatgagacgatatctattccaaattacattttcttgaactcttttagggactataaagagtgtattataga

SEQ ID NO: 173416 - DNA, 601 bp, Human
agattatggaaactttgaaatccttagtttgatgagactttgtcccataatcccaaagttgttggaattgccaatgcaagctataaagtgtgtactagcaggtatgaaatttttatagcctccatattctttaaaaattctacagatgaagaaacatgaaaagatacacgaaatagggaaaagctgcttctcaaaacaacatcatgatcagatgcttaaaagttactataaatgtcatttatcccaaagaaatcagagatttctttccatgtcaattagttggcttcattcaaacgtaccrtaatttagaaagaatatcctatctcagagggcattacatttgcagcatatccaagatcttttcctcaggctgtgttgcaagatatagttatatcccaaaatacttccttaggctacattcccacaggtggaacaggtcagtaagtctccttcttttcatgtttgtgatacatattgtacattttcttccagaaagggttgacctagtttacatgcccaacgaaaaagtatgagagagtccattctcatacacattggtgcatcaaagggttgcttctatattatttcatcctggccaatt

SEQ ID NO: 173417 - DNA, 601 bp, Human
aatgcaagctataaagtgtgtactagcaggtatgaaatttttatagcctccatattctttaaaaattctacagatgaagaaacatgaaaagatacacgaaatagggaaaagctgcttctcaaaacaacatcatgatcagatgcttaaaagttactataaatgtcatttatcccaaagaaatcagagatttctttccatgtcaattagttggcttcattcaaacgtaccataatttagaaagaatatcctatctcagagggcattacatttgcagcatatccaagatcttttcctcaggctrtgttgcaagatatagttatatcccaaaatacttccttaggctacattcccacaggtggaacaggtcagtaagtctccttcttttcatgtttgtgatacatattgtacattttcttccagaaagggttgacctagtttacatgcccaacgaaaaagtatgagagagtccattctcatacacattggtgcatcaaagggttgcttctatattatttcatcctggccaattttgataagctaaaggtgaaatttcaattcgcctcattactagtgaggctaaacattgttttgtaagttactt

SEQ ID NO: 173418 - DNA, 601 bp, Human
gttatatcccaaaatacttccttaggctacattcccacaggtggaacaggtcagtaagtctccttcttttcatgtttgtgatacatattgtacattttcttccagaaagggttgacctagtttacatgcccaacgaaaaagtatgagagagtccattctcatacacattggtgcatcaaagggttgcttctatattatttcatcctggccaattttgataagctaaaggtgaaatttcaattcgcctcattactagtgaggctaaacattgttttgtaagttacttggcccttgcatttcrtaaactgactgaagcataactgttggattgctgatttgtaagtgccctttcagtgttgagttgtaagtgccaccaatgtttcatatgttaatataagggaccagtacttcttcagagattgttttatacttttgtttatggctttcttaattttattgggctataattttcctacctaccataatgttcactttaggtgttaactatacaattcagtaattctcagtaaacttactgagttgtacaaacatcaccgtaatctgatttagaacatttccatcaccctggtatggtctctcg

SEQ ID NO: 173419 - DNA, 601 bp, Human
tttcatatgttaatataagggaccagtacttcttcagagattgttttatacttttgtttatggctttcttaattttattgggctataattttcctacctaccataatgttcactttaggtgttaactatacaattcagtaattctcagtaaacttactgagttgtacaaacatcaccgtaatctgatttagaacatttccatcaccctggtatggtctctcgtgcctattaatggttagtccttgctccccaggtaataactaatctactttctggctctgtagatttgtgtttctggacrttgtgtatcaatggaattacgtggtttttgttttacatattatagaagctttttacaagcttttgctttttcttttttttcttggtagagatgtgagtctggccatgttgcccagtctggtctcaaatcggcctcggcctcccggcgtgctggaatgaaccattgcccaccagcaggctttttctttgttaattatgcattcatttttatgttcttcttaagtgacacgtttccgttccagtgtttgccataggtttcttaagtttaccttgggggaaattaggagctaaatttctaaat

SEQ ID NO: 173420 - DNA, 601 bp, Human
tgtagatttgtgtttctggacattgtgtatcaatggaattacgtggtttttgttttacatattatagaagctttttacaagcttttgctttttcttttttttcttggtagagatgtgagtctggccatgttgcccagtctggtctcaaatcggcctcggcctcccggcgtgctggaatgaaccattgcccaccagcaggctttttctttgttaattatgcattcatttttatgttcttcttaagtgacacgtttccgttccagtgtttgccataggtttcttaagtttaccttgggggaarttaggagctaaatttctaaatgctttcagaataattgtaacattcattcaaaattctttgttaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaa

SEQ ID NO: 173421 - DNA, 601 bp, Human
ttcagatggttctataaataaatagtttcttgtacttataaaaagaatttatgttgaatgcctttcatctttttaaatcaagcattcatctaaatacttgtaagaatgtttgaaaaataaaattttatggggagttttataggttgccagcagctgatgatcagaaatgtaaatttgaaatttacttagataataatttattgtaagactgactttacggttaatattcctataaaggcacttaaaaagtcagtggaaattcagttcttcaaaagcgggttcctcagccaccccaacctcsctacatccctcctccactatgtccatttaatgtttaattattttcacagttcccttgggtgtggaaggaaaagtaaatccattggagtggacatgggttgaacttggtgttgaccaaacagtagatgttgtggtctgtgtgatatatagtcctggagaattttattgccatgtgcttaaagaggatggtaagttgattcttgtcatttgtttctttttacaaatacattggcatagataataacttcacatgagtttgttactaagtgataaaagtacctctttccaagaagagccaagt

SEQ ID NO: 173422 - DNA, 601 bp, Human
ttagcttttattctcttttaagccattatttctattttcaacaatacctctttatatttaaactagtttacatttcatagagtatctcctaaattcatttacagaaattaattcggcctggtatagtggctcactcctataatcctaacactttgggaggctgaggcaagaggatgacgaggccaagaactcaagggtgcggtgaggcttgatcataccagtgtactccagcctgggcagcagagctagaccgtgtctctggaaaacaaacaaacaaacaaaaaacaaatttaacttgtgwtgaagtattagtgtaacgtatagatacatgtgtatataggagtacaacataatgaattatcacaaactccacacacttgtataactagcctctaagtcaagcaataaaacattaccagtatcccagaagtttccctcctatcccctcccatcattacctcttctttctttcttttttttttttttcattgagatggagtctcgctctgttgcccaggcctgagtgcagtggcacagtgtaggctcactgcaacctctgcctcccaggttcaagcgattctcctgtctcagcctcctgagt

SEQ ID NO: 173423 - DNA, 601 bp, Human
tatcacaaactccacacacttgtataactagcctctaagtcaagcaataaaacattaccagtatcccagaagtttccctcctatcccctcccatcattacctcttctttctttcttttttttttttttcattgagatggagtctcgctctgttgcccaggcctgagtgcagtggcacagtgtaggctcactgcaacctctgcctcccaggttcaagcgattctcctgtctcagcctcctgagtagctgggactataggcatgtgccaccacgcccagttaattttttttttgtatttttartaaaggtggggtttcaccgtgttagccaggatggtctcgatctcctgaccttgtgaatccacctgcctcggcctcccaaagtgctgggattacaggtgtgagccactgtgcccaagctgccacctctctctttcaaaagtaaacatcttgctttctaatagcatagataagttcttcctggttttgaactttctagaaatggaattacacactatgcgagcttctgagccttgctgctgccccctgcactgtgagattgttacatgtctgtaccttgtttttccttgctgcatagtgttc

SEQ ID NO: 173424 - DNA, 601 bp, Human
gttttgaactttctagaaatggaattacacactatgcgagcttctgagccttgctgctgccccctgcactgtgagattgttacatgtctgtaccttgtttttccttgctgcatagtgttccattgtatgttacatgtatctgtatcttatttttccttgctgcatagtgttctgtgaattgtattgcagtttctttctaccattggacacttggcctgttttgcttgggctgtaaattagtgttgctgtgaacattacagcatatctggtgcacatgtgcaggcattttcatggagtccawacctaggaatgaaattattaggtcataaagggtatgtaaatttgcagcttccccatctacaaaggccagtttctgaagtgattcagaaacatctagttgctccacatcctcacaaacattgtgtgttttctttttcatttgagccgttctgatgagcatcattgatcttaagttttccaaatattggtttttctttgtcaaataaggacattaaagtagataactaaggccctgtctgaccccatagttgtgagatttgtcatttcttcattcagaatcatctggttggtaggccaccat

SEQ ID NO: 173425 - DNA, 601 bp, Human
ctatatctatcaacagtataaaatggtaagtaatttttgcattttttcttccactacattttggatatcagttcacatactgttttctccagtctctttttaaataacagtttttattttggaataattttaggtatacagaaagtcacaaagatggtacatagagttcctgtatacacctcacccagcttctcctgtagttagcatgtgatcgtggcacatttgtcgcaacaaagagaccaacagtggtatattaccattaaatgaaccccaaactttatttggtttttgctagattttycactagtgtcctttttctgttcaggagccactctgtgacaccacattgctgtttagtctctattctttttcatggctacatggtattccactgtgtgggtttatcctaatttaattaacctaagttaacatctagttgctccacatcctcacaaacattgtgttttttcttttttgtttgagccattctgatgagcatcattgatcttaacttttccaaatcttggtttttctttgttaaataaggacattaaactagataactaaggtcctatctgaccccatggttgtgagatttaac

SEQ ID NO: 173426 - DNA, 601 bp, Human
gaaactttctcaactttctaatacttggggcatataatccaagtgttaatatctacaatgttaacattttgtgtgagttagaggatcctgcttcatattataaaacttagaaattttacttacaatattgaccaaaaacgtccagtgttgtcagagtagggaagcggctcctttactgaccacaggaataaaaactgcacgatcctctggaaggcattggcaggattccttaagaacctccagcgttcataccttctgacttagtaattttgctcctagtaatttatcccagagaaatccrggaattgcacagaataggttacaaaaataattattacaccactgataataatggcaaaataacataaatagtcaataatagcagattgggtaaatgatccataaaatggataatgatagtacttattttgtagggttgttgggaggattaaatgaaggtttaggacagggtctggcactcaaagttctacatgtttagctgtctattgcacagtcattaagatgatgttaaatatgtgttattgatatgaagaattgttcatgatttaagtgaagaaaacaggttataaaagagtgttgt

SEQ ID NO: 173427 - DNA, 601 bp, Human
caggaataaaaactgcacgatcctctggaaggcattggcaggattccttaagaacctccagcgttcataccttctgacttagtaattttgctcctagtaatttatcccagagaaatccaggaattgcacagaataggttacaaaaataattattacaccactgataataatggcaaaataacataaatagtcaataatagcagattgggtaaatgatccataaaatggataatgatagtacttattttgtagggttgttgggaggattaaatgaaggtttaggacagggtctggcactcaragttctacatgtttagctgtctattgcacagtcattaagatgatgttaaatatgtgttattgatatgaagaattgttcatgatttaagtgaagaaaacaggttataaaagagtgttgtgataaagacaatagacgtcagagccaactgctgcttgctgtctatgagacgtttaggcaaattatttaaactttctgtgcttctgtttcctcatctggaaattattcctaccttcctcaaagagttgttaagagaaaaatataaagcacttaacagtgcttggcattatacctatagtagcg

SEQ ID NO: 173428 - DNA, 601 bp, Human
ttcctcatctggaaattattcctaccttcctcaaagagttgttaagagaaaaatataaagcacttaacagtgcttggcattatacctatagtagcggttattataaaaactttataatagaatatataagagaatgtgtgtatatgtgtgtattttggacatctgcacataaaagttgtggctggttggattccaaaattcaacagtggtaaagtcaggcagcatagatggatttatttcttctgctaatctgtttctgtttattttataatatatttcagattattgttctttttttaatttttttttttttttttgagatggggtttcactgttgttgcccaggctggagtgcaatggcacaatctcggctcactgcaacctctgcctcccagattcaagcgattctcctacctcatcagcctcctgagtagctgggattacaggcatgtgccaccacgcccaactaattttttgtatttttagtagagacggggtttctccatgttggtcaggctggtcttgaaatcctgacctcaggtgatccacctgcctccacctcccaaagtgctgggattacaggcatgagccactgtgcccg

SEQ ID NO: 173429 - DNA, 601 bp, Human
ataacagaacatgatggtgaattctaaaacagtactcctttttctattggaaaatgcccggtaaagatatgttagcagagaacgtaaggaaagatcctgagcctcctaaaaccctagagtgtattagcaagtgcattatctcttaagtcaggcatgcaggatgtaggtgtataattgaatattgaagatactgagaattgctgacctgaaagtaaacttggcaaagacctggtgctgggtactactaaagcaaaaatgaaacttgttcataggattctttttactgctgtccttattttcyagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaaggtaacattttaaaaccatttat

SEQ ID NO: 173430 - DNA, 601 bp, Human
ttaaatttgttattctttgctctcagagactatgaaaaattttccatcataaatgacagttttcctgtagagatatgctttacggacatagattagtaggttaatattgtattattattaaattattgaacaaacattcatttcaatgtaattgtcagataaacatatacagagatatctcacttagaagcttgagtaagttgtaagaattatattaaatatttgacagagatggaaatatacagaaataaactacaggagtgtaatagttcaaggatttcattgtagactgaactttttygtactgcccacaaaatccctcaaatagaatagattgttttgtgaaaaaatacagatttttattttggggatttggaaatgttgataatcatttcatgaacaaatgattgaattaaatatgttactgaggaaaacaacagtacattttttttattccgtgtgagacctgtgttttgtatgtttccagctacctcttcagctgagcaatggaagacgatagaattgccagtggataaaactatacaagcaaatgtattagaaatcataagcccaaacttgttttatgctctaccaaaaggga

SEQ ID NO: 173431 - DNA, 601 bp, Human
gatggaatgcctcagggagtcaggctcattgatgagggtatactttgatccttctccgttttaatgtctcattttaacaaatttcgtatgctaatataaataacacttggatttgcttctgggatcaaggttaagtgggagtggagccaggttacagtgctgcttcatggtccacagtcaggtccaattggcaggcaagcatggctcctgccagtccctgggcagaggtggctagtggcaggatggcagccacgtggggctagagctgagttcacctggggacagggctgctttcagtcartagctgggaacaaggtcttgaaagtctgccactggggcacaggcctgccttctcaaagagccttcctcaatcttgggctccagtggcgtttcaaaaccccccatctggatcccaaacctctcacaaaggcatttttgtgattagatgggcaccaaattgtttttgttggggagcacaagttggggaccttcaaacttcatggtcttgcagatattgcacactagttttgtttttcttttgtatgagaactggatctatacttgccctttctttccaggataaatcacaatttttggttct

SEQ ID NO: 173432 - DNA, 601 bp, Human
tgtatacctgtattcccagctactcaagaagctgaggtgagaggatcacttgagtctgggaggtggaggttgcagcgagccaagattgtgccactgcactccagcctgggctgcagagccagaccctgtctcaaaaaaaaaaaaaaaaattctattacatttttcataggaatgtagaggtaaatgcttgtatttaatttgaactgtaaccagaaattttggcatggatttttaagtgatgtaaatataactatgaatagccatcttaaagtaggaggaatcactgactgtaagttcttayctgagatttcattctgttttcaggtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggtagacagctaagtcactttccaatttaggtttctgggtattttttttttcctctttatgtttcatagctctaagtcggaatcaaatgggtatttccagtaactgcctt

SEQ ID NO: 173433 - DNA, 601 bp, Human
cactgactgtaagttcttacctgagatttcattctgttttcaggtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggtagacagctaagtcactttccaatttaggtttctgggtattttttttttcctctttatgtttcatagctctaagtcggaatcaaatggrtatttccagtaactgccttaatgtttttaaatattaagagttttcaaataagtttcatattctttattctttatcgaattctcacaaaaactgtgttcagtcagtctttgttttgtagattagtttcagagggccagggttcagagattcggttttgcccctggttgctaagctagtaagtggcaaggccaggatgtgaaacagggtgtctggtgtctgtgaaccagggtgtctgacctctcatttggggtctttctgcttcgtcacatctctctttagggactaaaggcattcacatga

SEQ ID NO: 173434 - DNA, 601 bp, Human
ggacatcagacactgatgtggaagtgctctatgcagactatggaaacattgaaaccctgcctctttgcagagtgcaaccaatcacctctagccacctggcgcttcctttccaaattattagatgttcacttgaaggtagacagctaagtcactttccaatttaggtttctgggtattttttttttcctctttatgtttcatagctctaagtcggaatcaaatgggtatttccagtaactgccttaatgtttttaaatattaagagttttcaaataagtttcatattctttattctttatcraattctcacaaaaactgtgttcagtcagtctttgttttgtagattagtttcagagggccagggttcagagattcggttttgcccctggttgctaagctagtaagtggcaaggccaggatgtgaaacagggtgtctggtgtctgtgaaccagggtgtctgacctctcatttggggtctttctgcttcgtcacatctctctttagggactaaaggcattcacatgacaccatttttggctaccttatgaaagataaatctgcatatattcaactccttagttggaatttgaacaaagtgaac

SEQ ID NO: 173435 - DNA, 601 bp, Human
ttttaaatattaagagttttcaaataagtttcatattctttattctttatcgaattctcacaaaaactgtgttcagtcagtctttgttttgtagattagtttcagagggccagggttcagagattcggttttgcccctggttgctaagctagtaagtggcaaggccaggatgtgaaacagggtgtctggtgtctgtgaaccagggtgtctgacctctcatttggggtctttctgcttcgtcacatctctctttagggactaaaggcattcacatgacaccatttttggctaccttatgaawgataaatctgcatatattcaactccttagttggaatttgaacaaagtgaacaaaaatacttaaagtagctttttactgtcgctcctgatgtccttatgcagaggacttgcagataataccataccgattgcttcatggtcctcttaggttttgactcagagttggaaaattatctttgtttctcctgttggaatatatgaaggacagatgtgtctgtttcgtgccctctagtccaagattagtgcttgatgccttgttaggtgatcaatcaatatgtattgaataaatttgtcttttgta

SEQ ID NO: 173436 - DNA, 601 bp, Human; identical to SEQ ID NO: 24753

SEQ ID NO: 173437 - DNA, 601 bp, Human; identical to SEQ ID NO: 24754

SEQ ID NO: 173438 - DNA, 601 bp, Human; identical to SEQ ID NO: 24755

SEQ ID NO: 173439 - DNA, 601 bp, Human; identical to SEQ ID NO: 24756

SEQ ID NO: 173440 - DNA, 601 bp, Human
gaaaacttccaagtgagtggaaccagaatacgtttttcttaggtaattctattttcatcattttcttttacctgtaattcaggcaaaaggaaaagatggagctcattctcaatatagataacaaaaatgactttcctgctatagattttactttcctctacaacaaaaccaggatttatttctgcagcacagagtactgaatgtccctgcaaggaagacagtttatctaataactaagggtactgaattttaagtggtggaaaatgagctgctgtgtagccaaaagtacttaaaagataamatatctgtgacttgagaactgcattgctttggagttttctggaatcttaaaggtactggtgagccattcttcaatcgccaacgggtgaagggagaccttgccacacagcccattttctctgccaggtccccagctgtttacaactttctgtgatggagctaaagttgacttcattgatagttacagctggataataggaatcagatgtcccttttgaacaacaagataggaggagagaagttattgaaaacagacctctctcgctccctctctgtctctcaagatgctccaaatctctta

SEQ ID NO: 173441 - DNA, 601 bp, Human
taagtcctgttgatgtggacagtacctgccttgggtttttgttgaagttcactagacaaggtggggataacagctgcagaaaaaggaatattttaaaacctgcacatactgaatgcccactgctaagcaaagaaagagtgaaatcaactcctttggaaaaaagaattttgtgtttggagaggaggcaggagggtgctgtgcgcacacaccacttctctggggacagtttcacaaatgccatcagccgttattacatgaaatctttccagtataaatctttacacctctacattcagctgtytgatgaactgtaaagacacactcaaaaggatgaaatacttggacgaagtgaaagctgggagtaaaacagtatgtattgtagtgacatgaacaaaacaaaaatcaaacaccactaacattacttgcttgttcttgacagacataaagcctcaaattagctcctttaaaaatatacacatggtatttgttcggtatattatagattgacaagtgcatatgttataattggtgaatattagtttcaaagaaaaaagtcacacccattttgtaggtcagtcaattcatgctttaacctccaaag

SEQ ID NO: 173442 - DNA, 601 bp, Human
atcttgaaagcacttaacttactgacatgctgtcccactttcaaatcccactgacagtttcttctttaccattaacccaaccctatcatcacctctttggtcatcacagaattttacaggtgatcgtgacatgtaactgatgatccttacctgtagttatttaatctaaattaccatttccacccattcagatgtccagggtaacaacagtgacccaataattatgaactgaactcaataacccaatgggtcagaagccttgtttctggaattctttatgagagttacagtaaaaaaaaawtactctctggtctatgttataaatgcatacaatttcaaatatttatcaccaaaggtaagctcacttctacagaataaaggaaacagcaaggacttatggctaacatactaaaagcaggtacaatttatttactttcatttaagcaccttttccttgcagaaaaaccaactcgaaagtgcagttggagaaattcagttcttccttttgatgctatctttggcatcttctgatgccatctttggcatggaggtggggtgaggtgagatgaagaaagcaggcaaggtagatagatacagaatt

SEQ ID NO: 173443 - DNA, 601 bp, Human
accttgcacagtctgtcttatctgccaggacagttcctggtttgttgcctactgaactgtgctcaaggcttaagtgacacacatggattgcctgctttttgccacagtccctaatgtctctcagagtgtatttgctcaactgcgggaggttagaggtctctcccttatgaaggtcataaaattactttttaaaaattgaatgattatttttggacttttaatcctagatacttagaattttacatttcaatttgaaacatctagaattccaaacatgttgaatttcaaattaacatcttgwttattaaaagaaccatttttattcttccagctgttatttttcttttcctaatgaatccataatttgctgttatggctaagatatcttcaaaaggctcagagctgttctccaacacattaacatatatccactcagacagaaaccatctcaatcttgaaagcacttaacttactgacatgctgtcccactttcaaatcccactgacagtttcttctttaccattaacccaaccctatcatcacctctttggtcatcacagaattttacaggtgatcgtgacatgtaactgatgatccttac

SEQ ID NO: 173444 - DNA, 601 bp, Human
tcattcttttttccttcatgagtaaaatgtataattatatatttattgttttccttgcatcgtgtctgtctccctcattaactttagtcatgctctctgccctcatagagtttattttttaaccactgtctatacccaatgctttccacaggtacacagaaggcacaaatcctagttgagggaatgagctagaatttattacttgtaaacaaatacttagtttgcagacacttgacttatgttaattacacgatttgagcctaactatatagagagtcactgaggtaaggctggtgggtcrgcctttgggaaggatgaaagaaactggacttcatagtatatacctgaagaacgtggagagtgagaggtggttatgtgagcaggaaggaaacttatgaactaggatcagctgcctcctgcttctgtttaacatattctggaaagctctgcagagaaaactcaaggcctcattttggaacacttcctcccctctgttgcagccatttcctaaagagagtaacttatagttctacaataggaataagaccttgccttctcagtagtttctattggtgtttaataccttgaatgtgggcaccac

SEQ ID NO: 173445 - DNA, 601 bp, Human
ttcaaatcaaatccacctggcaggcaatggatagagagaccttttttttttttttttttgagacggagtctcactctgtcgcccaggctggagtgcagtggtgcgatcttggctcactgcaagctccgcctcccaggttcacacttttctcctgcctcagcctcccgagtagctagaactacaggcacctgccaccatgcccggctaattttttgtatttttagtagagacagggtttcaccgtgttagccaggatggtcttgatctcctgacctcgtgatctgcccgcctccacctcccmaagtgctgggattacaggcgtgagccaccgcactcagccgagagacctttcaagaacataatttggatggtcactactctgcttttgtctccagcattgatatagtttggctgtgtctccacccacgtttcaccttgaattgtaataatccccacgtgtcaaggataggtccaggtggagataattgaatcatggggcagtttcccccatactattcttgtgatagtgaataagtctcacgagactgatgattttataaatgggagtttccctgcacaagctctcttgcctgccaccacg

SEQ ID NO: 173446 - DNA, 601 bp, Human
tcccttcttcaaatcaaatccacctggcaggcaatggatagagagaccttttttttttttttttttgagacggagtctcactctgtcgcccaggctggagtgcagtggtgcgatcttggctcactgcaagctccgcctcccaggttcacacttttctcctgcctcagcctcccgagtagctagaactacaggcacctgccaccatgcccggctaattttttgtatttttagtagagacagggtttcaccgtgttagccaggatggtcttgatctcctgacctcgtgatctgcccgcctccrcctccccaagtgctgggattacaggcgtgagccaccgcactcagccgagagacctttcaagaacataatttggatggtcactactctgcttttgtctccagcattgatatagtttggctgtgtctccacccacgtttcaccttgaattgtaataatccccacgtgtcaaggataggtccaggtggagataattgaatcatggggcagtttcccccatactattcttgtgatagtgaataagtctcacgagactgatgattttataaatgggagtttccctgcacaagctctcttgcctgc

SEQ ID NO: 173447 - DNA, 601 bp, Human
taacaaaaatagaaatcactttgaatcagtttttgttttggattacccattctgctattacaatccactaatttacctgtcccagaaatgtcacttccagaagtagatacttacatagatagtatgacctggtgagccaggaatactggagcctggcctagaataaatactttccgaggatgtcctggtaggctgtaaaataaacagtgacttgtaagacttcggaccctggcttcagaatctagactgtcctgggcccttaagctttactaaaaactcagctagtgaaaaaaagaaacayttatcacctttttgaataaggtaaaatacaacctagaaggaaaggtaaatgcaaactagttgtacgatccagttttgaaaaggcatggggaggcctttctctggcccttcctgctccttgtcccctacgagaatttctggtttacctttgagcacacctcaaagcttcccatttctctccctctctactgccgtagtcccagccccagtcaccacctccattcatccagattattgcaatggcctccctgtgagttttctgccttctcccctcccttcttcaaatcaaatccacctggca

SEQ ID NO: 173448 - DNA, 601 bp, Human; identical to SEQ ID NO: 24757

SEQ ID NO: 173449 - DNA, 601 bp, Human; identical to SEQ ID NO: 24758

SEQ ID NO: 173450 - DNA, 601 bp, Human; identical to SEQ ID NO: 24759

SEQ ID NO: 173451 - DNA, 601 bp, Human; identical to SEQ ID NO: 24760

SEQ ID NO: 173452 - DNA, 601 bp, Human; identical to SEQ ID NO: 24761

SEQ ID NO: 173453 - DNA, 601 bp, Human; identical to SEQ ID NO: 24762

SEQ ID NO: 173454 - DNA, 601 bp, Human; identical to SEQ ID NO: 24763

SEQ ID NO: 173455 - DNA, 601 bp, Human; identical to SEQ ID NO: 24764

SEQ ID NO: 173456 - DNA, 601 bp, Human; identical to SEQ ID NO: 24765

SEQ ID NO: 173457 - DNA, 601 bp, Human
tggctcactgcaacctttgcctcccaggttccagcaattctcctgtctcagcctcccaagtagctgggactacaggcgcatgccaccatgcccagctaatttttgtatttttagtagagacagggtttcaccatattggtcaggctggtcttgaactcttgacctcaggtgatccacctgcctcagcctcctaaagtgctgggattacaggcatgagccaccacgcctggcccagcataaaggatttcttattacccaaatggacaaaggcttaaatcgggactcacgtcctgggcatgartaaaatgaatataatagcccatgaaataaaggaaaaaaaattcctgagaactttcatttaatgtaattcaataaatagcacaaacatttatcagtgtagagaaaattatacattatcaaaggatcaaatagtttgaattctctacgatcattaaatctagggtcttagaagattgcagctttttatcatcctgttaattcttttggtttcatttcttgtacaatttatttttaaaaaggtagcatatgggtttgctctcatctatgcgtccagaagcaagaagcttaacatgaagtcttc

SEQ ID NO: 173458 - DNA, 601 bp, Human
caatggcgcgatcttggctcactgcaacctttgcctcccaggttccagcaattctcctgtctcagcctcccaagtagctgggactacaggcgcatgccaccatgcccagctaatttttgtatttttagtagagacagggtttcaccatattggtcaggctggtcttgaactcttgacctcaggtgatccacctgcctcagcctcctaaagtgctgggattacaggcatgagccaccacgcctggcccagcataaaggatttcttattacccaaatggacaaaggcttaaatcgggactcaygtcctgggcatgaataaaatgaatataatagcccatgaaataaaggaaaaaaaattcctgagaactttcatttaatgtaattcaataaatagcacaaacatttatcagtgtagagaaaattatacattatcaaaggatcaaatagtttgaattctctacgatcattaaatctagggtcttagaagattgcagctttttatcatcctgttaattcttttggtttcatttcttgtacaatttatttttaaaaaggtagcatatgggtttgctctcatctatgcgtccagaagcaagaagctt

SEQ ID NO: 173459 - DNA, 601 bp, Human
gagaagattctaaagtctattggcatcagaaccataattggaacagatggaaactttctcagtaaggacatgagcttttgggggaaggagtgttgactgaccactcccctcactgttcaggggtctttggaacaacaatgcccctataaccccacgccgctccggcaactccatggctggggtctcagtgacctcagcatatgtacatgagcagggtggcagcataaaggatttttttttttttttttttgagatggagtcttgctctgtcatccaggttggagtgcaatggcgcgatctyggctcactgcaacctttgcctcccaggttccagcaattctcctgtctcagcctcccaagtagctgggactacaggcgcatgccaccatgcccagctaatttttgtatttttagtagagacagggtttcaccatattggtcaggctggtcttgaactcttgacctcaggtgatccacctgcctcagcctcctaaagtgctgggattacaggcatgagccaccacgcctggcccagcataaaggatttcttattacccaaatggacaaaggcttaaatcgggactcacgtcctgggcatgaa

SEQ ID NO: 173460 - DNA, 601 bp, Human
aaaggagagaaggagaagattctaaagtctattggcatcagaaccataattggaacagatggaaactttctcagtaaggacatgagcttttgggggaaggagtgttgactgaccactcccctcactgttcaggggtctttggaacaacaatgcccctataaccccacgccgctccggcaactccatggctggggtctcagtgacctcagcatatgtacatgagcagggtggcagcataaaggatttttttttttttttttttgagatggagtcttgctctgtcatccaggttggagtgcartggcgcgatcttggctcactgcaacctttgcctcccaggttccagcaattctcctgtctcagcctcccaagtagctgggactacaggcgcatgccaccatgcccagctaatttttgtatttttagtagagacagggtttcaccatattggtcaggctggtcttgaactcttgacctcaggtgatccacctgcctcagcctcctaaagtgctgggattacaggcatgagccaccacgcctggcccagcataaaggatttcttattacccaaatggacaaaggcttaaatcgggactcacgt

SEQ ID NO: 173461 - DNA, 601 bp, Human
ggcaggaacagaaaacagaaggcaaagcctctcttctgcatcatgtgggagttaggacaaatcaaaagatgactgctctgagagtcggctcaaagagaaacattgatgttgccatagatcttttaatgctgcccaaacatgttaatatggtcatggtttatcaccggtaagacaacttttggatatctgttactaaacactgtcgtgttttgctgagacacgttgcgtattgaacccaggaaaatattccaattatatatattatattttgtttcgatgcatccaaaaacaaaataataaaatatatatatatattttcttttttcaaagtagtggataataaatcttatggtcttaaacatacttcctgcttcttcatctagagcccttagaagtgacatatttctcccaatgagagatgctatgcccgttctaagacaactgttgggtatagtcatgacacacgcaggcatgctgagagctcaaaagctcggcactaactcttggagatacaccttattagccttcccagggtgctaataaatctccactatgcagggtgctgcctggagaaacctgcctccttacctttgatatgggg

SEQ ID NO: 173462 - DNA, 601 bp, Human
taaaataatctgtcggctgagcatgatagctcacgcctgtaatcccagcacgttaggaggtcaaggcgggtggatcacttgaagccaggagtttgagaccagcctggccaacatagtgaaacccagtctctaccagaaacacaaaaattagctgggtgtggtggtgcacacctgtaatcccagctactcaggaggctgaggcataagaatcgcttgagcctgggaagtggaggttgcagtgagccaagtttgcaccattgtactccagcctgggtgacagagtgagactctgtgtcaaaamaaataaaaaataaaaaaataaaataaagtaaaataatctgtcaagagttttagagagtgttgcacctatcaaaaaatttgctaatggcaaatggcacgtgtaccttaactccaggtatgtgtgtctttgataagcatgattgcttcaataagcaatattattttcaaaacatagagaatgctgaaattagcaaatttataaaatcactgcatactgataagtacagtacatgtaccttttaggattcagccgctcaacaaccaagtgagcacaaagaaaaagcttcggtagactgacaac

SEQ ID NO: 173463 - DNA, 601 bp, Human
atttacatcatggcaactcatatttatagcaaaagaggaaagattcctttcaaagaaacttaatatatgtaaccctcctgctcagaaatccaatttatacttcatggacacagaatgtcatgtctagcagtatttcaaaggggaagcaagagaaacttagcagacactttacaaacgaagcccgaaacaaagcgaaaatggtttttccaaatctctaggcataaggttgtccaaatggcccaaagatatactaagatagaatgaggctacaaggaagtttggaggacagaaataaaaatayacccaaccaacaatggatgttatggaaaatgaatggggaagccagtgaaggagagaaacagtctgtgccgtgcatctcagctttacaaccatgcaggcgtcctcagctcagtgaggccccaggcctgggtcacatgctgcaaaaacaaggaacaggaagtggacttgggcaatggaaggctgggcttctggctgccagagtggcaaagggcgccccctgcctctgagatggacatcctaccttaggtcaagctcccagctcacatccattaaaaacaaaacaaaacaaacaaacaaacaa

SEQ ID NO: 173464 - DNA, 601 bp, Human
gacctcaggggagcattcactcacaggactctcactgtacttaacacatttaaatgcccatctccactttcattcttctttttggcaccatgagagcccgagtgactaattctaagacaagcgaatagagatgggggtgtgcgattctgctgtggggacctgttggagcactgcctagctttctggactcagagtgcttacatccccaaatataaatgaacatcttgagggaaccttaagataagttggcagcatccagaattttgtgacagttttaagattgccggttcttgtctaaagygtcaataagagttacggtttccttcagcaagtgtcaaatatatatttacatcatggcaactcatatttatagcaaaagaggaaagattcctttcaaagaaacttaatatatgtaaccctcctgctcagaaatccaatttatacttcatggacacagaatgtcatgtctagcagtatttcaaaggggaagcaagagaaacttagcagacactttacaaacgaagcccgaaacaaagcgaaaatggtttttccaaatctctaggcataaggttgtccaaatggcccaaagatatactaagat

SEQ ID NO: 173465 - DNA, 601 bp, Human
actgcttctgaacccccctgccccatgcttttgttctttcacatagacctccactgtccttgcagaaaatcagatgtttccaggaaagttctcgtaggttttggttataatacacaatcaaatgaacccccattaaatcagtttttatcattattagccagtgtcacgcacacacaaaaatatctgcatatgcaggacacaaactttaaggttattagaattagacatttgtccagggattaaaatatttctatcaacaagaccctgtgttggccagtgcctgtagaagcccctcacttcytgaatatggtcaaagcctctcaaaggttatggagtagctgtctgaattcccaaggactggattctggctgaatgctgtcaccagttgggtgtggttctatattaggctggatgtcttcagcaaacattcacctctctagttgttttttttttaaaaaaaaaaaaaaaacactactttgttcaaattttgtaagcagatgtaactataatcatttaaaacttcccacaaagcatttttaaaaatcaggtaaagagagacccaataacacacccatctcagcaattctgcagaatgtgcttt

SEQ ID NO: 173466 - DNA, 601 bp, Human; identical to SEQ ID NO: 24766

SEQ ID NO: 173467 - DNA, 601 bp, Human; identical to SEQ ID NO: 24767

SEQ ID NO: 173468 - DNA, 601 bp, Human; identical to SEQ ID NO: 24768

SEQ ID NO: 173469 - DNA, 601 bp, Human; identical to SEQ ID NO: 24769

SEQ ID NO: 173470 - DNA, 601 bp, Human; identical to SEQ ID NO: 24770

SEQ ID NO: 173471 - DNA, 601 bp, Human; identical to SEQ ID NO: 24771

SEQ ID NO: 173472 - DNA, 601 bp, Human; identical to SEQ ID NO: 24772

SEQ ID NO: 173473 - DNA, 601 bp, Human; identical to SEQ ID NO: 24773

SEQ ID NO: 173474 - DNA, 601 bp, Human; identical to SEQ ID NO: 24774

SEQ ID NO: 173475 - DNA, 601 bp, Human; identical to SEQ ID NO: 24775

SEQ ID NO: 173476 - DNA, 601 bp, Human; identical to SEQ ID NO: 24776

SEQ ID NO: 173477 - DNA, 601 bp, Human; identical to SEQ ID NO: 24777

SEQ ID NO: 173478 - DNA, 601 bp, Human; identical to SEQ ID NO: 24778

SEQ ID NO: 173479 - DNA, 601 bp, Human; identical to SEQ ID NO: 24779

SEQ ID NO: 173480 - DNA, 601 bp, Human; identical to SEQ ID NO: 24780

SEQ ID NO: 173481 - DNA, 601 bp, Human; identical to SEQ ID NO: 24781

SEQ ID NO: 173482 - DNA, 601 bp, Human; identical to SEQ ID NO: 24753

SEQ ID NO: 173483 - DNA, 601 bp, Human; identical to SEQ ID NO: 24754

SEQ ID NO: 173484 - DNA, 601 bp, Human; identical to SEQ ID NO: 24755

SEQ ID NO: 173485 - DNA, 601 bp, Human; identical to SEQ ID NO: 24756

SEQ ID NO: 173486 - DNA, 601 bp, Human; identical to SEQ ID NO: 173440

SEQ ID NO: 173487 - DNA, 601 bp, Human; identical to SEQ ID NO: 173441

SEQ ID NO: 173488 - DNA, 601 bp, Human; identical to SEQ ID NO: 173442

SEQ ID NO: 173489 - DNA, 601 bp, Human; identical to SEQ ID NO: 173443

SEQ ID NO: 173490 - DNA, 601 bp, Human; identical to SEQ ID NO: 173444

SEQ ID NO: 173491 - DNA, 601 bp, Human; identical to SEQ ID NO: 173445

SEQ ID NO: 173492 - DNA, 601 bp, Human; identical to SEQ ID NO: 173446

SEQ ID NO: 173493 - DNA, 601 bp, Human; identical to SEQ ID NO: 173447

SEQ ID NO: 173494 - DNA, 601 bp, Human; identical to SEQ ID NO: 24757

SEQ ID NO: 173495 - DNA, 601 bp, Human; identical to SEQ ID NO: 24758

SEQ ID NO: 173496 - DNA, 601 bp, Human; identical to SEQ ID NO: 24759

SEQ ID NO: 173497 - DNA, 601 bp, Human; identical to SEQ ID NO: 24760

SEQ ID NO: 173498 - DNA, 601 bp, Human; identical to SEQ ID NO: 24761

SEQ ID NO: 173499 - DNA, 601 bp, Human; identical to SEQ ID NO: 24762

SEQ ID NO: 173500 - DNA, 601 bp, Human; identical to SEQ ID NO: 24763

SEQ ID NO: 173501 - DNA, 601 bp, Human; identical to SEQ ID NO: 24764

SEQ ID NO: 173502 - DNA, 601 bp, Human; identical to SEQ ID NO: 24765

SEQ ID NO: 173503 - DNA, 601 bp, Human; identical to SEQ ID NO: 173457

SEQ ID NO: 173504 - DNA, 601 bp, Human; identical to SEQ ID NO: 173458

SEQ ID NO: 173505 - DNA, 601 bp, Human; identical to SEQ ID NO: 173459

SEQ ID NO: 173506 - DNA, 601 bp, Human; identical to SEQ ID NO: 173460

SEQ ID NO: 173507 - DNA, 601 bp, Human; identical to SEQ ID NO: 173461

SEQ ID NO: 173508 - DNA, 601 bp, Human; identical to SEQ ID NO: 173462

SEQ ID NO: 173509 - DNA, 601 bp, Human; identical to SEQ ID NO: 173463

SEQ ID NO: 173510 - DNA, 601 bp, Human; identical to SEQ ID NO: 173464

SEQ ID NO: 173511 - DNA, 601 bp, Human; identical to SEQ ID NO: 173465

SEQ ID NO: 173512 - DNA, 601 bp, Human; identical to SEQ ID NO: 24766

SEQ ID NO: 173513 - DNA, 601 bp, Human; identical to SEQ ID NO: 24767

SEQ ID NO: 173514 - DNA, 601 bp, Human; identical to SEQ ID NO: 24768

SEQ ID NO: 173515 - DNA, 601 bp, Human; identical to SEQ ID NO: 24769

SEQ ID NO: 173516 - DNA, 601 bp, Human; identical to SEQ ID NO: 24770

SEQ ID NO: 173517 - DNA, 601 bp, Human; identical to SEQ ID NO: 24771

SEQ ID NO: 173518 - DNA, 601 bp, Human; identical to SEQ ID NO: 24772

SEQ ID NO: 173519 - DNA, 601 bp, Human; identical to SEQ ID NO: 24773

SEQ ID NO: 173520 - DNA, 601 bp, Human; identical to SEQ ID NO: 24774

SEQ ID NO: 173521 - DNA, 601 bp, Human; identical to SEQ ID NO: 24775

SEQ ID NO: 173522 - DNA, 601 bp, Human; identical to SEQ ID NO: 24776

SEQ ID NO: 173523 - DNA, 601 bp, Human; identical to SEQ ID NO: 24777

SEQ ID NO: 173524 - DNA, 601 bp, Human; identical to SEQ ID NO: 24778

SEQ ID NO: 173525 - DNA, 601 bp, Human; identical to SEQ ID NO: 24779

SEQ ID NO: 173526 - DNA, 601 bp, Human; identical to SEQ ID NO: 24780

SEQ ID NO: 173527 - DNA, 601 bp, Human; identical to SEQ ID NO: 24781

SEQ ID NO: 173528 - DNA, 601 bp, Human; identical to SEQ ID NO: 24753

SEQ ID NO: 173529 - DNA, 601 bp, Human; identical to SEQ ID NO: 24754

SEQ ID NO: 173530 - DNA, 601 bp, Human; identical to SEQ ID NO: 24755

SEQ ID NO: 173531 - DNA, 601 bp, Human; identical to SEQ ID NO: 24756

SEQ ID NO: 173532 - DNA, 601 bp, Human; identical to SEQ ID NO: 173440

SEQ ID NO: 173533 - DNA, 601 bp, Human; identical to SEQ ID NO: 173441

SEQ ID NO: 173534 - DNA, 601 bp, Human; identical to SEQ ID NO: 173442

SEQ ID NO: 173535 - DNA, 601 bp, Human; identical to SEQ ID NO: 173443

SEQ ID NO: 173536 - DNA, 601 bp, Human; identical to SEQ ID NO: 173444

SEQ ID NO: 173537 - DNA, 601 bp, Human; identical to SEQ ID NO: 173445

SEQ ID NO: 173538 - DNA, 601 bp, Human; identical to SEQ ID NO: 173446

SEQ ID NO: 173539 - DNA, 601 bp, Human; identical to SEQ ID NO: 173447

SEQ ID NO: 173540 - DNA, 601 bp, Human; identical to SEQ ID NO: 24757

SEQ ID NO: 173541 - DNA, 601 bp, Human; identical to SEQ ID NO: 24758

SEQ ID NO: 173542 - DNA, 601 bp, Human; identical to SEQ ID NO: 24759

SEQ ID NO: 173543 - DNA, 601 bp, Human; identical to SEQ ID NO: 24760

SEQ ID NO: 173544 - DNA, 601 bp, Human; identical to SEQ ID NO: 24761

SEQ ID NO: 173545 - DNA, 601 bp, Human; identical to SEQ ID NO: 24762

SEQ ID NO: 173546 - DNA, 601 bp, Human; identical to SEQ ID NO: 24763

SEQ ID NO: 173547 - DNA, 601 bp, Human; identical to SEQ ID NO: 24764

SEQ ID NO: 173548 - DNA, 601 bp, Human; identical to SEQ ID NO: 24765

SEQ ID NO: 173549 - DNA, 601 bp, Human; identical to SEQ ID NO: 173457

SEQ ID NO: 173550 - DNA, 601 bp, Human; identical to SEQ ID NO: 173458

SEQ ID NO: 173551 - DNA, 601 bp, Human; identical to SEQ ID NO: 173459

SEQ ID NO: 173552 - DNA, 601 bp, Human; identical to SEQ ID NO: 173460

SEQ ID NO: 173553 - DNA, 601 bp, Human; identical to SEQ ID NO: 173461

SEQ ID NO: 173554 - DNA, 601 bp, Human; identical to SEQ ID NO: 173462

SEQ ID NO: 173555 - DNA, 601 bp, Human; identical to SEQ ID NO: 173463

SEQ ID NO: 173556 - DNA, 601 bp, Human; identical to SEQ ID NO: 173464

SEQ ID NO: 173557 - DNA, 601 bp, Human; identical to SEQ ID NO: 173465

SEQ ID NO: 173558 - DNA, 601 bp, Human; identical to SEQ ID NO: 24766

SEQ ID NO: 173559 - DNA, 601 bp, Human; identical to SEQ ID NO: 24767

SEQ ID NO: 173560 - DNA, 601 bp, Human; identical to SEQ ID NO: 24768

SEQ ID NO: 173561 - DNA, 601 bp, Human; identical to SEQ ID NO: 24769

SEQ ID NO: 173562 - DNA, 601 bp, Human; identical to SEQ ID NO: 24770

SEQ ID NO: 173563 - DNA, 601 bp, Human; identical to SEQ ID NO: 24771

SEQ ID NO: 173564 - DNA, 601 bp, Human; identical to SEQ ID NO: 24772

SEQ ID NO: 173565 - DNA, 601 bp, Human; identical to SEQ ID NO: 24773

SEQ ID NO: 173566 - DNA, 601 bp, Human; identical to SEQ ID NO: 24774

SEQ ID NO: 173567 - DNA, 601 bp, Human; identical to SEQ ID NO: 24775

SEQ ID NO: 173568 - DNA, 601 bp, Human; identical to SEQ ID NO: 24776

SEQ ID NO: 173569 - DNA, 601 bp, Human; identical to SEQ ID NO: 24777

SEQ ID NO: 173570 - DNA, 601 bp, Human; identical to SEQ ID NO: 24778

SEQ ID NO: 173571 - DNA, 601 bp, Human; identical to SEQ ID NO: 24779

SEQ ID NO: 173572 - DNA, 601 bp, Human; identical to SEQ ID NO: 24780

SEQ ID NO: 173573 - DNA, 601 bp, Human; identical to SEQ ID NO: 24781

SEQ ID NO: 173574 - DNA, 601 bp, Human
ttgccatgagccgagatcgcgccattgcactccagcctggggaacaagagcgaaactccatctcaaaaaaaaaaaaagatctggcccagcagcaggggggcggggcgtgcagttggggatccttcacctgggcccctcccatcatctgctttgcccatcaggctaacaaaatggcatcctcaaagggctccactaagttcaggtttaaatcccgaacctgcagcctccgcctggtccacaaagggagtccatcccaccctgccagggccttggtgggatggaggaaggcagcccatgtggrccccggaatgctgctccctgctgcatttttaggactagaattgagttcatctgctctgtatgtcagagcagctatgatctgtccgatctgtggtctgtccaaactgtgcactttttagaaataattctgtcccattttacatgcgtgggattgatatgtggttttcacaaaacccactgtgaacccatgatccaatgaaaactgggagaaattcatcaaatagtctttcattcaacacatatgtgtaggggtggccaaggcaacaccaggaagatgggtcaggaggtcatgtggtggcca

SEQ ID NO: 173575 - DNA, 601 bp, Human
gatctggcccagcagcaggggggcggggcgtgcagttggggatccttcacctgggcccctcccatcatctgctttgcccatcaggctaacaaaatggcatcctcaaagggctccactaagttcaggtttaaatcccgaacctgcagcctccgcctggtccacaaagggagtccatcccaccctgccagggccttggtgggatggaggaaggcagcccatgtgggccccggaatgctgctccctgctgcatttttaggactagaattgagttcatctgctctgtatgtcagagcagctatgrtctgtccgatctgtggtctgtccaaactgtgcactttttagaaataattctgtcccattttacatgcgtgggattgatatgtggttttcacaaaacccactgtgaacccatgatccaatgaaaactgggagaaattcatcaaatagtctttcattcaacacatatgtgtaggggtggccaaggcaacaccaggaagatgggtcaggaggtcatgtggtggccacacagctgagccttgacagtggctcagacatggctagatgctgcacactttggagaggatttgttgccaatgggtag

SEQ ID NO: 173576 - DNA, 601 bp, Human
caaagtgtgatggcccagggcagagcagtggcctcacctgggagtcccccacctggaagaggccgggcccacccactgcaagtcttctctgagccacgttctcaagtcttctctgagccgcgttctccaggttgtgctgctggagtcagttggcatttcctccaagcctgaaagtgtagtcagattcagaatgggcttttctagattcccctgtaagatctttcccctgctcctggcaggagcaccacaccatgggaaccccagggcccacgcagctgcccgggactgggggaccaggacrtggcacttctcacatgggtggaaagatgggtttacagaatggtggcatggagacgctgtggcctggcaaggatcaatggggtggcatctggcattagccatcaggaagacttaaggctgaagggacattgggcagggagctctcagggctgctccacccgcccccagggtgacagcccatagtatcacttagggtgggactgagagtcacctgggggagaggagagaaggggcccaacttccccagcccctagtatcacttagggtgggactgagagtcacctgggggagaggagagaag

SEQ ID NO: 173577 - DNA, 601 bp, Human
tctctgagccgcgttctccaggttgtgctgctggagtcagttggcatttcctccaagcctgaaagtgtagtcagattcagaatgggcttttctagattcccctgtaagatctttcccctgctcctggcaggagcaccacaccatgggaaccccagggcccacgcagctgcccgggactgggggaccaggacatggcacttctcacatgggtggaaagatgggtttacagaatggtggcatggagacgctgtggcctggcaaggatcaatggggtggcatctggcattagccatcaggaagwcttaaggctgaagggacattgggcagggagctctcagggctgctccacccgcccccagggtgacagcccatagtatcacttagggtgggactgagagtcacctgggggagaggagagaaggggcccaacttccccagcccctagtatcacttagggtgggactgagagtcacctgggggagaggagagaagggacccaacttccccagcccctggcaccttccctgcctttcccagtcttttaccagagtcataagatggtccttggctctgggcaggcatgtggccctggggagctctg

SEQ ID NO: 173578 - DNA, 601 bp, Human
aactgcaagattctaaatctaagcagaaggctatattttaccctgtgcttttctatagctgtcctcaaagcgtaaaccattccaaattattttcaactagtgttatatgtgttcagcagagctatttctgcctgggcattgccagtccctgagcaggagggtctcacagtgaggtctgcaggactgtaagtttggggtctgactccctggccaccctgtgtgggctgtgactgtctctcagagctatacccgccctttctctgctggcagcccgacagagctggctcaaccatcggaggtygcaggccaccagcccgtggcccacctggcagccttccaggtgaaggtgagacaaacaaggcatgacctgggggccgcccggctccccatcacaaacgccacaaacaccacaaacacaacccaccctgatcagagactaagcagagaaagcagggagaggacctagagttactcagtaatgactcaggaaggagaccctaagcttctaccacatgccagactctgtgcccagtgcagcataaacgtcctcagaaccagcctggtcccagcctggccgagccggacgttcctgggaaaggtt

SEQ ID NO: 173579 - DNA, 601 bp, Human
ccacatgcacacattcacacagcatacacactacacacatgcacaccacacatacaccacacacactacacacatgcaccatacacaccacacacacaccacacattacacacatacacaaccacacacaccacacacacaatacacacacaccacactcactacacacacaccccacacacagagcactccacggtcagccttctaccccggaaaactgcttgtgcaacaggctggatctaccagacgctcctcactgtgctcgccttccagctctggggcagactccggtggtgggackgagggtcagagtccccaatcctagacccccacatccacttgtcctcatggggctggtgctcatttccctgggaagcctgggagagtggacccagttctcctgtcctggggctcttttaagtgcacccacacttggcaacactggggctgggcccagtgcagggttcataaaatacagcccttgcactgccaggggcctggcacattctgccattcttgctatgtaatgacccagcagcccccatcctggatgctgaaatcctacccttgtcgtcatgccacagctgagacagtcagtgtt

SEQ ID NO: 173580 - DNA, 601 bp, Human
acagcactgtgatttctggaagagacagcactgtgattcctggtcctaatatcttggctttgtttgggttttttttccagatgaccattctagggtgattctgagccaactggatggaattccctgttcagactacatcaatgcttcctacatagatgtaagtgggcagaggtttcttgttcccctggcccagctggggcatgagcagtaagcactttcttgtctggtgcccggagtgtaaattgtcacaacctttctgggcagtttggccacaagcacaaagggtacggaactgcccgtrctttacacactggcatcagcatctgggaatttgatttcaagagacagagatgatcacagaggatgttcactacagcattatgtatattcctgaccaaatagaacagggagcatgggtagttaaacagattgtggtaaaaccatgtgcagtggactattagaacttgatttgtattaatctttaaaagatcatttaatatcaattataaaattcccattaaaaatacaacataaaataaattgtacatgttcacccaattagaggacagaaatgtctgcatgtctgcttgtgggtgagtct

SEQ ID NO: 173581 - DNA, 601 bp, Human
agagatgatcacagaggatgttcactacagcattatgtatattcctgaccaaatagaacagggagcatgggtagttaaacagattgtggtaaaaccatgtgcagtggactattagaacttgatttgtattaatctttaaaagatcatttaatatcaattataaaattcccattaaaaatacaacataaaataaattgtacatgttcacccaattagaggacagaaatgtctgcatgtctgcttgtgggtgagtctgggaaaggtttggcagaaaaacagactagagaggggacgtatgaartaggatttgttatttctggaattgctggtgagttttctttccttcttaaccttttcctgtgttttgcaaattttccatggtgaatatgtactgctttcctaacagcaacaccaacaaatcctttcagcaaagataattctgaaaaaatataaatctgatgttattttttctagggttacaaagagaagaataaattcatagcagctcaaggtaagctttttactaatttctcaacgtatttttggtaacgtgaatagctcttatttccttctctgtatgccaacaagaccaaggacttat

SEQ ID NO: 173582 - DNA, 601 bp, Human
aaatgtctgcatgtctgcttgtgggtgagtctgggaaaggtttggcagaaaaacagactagagaggggacgtatgaagtaggatttgttatttctggaattgctggtgagttttctttccttcttaaccttttcctgtgttttgcaaattttccatggtgaatatgtactgctttcctaacagcaacaccaacaaatcctttcagcaaagataattctgaaaaaatataaatctgatgttattttttctagggttacaaagagaagaataaattcatagcagctcaaggtaagctttttaytaatttctcaacgtatttttggtaacgtgaatagctcttatttccttctctgtatgccaacaagaccaaggacttatactggatttgtgtgtgtgtgtttacacctaacagacacgttagatatccattcacacaacggatatgtgtagtcagagaaacacacacttattcccacacctatatggtgtgaacacagggcacgcagtggccccggctgccattccagcttgttaatacttgcatcagataaccttgaatttctctcagctggctgagccctacatggcacccaagtttggg

SEQ ID NO: 173583 - DNA, 601 bp, Human
caaagataattctgaaaaaatataaatctgatgttattttttctagggttacaaagagaagaataaattcatagcagctcaaggtaagctttttactaatttctcaacgtatttttggtaacgtgaatagctcttatttccttctctgtatgccaacaagaccaaggacttatactggatttgtgtgtgtgtgtttacacctaacagacacgttagatatccattcacacaacggatatgtgtagtcagagaaacacacacttattcccacacctatatggtgtgaacacagggcacgcartggccccggctgccattccagcttgttaatacttgcatcagataaccttgaatttctctcagctggctgagccctacatggcacccaagtttgggcgaggggttagtggggtgaatagcttttcagatcaaggccataactaagaatatacttcagctgtgaaaacgtgcccttcaccttgcacagggctaccttgtgtgttgagtactgaatccagcatcactccgttccaccagaggttgtcatctgcaggacctggtgtacgtgcggttagatatcagtggagctgaaaccagattc

SEQ ID NO: 173584 - DNA, 601 bp, Human
tttttctagggttacaaagagaagaataaattcatagcagctcaaggtaagctttttactaatttctcaacgtatttttggtaacgtgaatagctcttatttccttctctgtatgccaacaagaccaaggacttatactggatttgtgtgtgtgtgtttacacctaacagacacgttagatatccattcacacaacggatatgtgtagtcagagaaacacacacttattcccacacctatatggtgtgaacacagggcacgcagtggccccggctgccattccagcttgttaatacttgcrtcagataaccttgaatttctctcagctggctgagccctacatggcacccaagtttgggcgaggggttagtggggtgaatagcttttcagatcaaggccataactaagaatatacttcagctgtgaaaacgtgcccttcaccttgcacagggctaccttgtgtgttgagtactgaatccagcatcactccgttccaccagaggttgtcatctgcaggacctggtgtacgtgcggttagatatcagtggagctgaaaccagattcctcagacttcctcactcttaggccaggagtctttagg

SEQ ID NO: 173585 - DNA, 601 bp, Human
gtaagctttttactaatttctcaacgtatttttggtaacgtgaatagctcttatttccttctctgtatgccaacaagaccaaggacttatactggatttgtgtgtgtgtgtttacacctaacagacacgttagatatccattcacacaacggatatgtgtagtcagagaaacacacacttattcccacacctatatggtgtgaacacagggcacgcagtggccccggctgccattccagcttgttaatacttgcatcagataaccttgaatttctctcagctggctgagccctacatggcmcccaagtttgggcgaggggttagtggggtgaatagcttttcagatcaaggccataactaagaatatacttcagctgtgaaaacgtgcccttcaccttgcacagggctaccttgtgtgttgagtactgaatccagcatcactccgttccaccagaggttgtcatctgcaggacctggtgtacgtgcggttagatatcagtggagctgaaaccagattcctcagacttcctcactcttaggccaggagtctttagggcaatgagctctgaaagtcagcgtccatcaaaatcacctgggaagt

SEQ ID NO: 173586 - DNA, 601 bp, Human
ctcttaggccaggagtctttagggcaatgagctctgaaagtcagcgtccatcaaaatcacctgggaagttgttacaaatgcagaatctctaagaaaaaaggacacacatgtgcacacgcagaggccatcaggaatgtgcccagctggaaacctcaggaaacctgacgatcctggctgaagcagatgaaagcatgtgtttctctcttgccagcagacacccacagggagctagcccacggcaggacagcagcagggccaggggcttccttatctccccgcccatccccctcagcacgtagcrcttagctcgggactgcaaaatagccgcagctcagacaggaagtggataggggcagaggactttctcctagtgacactttgtctgttgttcacatccccctcccgagggactttagctcatatcgtattggacagcaccatgctgagagtaagattttgacaaagaggaggggattgggaatgcagggtgaggctggccagtctctgcctctcgcaaggctttcaccagctctcccacacttggctgtagacccagccctcatctgaaccctgcttcttacctgtgaacgtcataactcaa

SEQ ID NO: 173587 - DNA, 601 bp, Human
gggagtgaacagctgtccaggggccaacggccagggtgccggggctgggaccccaaagggacttcccttcatgccttttgacttcgaaattgtcctctacacacaggtcccaaacaggaaacggttaacgacttctggagaatggtctgggagcaaaagtctgcgaccatcgtcatgttaacaaacttgaaagaaaggaaagaggtgagttccaggcatctggccccggtatcacttcctttcagctgctgctgccgggctggggatgttcttaccacttccttttcctacttccctcccytcctcccactatcactgcagaaaaaaacccaaacacatgcagtggcttacagcattttcttcacgaaacaaatcccctgtgtccccagcatctcactgttatctaatctgtgataacacaatgacacaagagtttcctttttttcccaagtaagagtggcccccggctggccccatggctctgcctgcctgatgagagacatgaatcttagagttttaggatgttgagcgtgtcatgcggcagagctcagactagaaatgaacatgatttcgcgcttattatccagactagagaaatgct

SEQ ID NO: 173588 - DNA, 601 bp, Human
gtactcattagcatctgctgtgctgggccagctctgtcccaggtgcaaggagtaggggctcaaattcagggctgagaagtggtggctgtggggagcctgggtgcgggggtggggttgagtgacaggcagggagccatgccataggcagtgagctcactctccagaatgaaagaagaactgggagcctgagggacacttaccacaggtggggcgaagttaggaggctgtgcttctggcgtgttctggcatgaaggcccggttcagtgggagccgtgtgtcctgcccggccctgctcagggcmtgctgtgtcctgagctcctcagtcatctgctggcctggccccagcagttcccaggcattgtagcgaggactgtggggaagggctgccatttttagatgggagtaccaggccttggggagctcagctggggcagaagatgggtggcaggagcccacaggaagggcaggctgggaggtgctctggtccccgcagtgccagcttactaattgccacccaaaacacaggaagcagcctccagccaccgtttctggtcaggaataggatggaggctttcattctgctctggggggagctgaaaca

SEQ ID NO: 173589 - DNA, 601 bp, Human
aagttaggaggctgtgcttctggcgtgttctggcatgaaggcccggttcagtgggagccgtgtgtcctgcccggccctgctcagggcctgctgtgtcctgagctcctcagtcatctgctggcctggccccagcagttcccaggcattgtagcgaggactgtggggaagggctgccatttttagatgggagtaccaggccttggggagctcagctggggcagaagatgggtggcaggagcccacaggaagggcaggctgggaggtgctctggtccccgcagtgccagcttactaattgccayccaaaacacaggaagcagcctccagccaccgtttctggtcaggaataggatggaggctttcattctgctctggggggagctgaaacaggactgtggagggccacccctttgcccttgcaaatcttgcccttgtcatgctttgtcatggggaagagggaagagtgacagagggaagtaggggattcccagcccaggactcttcactctgcctgcgctgtagcggccatggaggaggacacccacgcgagggaaaaggaggctgacccttcatcaggagcctcagggtcccccgtgacccat

SEQ ID NO: 173590 - DNA, 601 bp, Human
agatgggagtaccaggccttggggagctcagctggggcagaagatgggtggcaggagcccacaggaagggcaggctgggaggtgctctggtccccgcagtgccagcttactaattgccacccaaaacacaggaagcagcctccagccaccgtttctggtcaggaataggatggaggctttcattctgctctggggggagctgaaacaggactgtggagggccacccctttgcccttgcaaatcttgcccttgtcatgctttgtcatggggaagagggaagagtgacagagggaagtagggkattcccagcccaggactcttcactctgcctgcgctgtagcggccatggaggaggacacccacgcgagggaaaaggaggctgacccttcatcaggagcctcagggtcccccgtgacccatggcccatagggaccagtcttcctggggttggtgctccaagcatgagaccagcacagaagcagtggggctcaaggacgccctcacttccctctttcagtcattctgctgaaagtgtcactggcattttctctccatcttcccccacaacctcctactggatttttccactcctgtgactcag

SEQ ID NO: 173591 - DNA, 601 bp, Human
aattgccacccaaaacacaggaagcagcctccagccaccgtttctggtcaggaataggatggaggctttcattctgctctggggggagctgaaacaggactgtggagggccacccctttgcccttgcaaatcttgcccttgtcatgctttgtcatggggaagagggaagagtgacagagggaagtaggggattcccagcccaggactcttcactctgcctgcgctgtagcggccatggaggaggacacccacgcgagggaaaaggaggctgacccttcatcaggagcctcagggtcccccrtgacccatggcccatagggaccagtcttcctggggttggtgctccaagcatgagaccagcacagaagcagtggggctcaaggacgccctcacttccctctttcagtcattctgctgaaagtgtcactggcattttctctccatcttcccccacaacctcctactggatttttccactcctgtgactcagtgctgggctgctgccgcgtcctcattctcaccaattcagatgaaatcatttctcaatagagttccctttttcttaattgctcacacttctgttgtggtttccttggcttcc

SEQ ID NO: 173592 - DNA, 601 bp, Human
tcctgggctctgcattgcaaaacacagctgccctggcatctcatgatcgggtgggagggaggcagagggagggggtataaaaccagccaccaacactgagcccttgagaggctgacacatgttctcagttcctactggagagccttcaaggtgagaagctcaggagggaccccagggctccccatagggccaagactcacccaaaccgggacatgtaggcatttgcaattcccctgggctgcatcagagatggcctgtgacccgcagccccgcagccccgcccggagccaggtgtaaggagggggaagttgtcggtagccgtcataacacaatgatgctgctctctactaaataccagatgctgtttgtttcataagactgttaatcctggaggcttgaccacgagctgtgctgctcaggggccattccctggatatactctctgactactggcaggcttgttccattccagacatgtttctctggcagatgaagtagatcttttcccccttgaggtgggtcctcattcactcgcgaagtgatggaggacaccaccgggcaggtgctgcgggcggtgctgcaaaatgaaagggctcctgga

SEQ ID NO: 173593 - DNA, 601 bp, Human
tctcagctgtgggagctgtgtgactccagctggtgtgtgtgaggccttctgtagttgggtggggggatgtcatgatgcattgcacccacagatctatttgcttctattaaattgttccgtgcaggaaaagtgccatcagtactggcccgaccaaggctgctggacctatggaaacatccgggtgtgcgtggaggactgcgtggttttggtcgactacaccatccggaagttctgcatacagccagtaagcatctctagttgctgcccttccagaaagatcattttcagagagcatcatgcycagagttaacatccttctgcatttatgaagtgctttgctcccagcccggcactgtcgcagccctggctgagagggtgcagtggccaggctgtgataggcagacatgcaagagggccaagacaccagaggccggtgcacaagggtctgcaggcagtgctgggggctcctaattcctagtgactcctctgggcctctccaggaggaagaccagtcattggaggggcctgggggtgaggtcctccctcagtagcacagtgacatttcacacactgactgggaggtggggtttttttctaacac

SEQ ID NO: 173594 - DNA, 601 bp, Human
ccaccaccccaaaaggtttaagagagagatcagtaaaaatatgtgtatgcaaagcagatgaaatcaagatatagaagaaagtttaaaaccatagagaaaagacagaagaccattttgtcaggatttaaagatagagtcattggcataattaggtcacaaaataagtgtctgaggttccaagaagccacagcaaaaaaggaaaaggatgagctgattattcttatcctatcccctgctggcatctctcccagaaatgtgcacacaggcgcacacaggcactcacatgcacacgcacacacayactcccacacacaggcacacacatgcacacatgcacatacacccacacacaggcatacacatgcacacacacccacacacaggcacacacacgtacacctacccacacacaggcacgcacatgcacatactcccacacacatgcatgcacatgcacacgtacacccacacacaggcacacacatgcacacacacgcacacaaccgtacaatgcatgcacgttcacacacacatgtgcacacacacaccccactcacatgcacacatgcacacattcacacatgtgcacacacatacaccc

SEQ ID NO: 173595 - DNA, 601 bp, Human
ctcccacacacaggcacacacatgcacacatgcacatacacccacacacaggcatacacatgcacacacacccacacacaggcacacacacgtacacctacccacacacaggcacgcacatgcacatactcccacacacatgcatgcacatgcacacgtacacccacacacaggcacacacatgcacacacacgcacacaaccgtacaatgcatgcacgttcacacacacatgtgcacacacacaccccactcacatgcacacatgcacacattcacacatgtgcacacacatacacccayacacattcacatgcacacacatgcacacatgcacacacattcatgcacatgcatacatgtgcacacacacgcacccacacacgcacagatgcacacatgcacattcacacatgtgcacacacacgcacccacacacgcacagatgcacacatgcacattcacacatgtgcacacacatacatccacacacattcacacacgcacacgtgcacacatgcacacattcacacatgtgcacacatacacacatacacgcacatgggtgcacacgtgtacgcacccacattcacacatgcacac

SEQ ID NO: 173596 - DNA, 601 bp, Human
tgcacatacacccacacacaggcatacacatgcacacacacccacacacaggcacacacacgtacacctacccacacacaggcacgcacatgcacatactcccacacacatgcatgcacatgcacacgtacacccacacacaggcacacacatgcacacacacgcacacaaccgtacaatgcatgcacgttcacacacacatgtgcacacacacaccccactcacatgcacacatgcacacattcacacatgtgcacacacatacacccatacacattcacatgcacacacatgcacacaygcacacacattcatgcacatgcatacatgtgcacacacacgcacccacacacgcacagatgcacacatgcacattcacacatgtgcacacacacgcacccacacacgcacagatgcacacatgcacattcacacatgtgcacacacatacatccacacacattcacacacgcacacgtgcacacatgcacacattcacacatgtgcacacatacacacatacacgcacatgggtgcacacgtgtacgcacccacattcacacatgcacacacatgcatacatgtgcacacattcacacgt

SEQ ID NO: 173597 - DNA, 601 bp, Human
acatgtgcacacacatacacccatacacattcacatgcacacacatgcacacatgcacacacattcatgcacatgcatacatgtgcacacacacgcacccacacacgcacagatgcacacatgcacattcacacatgtgcacacacacgcacccacacacgcacagatgcacacatgcacattcacacatgtgcacacacatacatccacacacattcacacacgcacacgtgcacacatgcacacattcacacatgtgcacacatacacacatacacgcacatgggtgcacacgtgtacrcacccacattcacacatgcacacacatgcatacatgtgcacacattcacacgtgcgcacatacacacattcacccacacatacatgcgcacacatgcacacatacacatgcatacatgtgcacacacatgcacacacatctacttccaaatacgctgtgtatcaccttccgtgatctgggcaagggaattaaactcatgggctctgggtccaaaagctgagagaggctctgagggcaggtctgggagactccaaagagcaggccgactgcatcatctgtcctcccaaatgtaagacagct

SEQ ID NO: 173598 - DNA, 601 bp, Human
ggagaacatgaggacgggcaacttgccggcaaacatgaagaaggccagggtcatccagatcatcccgtgtaaggcacccgtggcgtggcttgggcagggctggggcggggctggtgccggaggctttcatcctggagaagccattgaccgcttacccctgtgcaccagggtcaaaagcagggtgtcctctggcctcaggctaagggctcctgtgtgctgtaccaaatgtcaggtagaaaagacacctgtgaagcaccagctgacccagacagtcctgcatgggtctcaggcaagctgcttsggatatgagcttgcagatgcgggagggcagccgaggctgatttcaggggagggcttcacagaagctggagatttgcggcaggcacgacttgggattccttgtctcattccttgtctccccaagcctgggcagaggcccgcctcccccttacacagaggggcctgagccacccagccgaggccatgcaggtgaactcagctgagaccacctaggaaaaggctgtggccttgaggaggacaagaaatgggcctagggtagagtcaggacactggtctgccacccaggtcatgggagagggaa

SEQ ID NO: 173599 - DNA, 601 bp, Human
ggcaggcacgacttgggattccttgtctcattccttgtctccccaagcctgggcagaggcccgcctcccccttacacagaggggcctgagccacccagccgaggccatgcaggtgaactcagctgagaccacctaggaaaaggctgtggccttgaggaggacaagaaatgggcctagggtagagtcaggacactggtctgccacccaggtcatgggagagggaaggaggacctggcaggtgtgggaggagtggaggcaaagctggcaagaagacagggccacatgcagtgggcaggggagygggaatcgggaggctcaccaagtgggaaaaagagaaacttgagaaacccggccccaaagcagactccacagggatccgaggaactagggagggaggtgggagatgccccgcttgggaggagggtgtgcctcgttatagacttgtcctcgacagagtcacagctcaacaaacaccatctggaaacagctgggagcaggcctgctgcagcagggtctccccgagcactgcaggcgagtagagctccccggggtgctgccatcttcagactctggcccttggttttctggggccccggtgtcc

SEQ ID NO: 173600 - DNA, 601 bp, Human
ccgagcactgcaggcgagtagagctccccggggtgctgccatcttcagactctggcccttggttttctggggccccggtgtcctgctggccactctagattgcttgcctggccacattccatttactccttcagcgcaatatttttagtgcttgtattttggtatgtattatatcgattcctgaaaaatgaaaatgataattgggtggttttcagagttttccttcaaaaagaaaaatacccctgagccactttaattatcgtctctcataacgtaaactttccaaagagttggctttacstagtgattttattaataggatctatattttgcaagcttgtagcaatggattaaagttagcaaggtgggaccctttttgtaataactaaaggaagataatgctttgcagatgacttcaaccgagtgatcctttccatgaaaaggggtcaagaatacacagactacatcaacgcatccttcatagacgtacgtatgctggcctgggttgtgtttatgcagatgtgtttccttcacatgtgaccacagacttgattagcttgttttcacaatgagaaagaattgacatgtttccagaaactca

SEQ ID NO: 173601 - DNA, 601 bp, Human
gataatgctttgcagatgacttcaaccgagtgatcctttccatgaaaaggggtcaagaatacacagactacatcaacgcatccttcatagacgtacgtatgctggcctgggttgtgtttatgcagatgtgtttccttcacatgtgaccacagacttgattagcttgttttcacaatgagaaagaattgacatgtttccagaaactcagccatttttgttagcagaattacttgcttaaaaaaaaaagtggcaaggcacgatggctcacacctgtaatcccaacactttgggaagctaaggygggcagatcacttggggtcaggagtttgaaactagcctggccaatatggcaaaacccgtctctactaaaaatacaaaaattagctgggcgtgatggcaggtgcctgtaatcccagctacttgggaagctgaggcaggagaattgcttgaatccgggaggctgaggttgcagtgagctgagattacaccactgtactccaacctgggcaacagagtgagagcgagaccccctctcaaaaaaaaaaaaaaaaaaaaaaaagtggactttggaaatagaaggacatagactcgctgctaagta

SEQ ID NO: 173602 - DNA, 601 bp, Human
tagcagaattacttgcttaaaaaaaaaagtggcaaggcacgatggctcacacctgtaatcccaacactttgggaagctaaggcgggcagatcacttggggtcaggagtttgaaactagcctggccaatatggcaaaacccgtctctactaaaaatacaaaaattagctgggcgtgatggcaggtgcctgtaatcccagctacttgggaagctgaggcaggagaattgcttgaatccgggaggctgaggttgcagtgagctgagattacaccactgtactccaacctgggcaacagagtgaragcgagaccccctctcaaaaaaaaaaaaaaaaaaaaaaaagtggactttggaaatagaaggacatagactcgctgctaagtaattggctcttttttcattctgcttttaatatatagttatttttcttttacatatctgttacacaccaattatatatccactgcctctgtgctctttctcttgtgtgatttctgcaatgtgtacccacgtggacaatacaattatgtgttcagggcacacagaggctgtcttcatgcacagtggagttcgcagaagaagggcaaaagggggaatggcag

SEQ ID NO: 173603 - DNA, 601 bp, Human
tggctcacacctgtaatcccaacactttgggaagctaaggcgggcagatcacttggggtcaggagtttgaaactagcctggccaatatggcaaaacccgtctctactaaaaatacaaaaattagctgggcgtgatggcaggtgcctgtaatcccagctacttgggaagctgaggcaggagaattgcttgaatccgggaggctgaggttgcagtgagctgagattacaccactgtactccaacctgggcaacagagtgagagcgagaccccctctcaaaaaaaaaaaaaaaaaaaaaaaagkggactttggaaatagaaggacatagactcgctgctaagtaattggctcttttttcattctgcttttaatatatagttatttttcttttacatatctgttacacaccaattatatatccactgcctctgtgctctttctcttgtgtgatttctgcaatgtgtacccacgtggacaatacaattatgtgttcagggcacacagaggctgtcttcatgcacagtggagttcgcagaagaagggcaaaagggggaatggcagccaagtgtgtgttcatattgccatttgcagatgagaaaattg

SEQ ID NO: 173604 - DNA, 601 bp, Human
gaagctaaggcgggcagatcacttggggtcaggagtttgaaactagcctggccaatatggcaaaacccgtctctactaaaaatacaaaaattagctgggcgtgatggcaggtgcctgtaatcccagctacttgggaagctgaggcaggagaattgcttgaatccgggaggctgaggttgcagtgagctgagattacaccactgtactccaacctgggcaacagagtgagagcgagaccccctctcaaaaaaaaaaaaaaaaaaaaaaaagtggactttggaaatagaaggacatagactcsctgctaagtaattggctcttttttcattctgcttttaatatatagttatttttcttttacatatctgttacacaccaattatatatccactgcctctgtgctctttctcttgtgtgatttctgcaatgtgtacccacgtggacaatacaattatgtgttcagggcacacagaggctgtcttcatgcacagtggagttcgcagaagaagggcaaaagggggaatggcagccaagtgtgtgttcatattgccatttgcagatgagaaaattgtaccagaatccggtgggctccatgctgatc

SEQ ID NO: 173605 - DNA, 601 bp, Human
gtgctctttctcttgtgtgatttctgcaatgtgtacccacgtggacaatacaattatgtgttcagggcacacagaggctgtcttcatgcacagtggagttcgcagaagaagggcaaaagggggaatggcagccaagtgtgtgttcatattgccatttgcagatgagaaaattgtaccagaatccggtgggctccatgctgatctagctgaaacacacagaaacatgttagaatctaagccaccaggtgctgttcaggtggccacaggcaactaccagttcataatacccatttgttgatgwcctcaggggctgacggtggccgttatggtttcagataagcgagcttcttgacctgcttgtcaggtgtgtgcctgagtgctcgtgccaactggggtctggtgcagaccatggaggatgagagagttttcctcattaggccttaggctgtcctaaacttagggagcaggtaatggagccaggatggaaggaagtcagactctaacctctgcgcctccatttgaagggctaccgacagaaggactatttcatcgccacccaggggccactggcacacacggttgaggacttctggaggatgat

SEQ ID NO: 173606 - DNA, 601 bp, Human
tcatattgccatttgcagatgagaaaattgtaccagaatccggtgggctccatgctgatctagctgaaacacacagaaacatgttagaatctaagccaccaggtgctgttcaggtggccacaggcaactaccagttcataatacccatttgttgatgacctcaggggctgacggtggccgttatggtttcagataagcgagcttcttgacctgcttgtcaggtgtgtgcctgagtgctcgtgccaactggggtctggtgcagaccatggaggatgagagagttttcctcattaggccttargctgtcctaaacttagggagcaggtaatggagccaggatggaaggaagtcagactctaacctctgcgcctccatttgaagggctaccgacagaaggactatttcatcgccacccaggggccactggcacacacggttgaggacttctggaggatgatctgggaatggaaatcccacactatcgtgatgctgacggaggtgcaggagagagagcaggtgaggagtgccgcccagcccggtccctccagggcagcctgtgcacctgaggcactgtccccgttcattacaaatgtcccacctg

SEQ ID NO: 173607 - DNA, 601 bp, Human
acggtggccgttatggtttcagataagcgagcttcttgacctgcttgtcaggtgtgtgcctgagtgctcgtgccaactggggtctggtgcagaccatggaggatgagagagttttcctcattaggccttaggctgtcctaaacttagggagcaggtaatggagccaggatggaaggaagtcagactctaacctctgcgcctccatttgaagggctaccgacagaaggactatttcatcgccacccaggggccactggcacacacggttgaggacttctggaggatgatctgggaatggaartcccacactatcgtgatgctgacggaggtgcaggagagagagcaggtgaggagtgccgcccagcccggtccctccagggcagcctgtgcacctgaggcactgtccccgttcattacaaatgtcccacctgccatcactgcaaacacatgggtgagaccaagccaggaccactagggaaggagagagattggaaatgaaaaaggtttcatttcaccctttccctttttgggagtgaggtttaaccatagctacccgctgccctttatccttagcctacatgttatttaacctgccctgaaa

SEQ ID NO: 173608 - DNA, 601 bp, Human
gcctgagtgctcgtgccaactggggtctggtgcagaccatggaggatgagagagttttcctcattaggccttaggctgtcctaaacttagggagcaggtaatggagccaggatggaaggaagtcagactctaacctctgcgcctccatttgaagggctaccgacagaaggactatttcatcgccacccaggggccactggcacacacggttgaggacttctggaggatgatctgggaatggaaatcccacactatcgtgatgctgacggaggtgcaggagagagagcaggtgaggagtgcygcccagcccggtccctccagggcagcctgtgcacctgaggcactgtccccgttcattacaaatgtcccacctgccatcactgcaaacacatgggtgagaccaagccaggaccactagggaaggagagagattggaaatgaaaaaggtttcatttcaccctttccctttttgggagtgaggtttaaccatagctacccgctgccctttatccttagcctacatgttatttaacctgccctgaaattctgccatttggtattggccaagatcataacctgttgaagaaaaagacatttattg

SEQ ID NO: 173609 - DNA, 601 bp, Human
agagagttttcctcattaggccttaggctgtcctaaacttagggagcaggtaatggagccaggatggaaggaagtcagactctaacctctgcgcctccatttgaagggctaccgacagaaggactatttcatcgccacccaggggccactggcacacacggttgaggacttctggaggatgatctgggaatggaaatcccacactatcgtgatgctgacggaggtgcaggagagagagcaggtgaggagtgccgcccagcccggtccctccagggcagcctgtgcacctgaggcactgtcyccgttcattacaaatgtcccacctgccatcactgcaaacacatgggtgagaccaagccaggaccactagggaaggagagagattggaaatgaaaaaggtttcatttcaccctttccctttttgggagtgaggtttaaccatagctacccgctgccctttatccttagcctacatgttatttaacctgccctgaaattctgccatttggtattggccaagatcataacctgttgaagaaaaagacatttattgacttttttcaagacatgaagacaacagtaaacccaaggtttaccaaca

SEQ ID NO: 173610 - DNA, 601 bp, Human
gtatattcacagagttgtgcaaccaccaccactatctaatctgtgatcattttcatcaacccaaaaggaaacctcgtaccattaacagtcactccccattccttccttcccctaacccctggcaaccactaatctgcttcctgactatgggtttgtctattctggacattattataaatggaatcatacagtatgtggtcttccgtgattgggttctttcacttagcatcatgctttcaaggttcatctatgttgtagcatgaatcagtaaatcattcttttttactggcaaatagtattygcttgtgtggatatactacactctgcatatccattcatcagttgatggacatttaggttgtttccactttggagctattataaatagtgctgctttgcttggtgcggttgctcacacctgtaatcccagccctttgggagtccaaggcgggcagatcacctgaggtcaggagttcgcggccagcctggccaacatggcaaaaccccgcttctactaaaaatacaaaaattagctgggcatggtggcgggaacctgcaatcccagctacttgggaggctgaggcagggagaatcgcttgaa

SEQ ID NO: 173611 - DNA, 601 bp, Human
gtcactccccattccttccttcccctaacccctggcaaccactaatctgcttcctgactatgggtttgtctattctggacattattataaatggaatcatacagtatgtggtcttccgtgattgggttctttcacttagcatcatgctttcaaggttcatctatgttgtagcatgaatcagtaaatcattcttttttactggcaaatagtatttgcttgtgtggatatactacactctgcatatccattcatcagttgatggacatttaggttgtttccactttggagctattataaatartgctgctttgcttggtgcggttgctcacacctgtaatcccagccctttgggagtccaaggcgggcagatcacctgaggtcaggagttcgcggccagcctggccaacatggcaaaaccccgcttctactaaaaatacaaaaattagctgggcatggtggcgggaacctgcaatcccagctacttgggaggctgaggcagggagaatcgcttgaacctgggaggcagaggttgcattgagctgagatcgcgccattgcactccagcctgggggacagaacaagactctgtctcaaaaaaaaa

SEQ ID NO: 173612 - DNA, 601 bp, Human
ggtggcgggaacctgcaatcccagctacttgggaggctgaggcagggagaatcgcttgaacctgggaggcagaggttgcattgagctgagatcgcgccattgcactccagcctgggggacagaacaagactctgtctcaaaaaaaaaaaaaaagtttcttgaacattcaggtagtagtttttgtatggacatgctttttcacttcccttgggtatacgcctaggagtgtatatactaggagcggaattgctaggtcacgtcataactctatgtcataaacttactgtttaacatttttgasgacctgccagactgttttcctcagtagctgccccattttacattcctaccagcaatatataaggttctaatttctccacatcctcaccaacattgtcattgtctttttgattaaagccatcctagtggatatgttctttgcttttttaaaacatcttttaaaatcacatctgtttatgcctacgtagactgttgtttagttttacttgtgtttgaactttatagaaagagcatcattacagcatgttgtcttctgagacttgcttcttccactcaaaattgtgcttttgatattctatgt

SEQ ID NO: 173613 - DNA, 601 bp, Human
atggacatgctttttcacttcccttgggtatacgcctaggagtgtatatactaggagcggaattgctaggtcacgtcataactctatgtcataaacttactgtttaacatttttgaggacctgccagactgttttcctcagtagctgccccattttacattcctaccagcaatatataaggttctaatttctccacatcctcaccaacattgtcattgtctttttgattaaagccatcctagtggatatgttctttgcttttttaaaacatcttttaaaatcacatctgtttatgcctacrtagactgttgtttagttttacttgtgtttgaactttatagaaagagcatcattacagcatgttgtcttctgagacttgcttcttccactcaaaattgtgcttttgatattctatgttgatgcttatgctgtggttcattcgtcatcattatttcattatattccactgcacaaactatatcctgcattagctcaggtattccttctcctgtcatgggcacttgagttggtttcatttcgttgttttacaaacagtgctacctgtacattctttttttaaaactttaagttctggagacaa

SEQ ID NO: 173614 - DNA, 601 bp, Human
cctcccctcaccctccaccccccaactggccccagtgtgtgttgttcccctccctgtgtccttgtgttctccctacctgtatattcttgtacatgtcttatgctgcactaggactaagatgtatcaaagagccaaaatgcttcattgaagagtatgtgaaagtttgaatttgcaagataattcctaattgctttccaaagtggacatcaacaatgtataagagatatcattcatctacatacctagtatggtattctcaaggtgtcctaattattgttaattgaaaattaacaaaatattsttcattgtataattattgtataaatactatctttttgtggctctgatttgcatcattctgattccaaggtcaaccccatcacttcatatatttgtggatgacatatttcctcttgtgtcaaatgcctgttcctgcctttcactgatttttctattgtttgtcctttcttattgatttataggagctctttacgtaatcttgatactaattctttattggttttatgtattgcaaacatcttattgcaatctgtggcgtgtcttttcactctgttaatgatgtttgttgatgaagagaagt

SEQ ID NO: 173615 - DNA, 601 bp, Human
gtgaatgttactgtaatccaatgtttcaaattgttgcatcgtgattggttagctgtttgggctcttgtctagtaatccttgtgtacctcaaagtgaaaagatatttcttcttccaagagtttcacagttttgttttttaccttaaaccttactccatctgggtgtatttttattaaggttcaaggccatgacacgtggaagtgcagggtgtacactgcccagttctaggaagagctgggggcactcacatcaaccctggtagggaatgagtcagggatccaatttcattttccccaggtakaaaaccaatttttccagccccacatattgaagaatctctcctttctgccatatgttaaggtttcatatatatatgtgtctgtttctagactctgttctgttccctgggtcaacaagcattaacaggcatttatattcatattcatatgtttttttttttggtcagatgaaatacattaactggtttgagaacaattctgtgttataaactcaaaatcgccagcagcaaattatttattacaagacttaaatttttattttatcccctaaggataaatgctaccagtattggccaaccgag

SEQ ID NO: 173616 - DNA, 601 bp, Human
ctccatctgggtgtatttttattaaggttcaaggccatgacacgtggaagtgcagggtgtacactgcccagttctaggaagagctgggggcactcacatcaaccctggtagggaatgagtcagggatccaatttcattttccccaggtagaaaaccaatttttccagccccacatattgaagaatctctcctttctgccatatgttaaggtttcatatatatatgtgtctgtttctagactctgttctgttccctgggtcaacaagcattaacaggcatttatattcatattcatatgttwttttttttggtcagatgaaatacattaactggtttgagaacaattctgtgttataaactcaaaatcgccagcagcaaattatttattacaagacttaaatttttattttatcccctaaggataaatgctaccagtattggccaaccgagggctcagttactcatggagaaataacgattgagataaagaatgataccctttcagaagccatcagtatacgagactttctggtcactctcaatcaggtattgttgaagtagctctttaaacgcttgtgaatttagtgaaccacgccctccc

SEQ ID NO: 173617 - DNA, 601 bp, Human
gaatgataccctttcagaagccatcagtatacgagactttctggtcactctcaatcaggtattgttgaagtagctctttaaacgcttgtgaatttagtgaaccacgccctccctctgggttctgcttgtcattgaaccagaatgtggccctgcacctgtcctgctccttcacctagtcccattggctatgaatggccaatgggtttcagagacagtggcaggcctcctgtacaattcccatctccctagctgcctacctcccatttatctctcaggagaattacattagccattagctgtragaggaagaacaaaggggactaatgaagccacaggggcctctctggggccctcctccaggtgccttctcagagccccccactgtccccatttccactgggtccttggttctgctcatcctctctccttggcaaagaatgagaactcggggtcagctgtaggtaggatgactcacttgtacacaggtcttgatgctgagctccaaacagtcagtatcacgtaatgcacctgccactgtctcctccatgccagccacagagccaccctggccaccagactcagatgctgctcatttgagctc

SEQ ID NO: 173618 - DNA, 601 bp, Human
atctctcaggagaattacattagccattagctgtaagaggaagaacaaaggggactaatgaagccacaggggcctctctggggccctcctccaggtgccttctcagagccccccactgtccccatttccactgggtccttggttctgctcatcctctctccttggcaaagaatgagaactcggggtcagctgtaggtaggatgactcacttgtacacaggtcttgatgctgagctccaaacagtcagtatcacgtaatgcacctgccactgtctcctccatgccagccacagagccacccyggccaccagactcagatgctgctcatttgagctctgaagggaaatgcagggccctggtttcttgagaaagtgattcccttctctccagcagagctgccaaggatcccgtaggggttgggcagtcctcacagggatccaggggatgtcctctggacggctcgctcccccttgcagaaggaagcacagccagccacctgccttcttctttaggacaagcaggtttcagccttctccttcaggctgcctcggtggggatgttggcagcacagaaggctcagggagggctcccagccttggcca

SEQ ID NO: 173619 - DNA, 601 bp, Human
gccaggcagggctcggaggaacacactcctggacttcaagttcctgggtgggttttgagagactgccttactgggctgcattggcctacacccgccctctcccatgggctgggattcctggccatatgaggagtcccaactgggattgtagccacgctggtcctgcagcctcagcctggctcccaagtcaggcccaaaggcagagggacaccctgggcaggtgggacatgcttagtccgcaggtgaaggcgtgaaacacagcacgcccaggggcagatacgcaaatctggtcaagcccacyggccacccacttgcctgccttctgtgcctctgtagttctgatcctgctgcacacttctgctggcagggacctcgacacccggcaaggttcttccaagcaggagcttggggtgtttctatccttgggtggtgctaatgtgctcctgaaactgcagttccatggcttgtctcacactggtggcgcccactctttgtgactgcctttcacccccacccactgtcccaccccttatagctggcagagctctctccctgcctggaccccaccggggtgcactcctggcctggccagtaggtggag

SEQ ID NO: 173620 - DNA, 601 bp, Human
ccctttcagcatcacctgtttcagaagacacccctggcacagtaaggagagggtatgccaagattacctccttcctagacctgaactgggagggtttgcatttctggcaagttcccaggtgccaactgtgctgctggtccagggaccacactttgagaaccattgccctacacaaggaagaggggaaatggtgatacttgcttaaaaacttgtcactggtcctgtctcattttataaaatatcggtctcctgtaattagggaggtgttttaggaattttacatttgctaaatcttgctcakaagttacactacatacaaatgatcaaaaaaaaattcagtcaaactcagatcattttcagcgattgttgcttcagtgctgatatgcaggggttggctgtcagctctccatttctcatccccaagtgcaagtcggatgatctgcattaagcgctttttctctgcagtgccggagctgggcgaacaggtacattcatagccctcagcaacattttggagcgagtaaaagccgagggacttttagatgtatttcaagctgtgaagagtttacgacttcagagaccacatatggtgcaaaccctg

SEQ ID NO: 173621 - DNA, 601 bp, Human
agttcaaaagcagcactgaaatttaaaatcctggtccttctcatttcaatgttatactcgtccatgtggcttgttttccctggcggggtctcactcagcctcaagataccgtccacgggctgcaggaatccctaatgtattagtagttttccccgtacattctttcatttcaaggactcctgctttctggttttcagaagcgattcctcctcaccaaatactatggctcgtgctgctaacccagcgagtacaattttaaagcctgttacaatgcatcctttttaccaaagcttcccacttygcacctgtcctccctgcctgctcactctccacgctgacaatcctggctcacgcagcgccctgtgcatagagaggcaggaaggaggcccttctacgtccccctcacagcaaggcgcagcaggagcgaggacacctgagctgagggcgggtctgtccatccacacccaacgacctacagcaaagaccatctctctaagcagtagcatacagagcttcccctagtctttttagggactcacagctctcattaatctgcctggtctggccaatatattctatcttcgagagcatctgtcatcca

SEQ ID NO: 173622 - DNA, 601 bp, Human
cttcgcacctgtcctccctgcctgctcactctccacgctgacaatcctggctcacgcagcgccctgtgcatagagaggcaggaaggaggcccttctacgtccccctcacagcaaggcgcagcaggagcgaggacacctgagctgagggcgggtctgtccatccacacccaacgacctacagcaaagaccatctctctaagcagtagcatacagagcttcccctagtctttttagggactcacagctctcattaatctgcctggtctggccaatatattctatcttcgagagcatctgtcayccaggtgtcctcccgtctcagctgtgctcttcctgaccgcagcttgcccctccatgctccctgactgagaagctgccctcagatgttgtgtggctgtcatctgtgctctcttgcctggtaacagcttgacagagcactttgtagcctgacttttagagtaaagggtctagtccaatgcctggcccgtggcgagggctccagagcaagtggtgaatcagcaaacgaatgagggagaagagtcactaaataaccatcaggcgttgggcgcagtgcaaccaggtgccttacagatgtctttct

SEQ ID NO: 173623 - DNA, 601 bp, Human
tcagcaaacgaatgagggagaagagtcactaaataaccatcaggcgttgggcgcagtgcaaccaggtgccttacagatgtctttctcatttcatcttcaccatctgcttgcccttgtgcctgcttctgttcacaaggagtgttctgcaggtgcctccagttaggacggttgaggggcctgcctgagatcttcaggtattaagtgtcagaatgagattcaaactctatctgattccagaagggaaaggcttaactagtactgtatgctgccagatctaacatttggcagggagattttggcaaaaaaaaacacaggcacaaaaatattattgagtaaagagatgattgctgacctgcaggttgatttagccctgcaggtgagcacagtggcccaagaaccagtttccaattgctgagcactcagggaagacttgcttccagcatcctaggtaggctttggttggaactgacatttcaaaggccacaagtacatctgttctcctggagtctgtggattgaccagaaatgtctgtctgtgacctgaggtgtggcttgtatcatccgagcacactccaaagtacacttcatccatcactggcccc

SEQ ID NO: 173624 - DNA, 601 bp, Human
cagggagattttggcaaaaaaaaacacaggcacaaaaatattattgagtaaagagatgattgctgacctgcaggttgatttagccctgcaggtgagcacagtggcccaagaaccagtttccaattgctgagcactcagggaagacttgcttccagcatcctaggtaggctttggttggaactgacatttcaaaggccacaagtacatctgttctcctggagtctgtggattgaccagaaatgtctgtctgtgacctgaggtgtggcttgtatcatccgagcacactccaaagtacacttcrtccatcactggccccaatcacttgtactcgagactacgtgggatggtcagcagttagctgctgtgttagctatgaaaacagagtaattagtgatcgtctccatttccatcccagactgagccagctttgatattcagtcaatgttgctttaagttggaaaagtcaatgttgctttaagctgtttgcctctttaaagagagcctgtatatttattgagaattccttctaagaattcaattccctttccttctgaaggctgggtgatcagctgcgtgtcttagtagccagaagtgaggaccc

SEQ ID NO: 173625 - DNA, 601 bp, Human
atgttgctttaagttggaaaagtcaatgttgctttaagctgtttgcctctttaaagagagcctgtatatttattgagaattccttctaagaattcaattccctttccttctgaaggctgggtgatcagctgcgtgtcttagtagccagaagtgaggaccctacaatgtggtcttggctcttccaacaacttcatgcaaattcagaagcaaagtttcaggctcaccttttccttctctggaaaactcagctccttcccatcctggccagaccgggactcaggaagggctaagctagctgttyggcatctttccacccaaaagcatttagatatttgttcactgtgtgctgagaagagcccaagtgcaatgtgttggaaagaagcagggaggtgctgaggacagctcttggcctctccggctttccaagcccctgtcccggccccaaactcacatatcccacccaggggtctgggaggaccagcctatatataaaacaatgtcccttttgtacagtaaatgtaggctttaaaataatctagatatgcattttatttaacttttatagatcgctttatgaaatttatctggcaatgttagtact

SEQ ID NO: 173626 - DNA, 601 bp, Human
agaagatgattttggcagcagtgtataggtagaaaaataggaggacagtaggtaagttaagatattgcacttaagtgagatccaaagagggtctaagctacagtgttagcagaggacattgaaaagagggatatatgacaaaaattacagggtgtttgtaccacctggcccttttgagttggtgtgatccatctatgcctacaccttcttggcctttcaagtcaagtatcacaggctccctggtctaggcaatctcttcagattcctccttctgttatccagtctggtcccagatattaakattgtctgcctggctggaacctttgggttcttatcctaaactacctctcctctggcttatatcagactcttctacacgttggacctcagctgtcctatttgatgggccttctgggaccctttcagagggagggatctagacagaaggagaatctgaacaatttggtacttttcaaattgtgaaggagtgggatgtgaagagaagaattagatggtaactccaaggtttagagtttgaattactagaacgaataaatgcatttttactgtaagccttcataaaacagattcaaatacagct

SEQ ID NO: 173627 - DNA, 601 bp, Human
tatcctaaactacctctcctctggcttatatcagactcttctacacgttggacctcagctgtcctatttgatgggccttctgggaccctttcagagggagggatctagacagaaggagaatctgaacaatttggtacttttcaaattgtgaaggagtgggatgtgaagagaagaattagatggtaactccaaggtttagagtttgaattactagaacgaataaatgcatttttactgtaagccttcataaaacagattcaaatacagcttttacttggctactttggatttgtctaaaatmgatttttatttatgtaattcctctgatggaaatattatatgtagagagtgtgatcaagagtccgccatctaaacaggaagccatgtttgaaagtagaggcaagatagcattttgggaaattgaatcattatgcctggtgcagagaaaactgggggaaagtggttgagatgtgaggcactgagtaaataatgtctgtaattctgacctcaagcttttattctaaattacactcttttttttttttttttttttgccccgagacggagttttgctctttttgcccaggctggagtgcaatgg

SEQ ID NO: 173628 - DNA, 601 bp, Human
attttgatctcatagacttcctgaaagtgttttagaaaacccaagggggttctttggagaatcactgggcaagtttgtgaaggggaacccaaataagagtgtaggtttgggactagataatgaaaagatgttcactgggggaatttggtctttactaagcaatggggagccactgaaataaagtagaagagtgaaataaaaggagctgtgcttttagaagattttttttattgcaagtaatgcctagagtatcggaagcagttacaattgaactgtaattgatatttgaggtaactgtggkaagcaacgtaatgggttttgaggaagaatataaatatagtacatctgattaaatacaaaggacagacaaagaggaaagtcaaaacagtgctaagattttgagccttatgactggttggcttatgtcccattaacaggcatggggagtacaggaaaataattaagcttgggaaagaaagtagggaattaagttttagattgtatataaaaagttttacctctaacattttgaaataattttgtcttacaaaaaagttgttaaaataataaggttcatatatatccttaacctaacttcccc

SEQ ID NO: 173629 - DNA, 601 bp, Human
gacatgtatcatttcacttggttgtcatagaaactgtggatggaggtagtgccacttgaaaactgagctttggagagagaaaaaaagatttttcccaagatcatgtgggaagtgagtggtggcacccagacttgaacttcaaagccttgctgcttttacccagcatagttaagtcaaagtctgaaatctgtttccttattgctttttctttttctttttttttttaaatgcggtcttgctctgtcacccaggctggagtgcagaggcccaatcatagtttactgcagcctcgaactcctgkgttcaggcgaccctcctgcctcagcctcccaagtaattggaattacaggcatgaatcagcctgcttggtccgttattgcttaactgtaacatggaccaaagaagcagctaaccctgttagttaattcttactaggaagagaaaccgcaccagctatttaaaaaaaaaaaaaaaaaaagcaaaacaaaaatgaaaataccaaggtatactggaaaataacattgagcttagaaggagacctgagtttgtacctggctcagtcacccagctcatttatcactttcttaggaaggcctttccc

SEQ ID NO: 173630 - DNA, 601 bp, Human
gctttggagagagaaaaaaagatttttcccaagatcatgtgggaagtgagtggtggcacccagacttgaacttcaaagccttgctgcttttacccagcatagttaagtcaaagtctgaaatctgtttccttattgctttttctttttctttttttttttaaatgcggtcttgctctgtcacccaggctggagtgcagaggcccaatcatagtttactgcagcctcgaactcctgggttcaggcgaccctcctgcctcagcctcccaagtaattggaattacaggcatgaatcagcctgctyggtccgttattgcttaactgtaacatggaccaaagaagcagctaaccctgttagttaattcttactaggaagagaaaccgcaccagctatttaaaaaaaaaaaaaaaaaaagcaaaacaaaaatgaaaataccaaggtatactggaaaataacattgagcttagaaggagacctgagtttgtacctggctcagtcacccagctcatttatcactttcttaggaaggcctttccctgtcacaccctccttcttgtttgtctctattagagcactgaactcattgccataattaccttattg

SEQ ID NO: 173631 - DNA, 601 bp, Human
ccagcatagttaagtcaaagtctgaaatctgtttccttattgctttttctttttctttttttttttaaatgcggtcttgctctgtcacccaggctggagtgcagaggcccaatcatagtttactgcagcctcgaactcctgggttcaggcgaccctcctgcctcagcctcccaagtaattggaattacaggcatgaatcagcctgcttggtccgttattgcttaactgtaacatggaccaaagaagcagctaaccctgttagttaattcttactaggaagagaaaccgcaccagctatttaaaaaaaaaaaaaaaaaaagcaaaacaaaaatgaaaataccaaggtatactggaaaataacattgagcttagaaggagacctgagtttgtacctggctcagtcacccagctcatttatcactttcttaggaaggcctttccctgtcacaccctccttcttgtttgtctctattagagcactgaactcattgccataattaccttattgcagtgattctaaggtggacatctttcacattttaacttttctaaagtgtggatgcattttacaattgatggtgttttaaaataaattggcagc

SEQ ID NO: 173632 - DNA, 601 bp, Human
agcgcgatccacctgctcactgttcagctggacctgtgggagatgactgtaagccttgctctatttctgggattatgctacctttaaaaatataggtttgaacatttgttaatgactccaaaactcctttgtttgtttcagtgttccactggcaagccactattatggggcctgtaagtatgattcatatctatgaaattaaccccctcagccatacttcattcttgccatttcacctttgatcagatgtttgtgatgaaggttgaatattcttgtactttgaatcacctaggaagcaaartattattaaggatttacaatgattttccaaagcattggtggcaaatatttcctgggatcactattatgttttcctttgctgaatcctagatcattacacataatggagtgccacagctcgcaaccaggctgtgtgtttatcttttttttttttttttttaagtcacagagagttagttgtaattaaccataatcattctcacatccacagttttggtaggttagaaattagtctaatgaagccaataattgaattcctacaagtaacaagtgtcagtttgccataagtttcatcactgtt

SEQ ID NO: 173633 - DNA, 601 bp, Human
cataactcccttactttagtaatgtaaatatttacagtactctggaccatatctgtcattgtaatttatcttcattttctatatttcttacaatttttgataaactagaattgtttaaacaatatatatagtaagaattattatacaggaaaatcctctagcatatatgtggaaacttaacgagaaagtaatgagtcttggtgttattaccagaatgctaatataacatgatatatttaattaaatatgaaagaattaaaatagaattgtaggtatagtttgctagcattttctttttttwaaatttttttgcttgtaatgttatattttctaatggctataaagaaacatggtcaaatttaaatttctctagtaaagttgattcccaatttgatagtagcatgaatatataattttgttttggatttttttgggttctctacattattttataaataattactaaacgaagatttggcacataaattgtgtagcagggtccttagcattttcttttcacgacagcctcttcagttcatctccattcttggtcatcaagtgaacatcagaacttaagttttactatcctcaaccctttttc

SEQ ID NO: 173634 - DNA, 601 bp, Human
atggaagcaatctgtactcattttttatttttaataattgctacttgaatatacagcatgtttttaaaagtaataaggtttataggaagcagggtccacagccgtagctctttcaaatattagataaataatagctctttcagttcaattatttatgaacgatagtttttctgacctaagatgctcatctacagtattcatatagattctcatattcttttaagaatctttcacacagtgtaactgtcatgcattagatatatgaaagattctgtgttgaagggttaattcaagttcataygctgtttcctggaatggtgtcacaaaatggatctcacttggcatataaactgccaagtccttatacatataaaagaaatggcaaactgccagatattgagtacttatattctgacattggtagccttttataaagaatcagtagtgttagattctggaaaccatcctgtgagaaatgaaacagcctcagtttccttataagtaaaatggggattcttatagtgttaccatacagggttgctatgtacctagcacatagtgggcacttacatgaatgttaactgttacccttttccttacc

SEQ ID NO: 173635 - DNA, 601 bp, Human
ggaggaacttccttcttgcttacttttttataagatagatcataccttgctcatttgtttgtatattttttactttgctatatttttttaaatttttaatttgtttatcttaaaagattgttttttaattaaatatagacagagtcttgctgtgttgcccaggctggtctcaaactcctggcctcaagtgatcctcctgccttggtctcccaaagtgctgggattataggtgtgagcaaccttgcccagcttattatttttatttttttattttttgagatgcagttgctgtgttgcccargctggtctcgaactcctaagctcaaggattcttccacctcagcctcccaagtagctggcattataggcacataccaccattgcctggagcttttccatattttaaatgtcttcttttgctttttatcatgaggttagtctggaagcattctggggctgtaagttagccctgaaaatctgccctgttggtttaatatacaaggcttttaagtttcattgggcagatagaagataagaaagatgaataaaatactaattttttctttagttcataacacccccccaccctttgcctgtcatt

SEQ ID NO: 173636 - DNA, 601 bp, Human
gtttcattgggcagatagaagataagaaagatgaataaaatactaattttttctttagttcataacacccccccaccctttgcctgtcattgtaagagtcaactctgctctataaatccacctttggacttgaaagagtacgaaaatagaaaggaaacgcagtggggtgggtgcaagtggaaatgggaggttggtccagaggttccatgaacctcctcagaagtggtggcatgcaattgaagcagacaaatgaggaaccagagtccttgttccctcttatttcagatacttagatcgttattgtgtgtgtgtgtgtgtgttagtgtagctatttgcattagaattttgacatactggagtaacaactactttttcaattttcatttcttttttaaaatatgcaagctatataaagatagctgttcacattatttttaaatgcatgcaatacaaataaactacattaagtaaagattcattgaaaaaaattttacaaatttttcttctttgtagacagactatagctctaagccaaagcaaaagagtgtatgagcacagtatccaaaatggtttggactgttaactgtaatttgattgttct

SEQ ID NO: 173637 - DNA, 601 bp, Human
gacatactggagtaacaactactttttcaattttcatttcttttttaaaatatgcaagctatataaagatagctgttcacattatttttaaatgcatgcaatacaaataaactacattaagtaaagattcattgaaaaaaattttacaaatttttcttctttgtagacagactatagctctaagccaaagcaaaagagtgtatgagcacagtatccaaaatggtttggactgttaactgtaatttgattgttctgtagagaactctcaagtttaaaggttgttaatagctactttggaggstcacatttttttaaataaatgggaactcggaatttaaaacttcaaaagctaaaataattttatattttatgcatcctatggtaattttataactttaaaaattaaagatcaatttgctatcaaccaaagtagaataaaatataatttgatgtgttcattttatgttttttttataagtacagtatctatattcactaaaattattttcacatatgtaatttgtatgaagtagaagggttattgtctaatgtgatgttctcttttaaatctagttttattgtccatatgttctctactttg

SEQ ID NO: 173638 - DNA, 601 bp, Human
tattaaatatatattgcttatcttctccaaggaagaggagttctctcgtacccatccaaactgacctaattctcaagctgcttcatcttgctagtactgtaggttcatttgcaatttgtagataatgctccttcaggattggcttttgtaaatttctgttagaagctggtttctgcattttgatttttgtgtatttggatacattttcatataggttgcagagaaatccatgagttaaaaaattatttttcctgttttatttctgcatgaacctaagtcacattgacccagtaattgatayatgtgtgattattgcaattaagtataagaaggtagaatatatagttttattagacagatgcttctgaaatattaattttgtatgtttttactatatcctttttgtgtatctacagatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctg

SEQ ID NO: 173639 - DNA, 601 bp, Human
ctgcagccacttgctcaggcctgctcccatcctgtgacatgtactttagcttctattgccttccacttcaataaatctatgctttcattgcttgttcatgcatgatgttcaattatttgttcaacgtgccaaaaacctggacaactccaatcagaaccttccacctggtaatacaactttctgtaagtgttttttctgaacaaaacgtgatactatacaacaaagggtcttaccaagattggcaaatccatcctgaagggcccataatcgagcccagggggcaggggtaggctcctcaggytcttggtcctcaggttcttggtcctcaggaatagaatagagttcctgagtggacactgtctctaaggagctcagtgtcccagagctggagtgagaggactggctggagtttggcatcgtgctggtagaggagctggatatgccctgggactgtgaggaggagccttgggactgggtaacgctgccatggggctgtgaacaggcactgctgccatgagactgctgagcctcaacatccgactcccgagacatcacgacctcaaaaagaaagtgtccaacaacaaaggtgagtttcaaggca

SEQ ID NO: 173640 - DNA, 601 bp, Human
tttggcctctaatgggctgtgagccagcacttcatttacataggatgtaaacagtgggagacctctagagggtacttgaaccccagaagactttgctacaagggctctgcagccacttgctcaggcctgctcccatcctgtgacatgtactttagcttctattgccttccacttcaataaatctatgctttcattgcttgttcatgcatgatgttcaattatttgttcaacgtgccaaaaacctggacaactccaatcagaaccttccacctggtaatacaactttctgtaagtgttttttctgaacaaaacgtgatactatacaacaaagggtcttaccaagattggcaaatccatcctgaagggcccataatcgagcccagggggcaggggtaggctcctcaggttcttggtcctcaggttcttggtcctcaggaatagaatagagttcctgagtggacactgtctctaaggagctcagtgtcccagagctggagtgagaggactggctggagtttggcatcgtgctggtagaggagctggatatgccctgggactgtgaggaggagccttgggactgggtaacgctgccatggggctg

SEQ ID NO: 173641 - DNA, 601 bp, Human
gcctgggaggcagaggctgaagtgagctgagattgtgccactgcactccagcctggatgacagagtgagatcctgtctcaaaataaacaaacaaacaaacaaacaaaaatttaaaaaaaggaattaaaactgtaaaattttaaaagaaaacataggtataaataattaacaaataataataataaacagcctcggccagacgtggtggctcgcgcctgtaatcccaccactttgggaggccaaggcgggcagatcacctgaggtcaggagtttgaaaccagcctggccaacatgatgacamcccgtccctactaaaaaatacagaacttagccacggtggtgggcacctgtaatcccagctactcaggtggctgaggcaggagaatggcttcaacccaggagattgaggttgcagtgagccaagatcgtaccactgcactccagcctgggtgacagagtgagactccgtctcaaataataataataataataatgataaacagtctctatttattcagcacctactttatgctggtcatcctatcaggatctttgtttacttgtctttttttgtttttcctttttgtggagaatggggtct

SEQ ID NO: 173642 - DNA, 601 bp, Human
gcttatgcctgtaatcctaacactttgggaagccaagatggatgtattgcttgagctcaggagtttgagaccagactgcaacatgatgaaaccccatctccaccaagaatacaaaaagttagctgggagtggtggtgcacatctgtggtcccagctactcaggaggctgaagtgggagaattgcttgagcctgggaggcagaggctgaagtgagctgagattgtgccactgcactccagcctggatgacagagtgagatcctgtctcaaaataaacaaacaaacaaacaaacaaaaatttwaaaaaaggaattaaaactgtaaaattttaaaagaaaacataggtataaataattaacaaataataataataaacagcctcggccagacgtggtggctcgcgcctgtaatcccaccactttgggaggccaaggcgggcagatcacctgaggtcaggagtttgaaaccagcctggccaacatgatgacaacccgtccctactaaaaaatacagaacttagccacggtggtgggcacctgtaatcccagctactcaggtggctgaggcaggagaatggcttcaacccaggagattgaggttgc

SEQ ID NO: 173643 - DNA, 601 bp, Human
aattaaatgttcattgcaaggcagactagggaaaatactagcaactcctatcaggaaaaggaataatttccctaataaatgttaggttcctataaatcagtgaaaacgctaaacagtccagtagaaaaataggtaaaggatatgaaaagataatttacaagaaacagaaatacagctggctcaaacatatgaaaggtggccaagctaacccaatataagaaaattcagaaatcaaaaacacattaagatttcatgttttacctattagattggcaaaaatccaaaagtttcatatcacccwgtgctggcaagaggtatgaaaaagcgggtactctcatacattgccattgggaatataatttatacacacattgtctataattgtctagggaggacaatttagcaagatctatcaaaattacatatgggctgggcacgatggctcacgcctgtaatcccagtactttgggaggccaaggaaggaggatcacttgagcctgaaggtcgaggctgcactaagctgtggttgcaccactcactccagagtgagagtgagaccctatctctagaaagaaaaagaaaattaacaaatccaaattta

SEQ ID NO: 173644 - DNA, 601 bp, Human
tatctataaccacatggccaggcacagtggctcacacctgtaatctcagccctttggaaggctaaggcaggaggatcacttgaccccaggagctcatgaccagcctgggcaacatagggggcacccatctctaccaagaatttaaaaattagtctgggcaacatggtgaaaccctatctctacaaaaaataaaaaatcagcagggtgtggtggtgggtccctgtggtctcagctactcaggaggctgaggtgggaggatcgcttgagcccaggaggtcgaggctgcagtgagctgagactrcgccactgcacactagcctgggcgacagagtgagacccagtttcaaaaaaaaaaaaatggccaggtgtggtggctcatgcctgtaatcccagcactttgggaggctgagacgaatggatcacgaggtcaggagttcaagaccagcctggccaagatggtgaaaccctgtctctactaaaaaatacaaaaattagctgggcgtggtggcgggtgcctgtaatcccagttactcgggaagctgaggcagagaattgcttgaacctgggaggtggaggatgcagtgagccaagattgcgccac

SEQ ID NO: 173645 - DNA, 601 bp, Human
tcagaattatcaatctgcttatcaagattttacaagattaaaaattaggagagaaaaaacaacattaccaatgagtttaacaaatggcagtttatctataaccacatggccaggcacagtggctcacacctgtaatctcagccctttggaaggctaaggcaggaggatcacttgaccccaggagctcatgaccagcctgggcaacatagggggcacccatctctaccaagaatttaaaaattagtctgggcaacatggtgaaaccctatctctacaaaaaataaaaaatcagcagggtgtsgtggtgggtccctgtggtctcagctactcaggaggctgaggtgggaggatcgcttgagcccaggaggtcgaggctgcagtgagctgagactgcgccactgcacactagcctgggcgacagagtgagacccagtttcaaaaaaaaaaaaatggccaggtgtggtggctcatgcctgtaatcccagcactttgggaggctgagacgaatggatcacgaggtcaggagttcaagaccagcctggccaagatggtgaaaccctgtctctactaaaaaatacaaaaattagctgggcgtggtggc

SEQ ID NO: 173646 - DNA, 601 bp, Human
gatattacccagaaaaacagttgttcattttagatgttattttcatagtttcagaaatggatgcttataaaatgctacctgatgaggctgataaacatctccacttgtgcacgataaccttgtagtatttacaaaggtagaagctctaaagtgagcctcttacagaagcactcacagcctagtacctggcatataaaaagagctcaataggccgggcgcggtggctcacgcctgtaatcccagcactttgggaggccgaggcgggtggatcacgaggtcaggagatcgagaccatcctggytaaaacagtgaaaccccgtctctactaaaaatacaaaaaattaggtgggcgtggtggcgggcgcctgtagtcccagctactggggaggctgaggcaggagaatggcgtgaacccgggaggcggagcttgcagtgagccgagatcgcgccactgcactccagcctgggcgacagagcaaggctccgtcacaaggaaaaaaaaaaaaaaaaaaaaaaaaggagctcaataaatgtatacagaaataaatgaatagggctggacatggtggctcccacctgtaatcccagcactttgggaggc

SEQ ID NO: 173647 - DNA, 601 bp, Human
aggctaaggtgggaggatcacttgagccctggaagtggaggttgcagtgagtcaagatcgtaccactgcactccagcctgtgcaacagagcaagactctgacactaacacacacacacacacacacacacacacacacacacacaggaaataaaaaaagaaatatttggctgggcatggtggctcacgctactaatctcagcactttgggaggctaaggcaggaggatgggttgagcccaggagttcaagaccagccctggcaacacagcgcaaccccaactctaaaaaacaaaaacacayattagttgtgcatggtgctgcatgcctgatctcccttgacctgggagatcaaggccacagtgagctctgatcgtgccactaccctccagcctgggtaacagagcaacaccctgtctcacaaagaaataaaataaaaataaattaaaatgactgtgtgaaataacacacaaaaataaaaataaaaaataatacacaaatagataccatacaaatgttatcaatacataatgagtgttataaaatcagaaatgagaaaccaccaatcacaaatgtatagtgaaaaaattaagtgcatttata

SEQ ID NO: 173648 - DNA, 601 bp, Human
atgcctgtaatcctagcactttgggaggccgagatgggtggattgcttgagcttaggagttcaagaccagcctgggcaacatggtaataccccatctctacacaaaatacaaaaattagccaggcacggtggttcaagcccatagtcccagctacttgggaggctaaggtgggaggatcacttgagccctggaagtggaggttgcagtgagtcaagatcgtaccactgcactccagcctgtgcaacagagcaagactctgacactaacacacacacacacacacacacacacacacacacccacaggaaataaaaaaagaaatatttggctgggcatggtggctcacgctactaatctcagcactttgggaggctaaggcaggaggatgggttgagcccaggagttcaagaccagccctggcaacacagcgcaaccccaactctaaaaaacaaaaacacacattagttgtgcatggtgctgcatgcctgatctcccttgacctgggagatcaaggccacagtgagctctgatcgtgccactaccctccagcctgggtaacagagcaacaccctgtctcacaaagaaataaaataaaaataa

SEQ ID NO: 173649 - DNA, 601 bp, Human
tatttttatttttatttatttatttatttattttaatattttatttttttgagacagggtcttgctctgtcacccaggctggagtgcagtgatgccatcttggctcactgcaacctccgcctcctgggttcaatcgattctcttgcctcaacctcccaagtagctgggactacagacatatgccaccacacccagttaatgtttatatttttagtagagacagggttttactgtgtcagcccggctggtctcaaactcctgacctcaagtgatccaccagcctcggcctcccaaagtaccyggattacaggcgttagccactatgcccggcctggctatttcccagttacaaaagccagtaaattttttctcttacctgactcatttgagttgagtttctatcatttgctacaagttagagaattcatattaaatcttcccttaggaaaacattgaattccatacatttcttcttcttttttttttttttcctcccgagacattgtctcactctatcgcccaggctggaatgcagtggcatgatgatggctcactgcagcctccacctcctgggctcaggtaatcctcccacctccacctt

SEQ ID NO: 173650 - DNA, 601 bp, Human
tgacattgggagacagacttctctctgttgtagtttctagacaaagaaaatatcattctgcagcccctggtagccatttttcctaccacatagagagaacaattctataggaagccaacaaacagctgaatcaagagatggagctagagccctggtgacactgcaggagctcttagacgcagtcaaccagaccatcagaactcaaagaccatgaagtaaagcctaatgacctcctagatccagccatgcctgaagtaaggatttgcctgcttatttttatttttatttatttatttattttttttaatattttatttttttgagacagggtcttgctctgtcacccaggctggagtgcagtgatgccatcttggctcactgcaacctccgcctcctgggttcaatcgattctcttgcctcaacctcccaagtagctgggactacagacatatgccaccacacccagttaatgtttatatttttagtagagacagggttttactgtgtcagcccggctggtctcaaactcctgacctcaagtgatccaccagcctcggcctcccaaagtacccggattacaggcgttagccactatgcccgg

SEQ ID NO: 173651 - DNA, 601 bp, Human
tctcgtgcctcagcctcctgaatagctgggattacaggtgtgtgccacctcgcccaactaatttttgtatttttagtagagacggggtttcaccatgttgggcaggctggtctcgaactcctgacctcaggttatctacccacctcagcctcccaaagtgctgggattagaggcgtgagccaccgtgcccagcctggacacttgttttttaaattggggaatttatatacctagaaggagaatttctgagtcacgtgataattctatgtttacctttttctgttgttgtttgttgttgttgttttttatgccccatagagctcagatgtttacctttttaagaaatcaccaaactattttccacagtggctacatcattttacattcccgttagcagtgcatgggggttccaatttctccacatcctcaccaacagttactagtttctgtttccttattatggtcagcctagtaggtaggtgtgaagtggtatctcattgtggttttgatttgtattgccctaatgactaatgatattcagcatcttttgatgtgctttttggccattgtatgtgttcttgagggaaatgtctattcaagc

SEQ ID NO: 173652 - DNA, 601 bp, Human
tctgtcacccaggctggagtgcagtggcacaatctcggctcactacaacctctgcctcctggcttcaagcaattctcgtgcctcagcctcctgaatagctgggattacaggtgtgtgccacctcgcccaactaatttttgtatttttagtagagacggggtttcaccatgttgggcaggctggtctcgaactcctgacctcaggttatctacccacctcagcctcccaaagtgctgggattagaggcgtgagccaccgtgcccagcctggacacttgttttttaaattggggaatttatayacctagaaggagaatttctgagtcacgtgataattctatgtttacctttttctgttgttgtttgttgttgttgttttttatgccccatagagctcagatgtttacctttttaagaaatcaccaaactattttccacagtggctacatcattttacattcccgttagcagtgcatgggggttccaatttctccacatcctcaccaacagttactagtttctgtttccttattatggtcagcctagtaggtaggtgtgaagtggtatctcattgtggttttgatttgtattgccctaatgac

SEQ ID NO: 173653 - DNA, 601 bp, Human
gtaatgccataacatttgtggtacttcattcctttttacagctgaataatattccattatatggaagtatcacagtttatctattcaccttccgacggacatttatttggtttgtttccaccttttgtaaatggtttcttcagtatgacaacaaaagcataagcaacaaaagaaaaacaatagataaattatacttcttcattgtgactaaagctgctatgaacatttatgtacaagttttctttttttttttttttgagatggagtctcgctcagtcgcccaggctggagtgcagtggcrtgatctcggctcaccgcaagctccgcctcccgggttcacgccattctgcctcagcctcccgagtagctgggactacaggtacccgccaccacgcccggctaatctttttgtatttttagtagaggggggtttcactgtgttagccaggatggtcttgatctcctgacctcgtgatcctcccatctcggcctcccaaagtgctgggattacaggcgtgagccaccgcactcggccacatgtacaagtttttgtctgaacacttgtttgctttttttttgagatataggctcgatctgtcac

SEQ ID NO: 173654 - DNA, 601 bp, Human
ctggattgtgaaattcccagaaagatactaagagaaaaatgagagagaaactacgtatccgagaggtcagaaaaacattaactagaaacagtcctccctggtcaaaaataagtgcccaaaacaaacaaataacggtaaacagaatctgcaaatgaataactttaatggataaatttctttccttcttattctccatcttcaaaggaagtgcataagcagttgatgacataagttgcaccctaaatcaaatcagattacctaagaaaccaaacgtattacacaatcagcctactttcagcawcctctcacagagatttgcagttaaatgggatactactcatggaggaggaatgctctccaagccattacccagaacacagttaatcctgagtaggatctgtcctccaaagcttgggtcagcccaagataatggctactagggcatcaattacccattatgaagtagactattataactattgtgggttttgaaggggtgagttgaggggcttaccaagacatcttttttattgtgttaaatatacataacacaaaatttaccactgtaatcattttaaagtgtacaattcagtagcattaa

SEQ ID NO: 173655 - DNA, 601 bp, Human
ttttgctgatgatctttatggctactttcttacatgttttcctctcgaaagccagctttacctctccacaggcaccactagagggaaaaacaaagatagtgattgtctgaatgtttttaattatgagacctaccactcctgggtccacttcaagtattagaatttacagacattccatataacagcctttccattgtccctgtttgcagaggacacagtgaaacttcaccagtgtaaaatgtcaagggcttaacagccaaaaacactaagtcagctccaaattccatttctgagcccagcratacaaacatgggtcttactgtagccctggattgtgaaattcccagaaagatactaagagaaaaatgagagagaaactacgtatccgagaggtcagaaaaacattaactagaaacagtcctccctggtcaaaaataagtgcccaaaacaaacaaataacggtaaacagaatctgcaaatgaataactttaatggataaatttctttccttcttattctccatcttcaaaggaagtgcataagcagttgatgacataagttgcaccctaaatcaaatcagattacctaagaaaccaaacgt

SEQ ID NO: 173656 - DNA, 601 bp, Human
atgtgattagaggctgtgttttacattactttgttgagtcacatgtggaaagaccaatgcatttggccatctctcccatacagtaaatgttgattacaaaagagtagtaaaataaatggctgctataaagaaaggctatttcaatgatttaattaaaattttaaaaatctatggctaatccataaaccagggatactcactgccatattacccagaacagcaaagaataagaaattacctaaatgatcagccagagaaatggttaagtaaattacaataaagttgatgacatgaaaactcagtcatcaaaaaggatgtattaggcaaaagtctatgctataatgcatttgtggaaaagcaaaatacaaaactgtatatacaagatgatttcaaccatctaaaaacacgatttcatctgaacaaaatctagaaggaaaaggaaaactgaaaacagctgtggggttacagtggggattatggctgaatttttttctctaatttcctgtcatttattgtaaaaacaatcttgtaacgactttgaacttggaagaagaaaaaaaaaaacttcccactatgctcattattatgtacaattaaatac

SEQ ID NO: 173657 - DNA, 601 bp, Human
taacaatctagttggtattttcttctccccaaaatgggaaacaaatcttagaatcataggggaaaagatctataacaaagtgaacacaaaaaggaaattcctcttgccatgtgagaatggcattgtctagggggaaaaaaaattgatctttaaagaatgtgaaagtataatagccagaaacagctggccactagggaaaatgtgattagaggctgtgttttacattactttgttgagtcacatgtggaaagaccaatgcatttggccatctctcccatacagtaaatgttgattacaaaaragtagtaaaataaatggctgctataaagaaaggctatttcaatgatttaattaaaattttaaaaatctatggctaatccataaaccagggatactcactgccatattacccagaacagcaaagaataagaaattacctaaatgatcagccagagaaatggttaagtaaattacaataaagttgatgacatgaaaactcagtcatcaaaaaggatgtattaggcaaaagtctatgctataatgcatttgtggaaaagcaaaatacaaaactgtatatacaagatgatttcaaccatctaaa

SEQ ID NO: 173658 - DNA, 601 bp, Human
agattaagcccaccctctaatttttcttctcactttttaaaagtgagacacatttttcattgagacatagtcatcattgcacaaaaagataagaactaggccacagacaccatttaatcagatataaggacaggatgttgtcatacttaatggatacccttggatttatttggattactccaaataaaaggtattcaaaagtggtaaaacttcaggtataactaaaccaaatttactaaaattaacactgtcttctctaatataaccagttgtgtctatgagatagaataattgctatatsttttggtcaagaactaactcagaagaaatatcatttgtttatttaatcatgaaatctttatacggtattgttcactcagtaacattttggggtaaaactcttcccagctaaatgacagctaggcatgtgtgtgaatgtacacataagttaaagaacccaggttaatattagctttatttattcttttaatttttcttgtttttttttctgagacagtctcactctgtcgcccaggctggagtgcagtggcgcgatcttggctcactgcaatctctgcctcccaggttcaagcacttctcc

SEQ ID NO: 173659 - DNA, 601 bp, Human
taaacaaataaaggagaacaaaaagaaaagacacatatagaaaaggaacggagagaaggaaaaagggaactgcttggttctggttggcttcataatgggcagtgccagtacctatctgaaaatgggtggggtctggagctaacagagcatgaagaggtgtccgatagtcagaaccagtgtgaattacttcctctagtgtccgctacctccagggtcactgcctggggctgtcacagctaaaagggtctctctaccaggaatcagaagctactaacccacaccttccacttaggtcatactrggaaagcagttcagggaattaacgatctctgtcactctccaagtgtgttgtctgcactgaaagctttaggagtacgtctcattaaattctcacactgaccttgtgacataagtattcttattgtcttcattgtacagctgaggaaacgggggctccaataaataaaatgaacttctcaaacgacttctcagctgctttgatagtactgagacaggaacccagttctgcctccacactaaagtcacactaaagtgagggaagggaaggacagcaatatctgtgcttaccactgccggggtc

SEQ ID NO: 173660 - DNA, 601 bp, Human
gaggccaaggcaggcagatcacctgaggtcaggagttcgagaccagcctggccaacatggcaaaaccccatctctactaaaaatacaaaaattagctgagcctggtggtgggcgcctgtaatcccagctagtcaggaggctgaggcagaatcacttgaaccctggaggcggaggttgcagtaagccgagatcatgccactgcactccagcctgggcaacagacggagactccatctcatacataaataaataaacaaataaaggagaacaaaaagaaaagacacatatagaaaaggaacgragagaaggaaaaagggaactgcttggttctggttggcttcataatgggcagtgccagtacctatctgaaaatgggtggggtctggagctaacagagcatgaagaggtgtccgatagtcagaaccagtgtgaattacttcctctagtgtccgctacctccagggtcactgcctggggctgtcacagctaaaagggtctctctaccaggaatcagaagctactaacccacaccttccacttaggtcatactgggaaagcagttcagggaattaacgatctctgtcactctccaagtgtgttg

SEQ ID NO: 173661 - DNA, 601 bp, Human
caggagcagtggctcacgtctgtaatcccagcactttgggaggccaaggcaggcagatcacctgaggtcaggagttcgagaccagcctggccaacatggcaaaaccccatctctactaaaaatacaaaaattagctgagcctggtggtgggcgcctgtaatcccagctagtcaggaggctgaggcagaatcacttgaaccctggaggcggaggttgcagtaagccgagatcatgccactgcactccagcctgggcaacagacggagactccatctcatacataaataaataaacaaataaaggagaacaaaaagaaaagacacatatagaaaaggaacggagagaaggaaaaagggaactgcttggttctggttggcttcataatgggcagtgccagtacctatctgaaaatgggtggggtctggagctaacagagcatgaagaggtgtccgatagtcagaaccagtgtgaattacttcctctagtgtccgctacctccagggtcactgcctggggctgtcacagctaaaagggtctctctaccaggaatcagaagctactaacccacaccttccacttaggtcatactgggaaagcagtt

SEQ ID NO: 173662 - DNA, 601 bp, Human
tcgcttgtacctgggaatcgcttgaacccgggaggcagagtttgcagtgagcctaaatcgcgccatggcactctagcctgggcaacaagagtgaaactccgtctcaaaaaactaaactaaactaaactaaaaactaaactaaactaaactaaactaaactaaactaaactaaagcaagggacaggccaggcacagtggctcacgcctgtaatcccagccctttgggaggctgaagcgggcagatcaccaggtcaagagatcaagaccaccctggccaacatggtgaaaccctgtctctacyaaaaatacaaaaattatctgaattagctgagtgtggtagcacgaacctgtagtcccagctgctcaggaggctgaggcaggagaaccacctgaacccgggagggagaggttgcactaagccgagatcacaccagtgtgctctagcctggcaacagagcaacactccagctcacacacacacacacacacacacacacacacaaagggacagtacacacagcattcaaggtaatggcattacctctgggtaggatggggaaaacataaacaggtagctcgagtcatgtggtcaggttttttg

SEQ ID NO: 173663 - DNA, 601 bp, Human
cgtgatccacccgcctcagcctcccaaagtgttgggattacaggtgtgagccactgcacccggcccaaaatctttttgagagctgacacaacactcaaaggaaatactcattggagcattttggatttcagatttttggatctggaatattcaaccaggaagtacaatgcaaatgttccaaaatccaaaaagattcaagacccaaaaacctctggtcccaggcgttttggataagggacactcaatctgtatcatttttataagattcagaaacaagcagtaaaactatattatttagggrtacacatatatgtggctttaaaaaagcaaggggccgggcgcagtggcacatgcctgtaatcccagcactttaggaggccaaggcaagtggatcacctgaggtcaggagttcgtgaccagcctgactaacatggtgaaaccctgtctctactaaatacaaaaaaattagctgggcgtggtggtgcatgcctgtaatccgagctacttgggaggctgagacaggagaatcgcttgtacctgggaatcgcttgaacccgggaggcagagtttgcagtgagcctaaatcgcgccatggcactct

SEQ ID NO: 173664 - DNA, 601 bp, Human
aatccaaatcttttttttttttttttttgagacggagtcttgcgctgtcacccaggctggagtgcggtggcgagatctcggctcactgcaagctctgcctcccgggttcacgccattctcctgcctcagcctcccgagtagttgggattatgagtgcctgccactgcacccggctaatttttgtatttttagtagagacttggtttcaccatcttggctgggccagtcttgaactcctgacctcgtgatccacccgcctcagcctcccaaagtgttgggattacaggtgtgagccactgcrcccggcccaaaatctttttgagagctgacacaacactcaaaggaaatactcattggagcattttggatttcagatttttggatctggaatattcaaccaggaagtacaatgcaaatgttccaaaatccaaaaagattcaagacccaaaaacctctggtcccaggcgttttggataagggacactcaatctgtatcatttttataagattcagaaacaagcagtaaaactatattatttagggatacacatatatgtggctttaaaaaagcaaggggccgggcgcagtggcacatgcctgt

SEQ ID NO: 173665 - DNA, 601 bp, Human
cccgggttcaagctattctcctgcctcagcctcctgagtagctgggactacaggcgtgcaccaccacacccagctaatttttgtatttttagtagagagagggtttcaccatgttggccaggttcgtcttgaactcctggcctcaagtgatccacccacctcagcctcccaaagtgttgggattacagcagtgagccaccacgcccggtgggcacacctattgtttttacgatacagaagtcagaagacagttaagctcagtgggtaaataaaagatttggtgagtattcatcagggacayacaccccagcacattggaggactgtagttatatcagaattaaaaagaaaagagtcatcagattttttggttttagattcaaaagagtggtaaaacttgccagattgatcttcccataatgtgtatttcatcatattcatcactcatcactctgattaagatcatccaatggaaccttcccacaatgaattgttatatagcaatgaatgaatgcccagttttcccaccatagatgggtcttggaagcataatgctgaatgaaaaagccaagtcagaaaagacttcaaagagtatgatacaa

SEQ ID NO: 173666 - DNA, 601 bp, Human
acttagcacacctattttttttttaatttttctttcttttttttttattttgagacagtctcattttctttttttgagacagagtctcactttgtcgctcaggcttaagtgcagtggcatgatctcagctcactgcaacctccgcctcccgggttcaagctattctcctgcctcagcctcctgagtagctgggactacaggcgtgcaccaccacacccagctaatttttgtatttttagtagagagagggtttcaccatgttggccaggttcgtcttgaactcctggcctcaagtgatccrcccacctcagcctcccaaagtgttgggattacagcagtgagccaccacgcccggtgggcacacctattgtttttacgatacagaagtcagaagacagttaagctcagtgggtaaataaaagatttggtgagtattcatcagggacacacaccccagcacattggaggactgtagttatatcagaattaaaaagaaaagagtcatcagattttttggttttagattcaaaagagtggtaaaacttgccagattgatcttcccataatgtgtatttcatcatattcatcactcatcactctg

SEQ ID NO: 173667 - DNA, 601 bp, Human
tgaatggaaacagaaatttttaaaaagtttactacttacaattccaaaacaatataataatcttctgcatcaaaaaagtttttaatcttgatgatgcaaggctaagaagagggggagaaaaaagggaaagtagtgagaaactcccaagaggaaaaccacaagagcttagaacatctgcccagagggacagggaggccaagaacaggcatctggccccctgcctcagaggcttggaagttcaatcaggggagaaggcagacagaatctagccaactcctcagtgagaacatgcaagaaattytccaccccaccatgatggtgagagactagttcatatttcatatgcaaggatgctacctgggaatgaaggctaggtctcttcccagtcttcttcctcactaccccagagcagaggtactcaaggacagcctaaggaaccctgagggagactgacaagtagcatgaataaaagctgtcaagtaggagcccagccatgctgccaaacaagggttatttaagctctgggcaactggaacctccaggcaattggaccccatggaacaagatcctaccatttttcaaaggaagaggaaaattctaa

SEQ ID NO: 173668 - DNA, 601 bp, Human
ggaatgcagtggcgcgatctcagctcattgcaagctccgcctcctgggttcacgccattctcctgcctcagcctcccgagtagctgggactacaggagcccaccaccacacccagctaattttttgtatttttagtagagacagggtttcaccgtgttagccaggatggcctcgatctcctgaccttgtgatccgcccgccttggcctccctaagtgctgggattacagatgtgagccactgcgcccggccttttttttttttttttttaattttttgatatggagtctcactctgtggcscaggctggagtacagtggcacaatctcagctcactgcaacctctgcctcccgggttcaagctattctcctgcttcagcctcctgagtagctgaagtaacaggtgtgcgccaccacactcggctaatttttgtatttttagtagagatggggtttcatcatgttggccaggctggtctcgaactcctgacctcaggtgatccacccacctcggcctcccaaagtgctgggattacaggcgtaagccactgcacctggccctggatactttaaataatctctaaaatacttacaaaacctaa

SEQ ID NO: 173669 - DNA, 601 bp, Human
taaaactaataaggtttattcacaatcagatgtcccagttggaaactaaggaatgagatgaaaggattgggcattggaggcacctggggaactttaaaaaatccaattcagtagcttggaagtggggcccaggagttgcttttttttttttttttttgagacagagcctcgctctgtcacccaggttggagtgcagtggtgcgatcttggctcactgcaacctccgcttcccaggttcaagtgattctcatgccttagcctcccaagtagctgggattacaggtatgcaccaccatgcccrgctaattgttgtattttttttagtagagacaaggttttgccatgttggccaggttggtctcaaattcctggcctcaagtgatctgcccactttgccctcccaaaagtgctgggattacaggcataagccaccgcacccagtcaggagtttgcatttttatcacacaccacagatgattctgagactgatgtagaagagcaaacagaattttacaaacagacaaccaggatctgaaccctaactctaccatttcccagcttttggactttgggaaagctatttaacctctctcagcttgtt

SEQ ID NO: 173670 - DNA, 601 bp, Human
acgttggtcaggctggtctcgaactcctgatctcaagttatctacccaccttggcctcccaaagtgctgggattacaggtgtgagccccggtgcccagcaaactttttttttttttcttgagacagagtctcactctgttgcccaggctggagtgcagtggtgcgatctcagctcactgcaacctccctctcccaggttcaaacaatcctcccacctcaacctcccgagtagctgggactacaggcactcacgcttggccttttttttttttttttttttggtatatttttgggtagagasgggattttaccatgttggctaggctggtctcaaactgctggcttcaagtgatctgcccaactcaggctcccaaagtgctgggattacaggcatgagccaccatgcccagcctagtttaacttttaatcatatattcaattgtattctaataggggctgaaacaacttgggatgggaagcaaatatcagaacattcaccaaggaagggtatacaatggataaaagagtttgaccttaagtagttttacctcttcttctaaatctaccacttgctgttccagctcactcattcgagccttct

SEQ ID NO: 173671 - DNA, 601 bp, Human
caccacgttggtcaggctggtctcgaactcctgatctcaagttatctacccaccttggcctcccaaagtgctgggattacaggtgtgagccccggtgcccagcaaactttttttttttttcttgagacagagtctcactctgttgcccaggctggagtgcagtggtgcgatctcagctcactgcaacctccctctcccaggttcaaacaatcctcccacctcaacctcccgagtagctgggactacaggcactcacgcttggccttttttttttttttttttttggtatatttttgggtakagacgggattttaccatgttggctaggctggtctcaaactgctggcttcaagtgatctgcccaactcaggctcccaaagtgctgggattacaggcatgagccaccatgcccagcctagtttaacttttaatcatatattcaattgtattctaataggggctgaaacaacttgggatgggaagcaaatatcagaacattcaccaaggaagggtatacaatggataaaagagtttgaccttaagtagttttacctcttcttctaaatctaccacttgctgttccagctcactcattcgagcc

SEQ ID NO: 173672 - DNA, 601 bp, Human
tcaccacgttggtcaggctggtctcgaactcctgatctcaagttatctacccaccttggcctcccaaagtgctgggattacaggtgtgagccccggtgcccagcaaactttttttttttttcttgagacagagtctcactctgttgcccaggctggagtgcagtggtgcgatctcagctcactgcaacctccctctcccaggttcaaacaatcctcccacctcaacctcccgagtagctgggactacaggcactcacgcttggccttttttttttttttttttttggtatatttttgggtrgagacgggattttaccatgttggctaggctggtctcaaactgctggcttcaagtgatctgcccaactcaggctcccaaagtgctgggattacaggcatgagccaccatgcccagcctagtttaacttttaatcatatattcaattgtattctaataggggctgaaacaacttgggatgggaagcaaatatcagaacattcaccaaggaagggtatacaatggataaaagagtttgaccttaagtagttttacctcttcttctaaatctaccacttgctgttccagctcactcattcgagc

SEQ ID NO: 173673 - DNA, 601 bp, Human
taggccataattatggaaaagcaagctacttaataagtgccacttcatggggtcaagaataacacactgcttccaactactaatactgacttcagcaaagggtgacttgtggctttaatgtagatataattttttttttaaactatcttggccaggctcggtggctcacacttgtaatcctaacactttgggaggccaaggcaggtggatcacctgaggtcaagagttcaaaaccagcctggccaacatggcaaacccccatctctactaaaaaatccaaaaattagctggatgtggtgasgggtgcctgtaatcccagctaatctggaggctgaagcagggagaattgcttgaacctgggaggcagaggttgcagtgagccgagattgcaccactgcactccagcctgggcaacagagtgagactccatctcaaaataatgatgatgataataataataataataatataaaataaaaataaataactatcttgaactggcaggtaataataaaagtggtagtggtgactataaatccaaaataagttaaaaaaaatccctgctcctgactcatgattcttagaagaaccaactaatgat

SEQ ID NO: 173674 - DNA, 601 bp, Human
ttgaatctttgcctggaggaggaaaaatgtttcattgtgcaggaaatgtataaggaagccttacctcccttttctcatctcttgaggacttaaaagtggaaataacaatggttagggaaagatttcagctgtaaagaatggttttctagttttcttgaaatttgtcctgaacattaccttcacagagtaaaactgtgctactgtcaatcttagaccatttgattgttgtcactgaatttgccataatctgtagactaaaactcacataccacccttctcttaccacagaggtatcactatyacaaagaatcctttccctactcattcatattcatcaaagaactactttaattttagtagcgttcaaaatctggtttgagtggctctcttactttggttctccttaatgattgcatggtaatcttgttggctactgcatttgttagtacttgttcttagggagccatgtaacttgttttcattattagatcttagtactgttcactacacacttaaaaaatgagtgtcaagtgcctttaggggaagaacactctgcctgcatgaaaatgtcttaaaactgaaggaaaatttcaagaacgct

SEQ ID NO: 173675 - DNA, 601 bp, Human
ttgaattttctaaatctggcagtcattctaccactgctaatgtaatgcatgtgtgttaatagtaaatgattttctttagcctaaagtagggaaagtgaacagttagtatttgggagcaaagacagtcttcagctactgctgtgacaaatgtgattaaaattaaccatgaatattctgatgctacagctgaggatataccttttcattgtagttgtagtgcagtggcaggttgcatatataaattgtttccagtccataagtgaatttactttacagtgaatccttttttttctttttttttgagatggtgtgagacagtgttttgctcttgttgcccaggctggagtgcagtggcacgatctcggctcaccacaacctctgcctcctgggttcaagcgattcttctgccttaggctcctgagtagctgggattacaggcgcccatcaccatgccaggctaattttgtatttttagtagagatggggtttctccatgttggtcaggctggtcttgaactgctgacctcaggtgatctgcccaccttggcctccccaaagtgcttggattacaggtgtgagccactgagcccggccagtgaat

SEQ ID NO: 173676 - DNA, 601 bp, Human
actgagcccggccagtgaattcctttttaaaacatgagagtaccattaattggtttcactataaatgcagtagagattttaaaaatttctgtagtacttttctagagcaaagattagtgttaaatcactaatactctgtaatattgatgaatatactgtaatatatggaacttggcatacaatagtgtgtattgaccagtgttgatttattcatgtattacttgtcagattttataatgatattttattatattttcttttctatttttattttttgagacggtcttattctgttacccakgctggagtgagtggtgtgatctcagctcacttcaacttctgcctcccaggcgaagtgaacctcccatctcagcctcccgagtagctgggactacaggctcatgccaccacacctagctaactttttgtatttttagtaaagctagggtttcaccatgttgccccggctggtcttgaactcctgggctcaagtgatcctcctgcctcagcctcccacagtgctgggattacatacgagagccaccacacccagcctgattgtacttttcaggaatatgggtgacttaaatgactaaacttt

SEQ ID NO: 173677 - DNA, 601 bp, Human
cataccatcaggatatcttgagtttctttgggatcagaaaactaatttgggaaaggtcttaggagaacaataaaaacgtgtcaaggtaaaggaacccatatccttcctgttgcgccctcctcccaaccccactctgaacttgttttcactttggttgcccctcccaccatcatttttccccttgggttgtccaactctattttacagagtggatgtagatgggaagatgggtggaagtggtaggactaggctgggaaattgaactcatggcagtagtttttcacattgttgaagtccaaarcaggatgaaatgcaattgttactatattaaaataattttgaccggactctggctcatgcctgtaatcccagcactttgggaagccgaagtaggaagaccatttggggccaggagatcaaatgatcatttgaggtcattcgagaccagcttgggcaacatagttggagtctttgtctacagaaaatttaggctgggtatggtggctcatgcctgtaatcccagcactctgggaggctgaggcaggtgaatcacaaggtcaagagattgagaccatcctgaccaacatggtgaaaccccgtc

SEQ ID NO: 173678 - DNA, 601 bp, Human
tgcctgctgaaaccccagcaaagggctaattttgcttctaccatataaactctgtgtgtacttagagtattccagaaagacaaatggataaacgtaatagataccttttaacatgtctatttacatcgattgctgtgtaatcaggagaaacctggttttttgaggtatgaacagaagccaatatttgtaaaggaatgaaagtttaggtctatagtatattaacgcataacactgttttgtattggaattttcaagaaactagactgaaataaccaccaactaaaagctaagtttttttttttagcattagacctatgaatgtttaggctaatgaaatgaaatcattaatgaaaatcactaatgaaaaatattgattgcctgcttaccttcttctagataacaagtactttttgtagttcttcataattttttatttttttatgaaaattttcttattagagaaatataaaccaggacagtgaatgtaagccaagccaatacctaaatatgcttattgttttaaaaaaaaggaaaaagggagaaataaaatatgaaatcttagcccctaaatttagctaccattgatgtctattgactctga

SEQ ID NO: 173679 - DNA, 601 bp, Human
ctgatgggctctaccgtcaagtgattgggccagggctaggctgttttgtttgggagagcaggatcctctagtctctgagatttaagtttttgtaactgtatatgctagttccagcctttccttcctcccactctgtcctcactatattgtacagcttctatgttgcttttgctgatttctttattactcatgtttgatttgaaacaagctgtttgtgggaggaagttttagggattttttgccctccccttccccaaaggagcaattcttttgtatgtgtgtgtcttttttttttttttttcccagaaaactttttgcaagttgttttatttgcaatgccctttgaaaggccacgaaagttaactggattacaaactaggcagaaattgctttacaaaaggagggaaataccaaaatgtcagtttctgtagagaatccacagttcagttttattcagagcaaaaaaaaaaaaaacttttaatcacactagaaaaaactcagcaatagatttggaatctgtactcaaactacacatgcaatgacagtattctgctaatgcagtcgatttgctgttgtatttgtctacttttttatattaata

SEQ ID NO: 173680 - DNA, 601 bp, Human
gctgttgtatttgtctacttttttatattaataattataaactctaaagcagtgcaactagtatttggaacaatctttacagtgtcaggcacatttcacttttcttcacaccattggttctgtgtacgtgggcttcctccccttcagtaaagtcgttttgatattgaaggtcttgggaatgtccacaggtgttttctccttgatcttattggcagcagtcttgcatgtaacaaacctttgataatagcttgcagctagaataaggtcaaagagagttccttggtgaattttcaggaattcytggtcccaaacaggatttttatctcttcatttttcttctcattattctcaggaggaggaggagggtcatctttatgggggggtgcaccactgaatgaccttttaaaatactgcttcattatttggtagaggactgggtcatcatatccttcaatcattcattcccaaatcttccaacgtgatcttgatagtatagattgtttggcaatttctacattaacctcaaatatttcttcattggaactccataactaattgaaggcaggctagaggctgacatgagccgggcagcatcagcaca

SEQ ID NO: 173681 - DNA, 601 bp, Human
aggcacatttcacttttcttcacaccattggttctgtgtacgtgggcttcctccccttcagtaaagtcgttttgatattgaaggtcttgggaatgtccacaggtgttttctccttgatcttattggcagcagtcttgcatgtaacaaacctttgataatagcttgcagctagaataaggtcaaagagagttccttggtgaattttcaggaattcctggtcccaaacaggatttttatctcttcatttttcttctcattattctcaggaggaggaggagggtcatctttatgggggggtgcrccactgaatgaccttttaaaatactgcttcattatttggtagaggactgggtcatcatatccttcaatcattcattcccaaatcttccaacgtgatcttgatagtatagattgtttggcaatttctacattaacctcaaatatttcttcattggaactccataactaattgaaggcaggctagaggctgacatgagccgggcagcatcagcacagaagggaagggtggaggacatgactgctctgtgtatgtttttaaacgtgtgttttctgagcatattttgatgtgtatttttaactt

SEQ ID NO: 173682 - DNA, 601 bp, Human
tactgttattggtctattcagagattcaacttcttcctggtttagtcttgggagagtgtatgtgtcaaggaatttatccatttcttctagattttctagtttatttgcatagaggtgtttgtagtattctctgatggtagtaaccatttttaaatgtaccgttgaatccctttttttcaatatggtgagaaatagggatccaattttatttctgtccctataacaacctagttttttccagcaccatctaagcattctgtcttttccttgttgatgtgtgatgcaaatttcatttcttaawcgattttgttctttgttgtcttaaagcattggataaaatctacagttcattgacgagtagtagaaataacaaacatctaggcttttcctcacttcaatgggaatgctcccaaatttttataattatgatgtttgcattaggctactaatagttattttttaaaatcatgccaagagagtttcttttcatttctacttgaatatttgttttgttcaggaatggcagttgaatgttatcaaatggctttttagaattactgatttctattatttctcccttatatctattaatgtagtaaat

SEQ ID NO: 173683 - DNA, 601 bp, Human
agtagaaataacaaacatctaggcttttcctcacttcaatgggaatgctcccaaatttttataattatgatgtttgcattaggctactaatagttattttttaaaatcatgccaagagagtttcttttcatttctacttgaatatttgttttgttcaggaatggcagttgaatgttatcaaatggctttttagaattactgatttctattatttctcccttatatctattaatgtagtaaatgaatttttaaatgaactttgtgttcctgggctaagccttacgtgactcttttattgtastattggatgaaattagatattttatttagcacttctgaattaatgtaagattggcgtatagttttcttctgtcatgtcgtcctcacttggttttggtttcaagcttttcatgttttccagtaagctccggaacatgaaaattacctgtttttttacaagttgtatagaatttgttcataaaactgtctaggccagggcagattctttttttttttaaactttattgaagcataatgtacacatagattcaatatgtatttcagtaagatacacagcataaatgtacagctcacttaatta

SEQ ID NO: 173684 - DNA, 601 bp, Human
tccctcacccctcatcgcactcctttccccaagtccccaaagtccattgtatcattcttatgcctttgcatcctcatagcttagctcctgcttatgagtgagaatatctgctatttggttttccattcctgagttaattcactaagaataatggtctccaattccatccaggttgctgcaaatgccattatttcatttctttttctggctgaatagtattccatggtgtatatatacaccactcattgattgatgggcatttgggctggttccatatttttgaaattgcgaattgtgctgytataaacatgcgtttgcaagtatcttttcatataatgacttcttttccaactagtgagaggtaggattcccaagaataattgttaccctgtgactttattgtagaatctttattgaagaccttttcatgaaaaaaatctactgtattgaagtcttatgtaaaccataaagcttaatgttttgaaccaccactaattttaagaacattacccaccgggcgcggtggctcacgcctgtagtcccagcactatgggaggctgaggtgggtggattacttaaggccaggagttcgagacctgct

SEQ ID NO: 173685 - DNA, 601 bp, Human
aaagcttaatgttttgaaccaccactaattttaagaacattacccaccgggcgcggtggctcacgcctgtagtcccagcactatgggaggctgaggtgggtggattacttaaggccaggagttcgagacctgcttggccaatgtggtgaaaccctgtctctacaaaaaaataaaaaaattagctggatattgtggtacacgcctctagtccgagctactcaggaggctgaggcaggagaattgcttgaacctgggggtcagaggtcgcagtgagcggaaattgtgccactgcactccaacytgggtgacagagcaagactccatctcaaacaagacaaaacaaaaaaattctcatgcacatttgggttgtttccttttttgctgttatgaacaaactctcatcattccttagtttgctaagtatatgttaagtcatgaaaggtgttaaattatgtaatatactttatctggagagattagttattttttattaatgttgtgtgttacctttttttagatatggtagtgttaaatacccttgcatactgggataaacccaattagtcataatatattttatccattcagtttactgttgggt

SEQ ID NO: 173686 - DNA, 601 bp, Human
agattcagatgagattttgttagctactattaaaattagaaatattttaatattacatttaggagcatatttattatttacgtatcttttaaaattatattttagtagaggttatgtgatattttgatacaggcttctaaatattattgaataaaacctttttcagtgagaaaatcatcactgaggcagattttaccacaaattattttcatgttttaggttgaaatacacataaaatttccgatcagaactctcagttgttaatactttaaacaattagctttatattacctgggacattgtagacccatgagtataacttattttccatatgattcttctaacattttatatagtttccttttttttttctttttcttttttgagacagttttgctcttgttgcctaggctggagtacaatggcacaatctcggcttactgcaaccttcacctcccaggttcaagtgattctcctgcctcagccttccgagtagctgagattacaggtgtgcgccaccacgcccagctaattgttttttattagtagtagagacagggtttcaccatgttggccaggctagtcttgaactcctgacctc

SEQ ID NO: 173687 - DNA, 601 bp, Human
ttattatttacgtatcttttaaaattatattttagtagaggttatgtgatattttgatacaggcttctaaatattattgaataaaacctttttcagtgagaaaatcatcactgaggcagattttaccacaaattattttcatgttttaggttgaaatacacataaaatttccgatcagaactctcagttgttaatactttaaacaattagctttatattacctgggacattgtagacccatgagtataacttattttccatatgattcttctaacattttatatagtttccttttttttttctttttcttttttgagacagttttgctcttgttgcctaggctggagtacaatggcacaatctcggcttactgcaaccttcacctcccaggttcaagtgattctcctgcctcagccttccgagtagctgagattacaggtgtgcgccaccacgcccagctaattgttttttattagtagtagagacagggtttcaccatgttggccaggctagtcttgaactcctgacctcaggtgatccacctgcctcggcctcccagtgtgctgggattatagacgtgagccaccacgcctggactgta

SEQ ID NO: 173688 - DNA, 601 bp, Human
gctctatcaggatgagaattcaacatatagaaaactatggagcagaattttcctgcttgaaggtctccaatataataccaactagtagaaagctgtgtttcaccggtagtagatttgtttttaccttggtatcataatttaagagtttttcttttaagttgcaggtatattaattaattttaggtttctgtgctactcttttcccatccttggaagtctctttacgccagaaattcatttaattcttagtttttgatgatgacacacttaattttatatgttaaagagtttaactgtccamcctttttcagatgctggtgagtgtaataagcgagataatacatccacaatgggtggttttggagttggaaagagttttggaaacagaggtaattacttggttatgatatcttacaatcaaaacttgagtgattttttaataattgagtttaaatactgattgacagacattccatattgacatttaatttcaaggtatatattctgtgagtgcctttgcactaaagattatcttattaaaacttattaaaaacattttttaattttatgaaagattactgatgaatgcttttaaaattaa

SEQ ID NO: 173689 - DNA, 601 bp, Human
tgaaagattactgatgaatgcttttaaaattaattctagagacatgtctgtatgcttcagagatgcataactcttagacataggtttttaggaaataagtttgaaagcaaaacttgacgactttttaaaaaagagtaaacaaaaagaagctaacaagattttcatgttattgaggagaaaatcattgagttattgggttataatttagttgtattgtccttagcagatgaagagattgagtttgtaaaattttgagaattttgatggttttaaatagaaaacatatagtggttacactgayatattcctctgttttgcccatgtgcatacagaggagtatatgacaattgaggtaatacagaattggctgaaaagaaagttgtttttaaccttaagagaatggagttgataaactgacacaaagcagaaattgttgtacagcctgagtgaatttgcatgtgatagctatgtatacaattgtgtatcgcttatcttagaaggcatcataactagtagttcctgtgtggttatcatttttaccacagaggtacaggaaattgtttcattttatattttgtataggtttttcaaacagcaggtt

SEQ ID NO: 173690 - DNA, 601 bp, Human
ggtacaacttttgaatgctctgaaacttaagaaaatggggatagataataaaaagaagtagtcaagaagtgaaacttcactctctatataaatacagtttgtgatgtatagggtcacatttagattcaaataaatctaagaaaaagtttcatgagaatgtaaatcagtgctgaaattaaagacaattccattgaaggtactgacactctacaggaatacagagaatgatgagaatgatgaaaataatgataccagaagatggactacgataaaccagtgcattcccaaatctgattgagtygatttgggtgaggtcttagaacctgtatttaaaagcatccatggtgatcctgatacctcctgtgtttggtaatcattgatgtatgaaatctttataacatagaacactttagggtgccaaacttggcttcatgtctctgccttgctacctgctagttgaagtagaacaagttgcttaatttttctaagccagttttctgttccatagaatggaaggtattcattttataggtggttaggcaggctaagtgagaatgcgtgtaaaagcacacagctgaataccagacacattcatgacaaa

SEQ ID NO: 173691 - DNA, 601 bp, Human
ggaatacagagaatgatgagaatgatgaaaataatgataccagaagatggactacgataaaccagtgcattcccaaatctgattgagtcgatttgggtgaggtcttagaacctgtatttaaaagcatccatggtgatcctgatacctcctgtgtttggtaatcattgatgtatgaaatctttataacatagaacactttagggtgccaaacttggcttcatgtctctgccttgctacctgctagttgaagtagaacaagttgcttaatttttctaagccagttttctgttccatagaatgraaggtattcattttataggtggttaggcaggctaagtgagaatgcgtgtaaaagcacacagctgaataccagacacattcatgacaaacactcagatgtcatccatctatcttcattaaatatttgaagctgatcttattaaacactttgattcccaaagtcaaaaccaagcctagacctgatcaccttaaaacacttttggtataaggccggattttaattatcaaatgagactgtttctccaaactattgccagtctctttctccctacttctctttttttctcctatcccgttcaaa

SEQ ID NO: 173692 - DNA, 601 bp, Human
taatgataccagaagatggactacgataaaccagtgcattcccaaatctgattgagtcgatttgggtgaggtcttagaacctgtatttaaaagcatccatggtgatcctgatacctcctgtgtttggtaatcattgatgtatgaaatctttataacatagaacactttagggtgccaaacttggcttcatgtctctgccttgctacctgctagttgaagtagaacaagttgcttaatttttctaagccagttttctgttccatagaatggaaggtattcattttataggtggttaggcagrctaagtgagaatgcgtgtaaaagcacacagctgaataccagacacattcatgacaaacactcagatgtcatccatctatcttcattaaatatttgaagctgatcttattaaacactttgattcccaaagtcaaaaccaagcctagacctgatcaccttaaaacacttttggtataaggccggattttaattatcaaatgagactgtttctccaaactattgccagtctctttctccctacttctctttttttctcctatcccgttcaaatgaaaacatatatgatgtagaactagtattt

SEQ ID NO: 173693 - DNA, 601 bp, Human
tgcaacaagagctttgggtcactgtttattgtagaacattattagttgttaaatggattgggactttcacacaggaacttagctaataacctgcaagctgtttggtcacttgctgtcattattttgacttaatgttcccagatattaaatattaatgatatgtacaaagatcccttgaaaccatctttgtattcccaaatgtgactttttttggaatcttctggaaagcctgatgtcatagtaataacatagaacttttacatttcgaaaaatcattcctttcagaataaacatttctggraatggggtctaggaatttatttttaaccaactctccaggtagttttcaggcagccttcagtatagtaatctctcatactactattttaaaactctgggaatgttacttactaatatcaaaaatggagaagctaggatatccccaaattatttcattagcatgaatgggggaaagtttgcatatatttaagaaagcacaaatgtcttgagtttattaagaatggtaaattggccgggtgtagtggctcacgcctgtaatcccagcactttgggaggccaaggtgggcgaatcacctgaggt

SEQ ID NO: 173694 - DNA, 601 bp, Human
gagctttgggtcactgtttattgtagaacattattagttgttaaatggattgggactttcacacaggaacttagctaataacctgcaagctgtttggtcacttgctgtcattattttgacttaatgttcccagatattaaatattaatgatatgtacaaagatcccttgaaaccatctttgtattcccaaatgtgactttttttggaatcttctggaaagcctgatgtcatagtaataacatagaacttttacatttcgaaaaatcattcctttcagaataaacatttctgggaatggggyctaggaatttatttttaaccaactctccaggtagttttcaggcagccttcagtatagtaatctctcatactactattttaaaactctgggaatgttacttactaatatcaaaaatggagaagctaggatatccccaaattatttcattagcatgaatgggggaaagtttgcatatatttaagaaagcacaaatgtcttgagtttattaagaatggtaaattggccgggtgtagtggctcacgcctgtaatcccagcactttgggaggccaaggtgggcgaatcacctgaggttcaggaat

SEQ ID NO: 173695 - DNA, 601 bp, Human
atgtacaaagatcccttgaaaccatctttgtattcccaaatgtgactttttttggaatcttctggaaagcctgatgtcatagtaataacatagaacttttacatttcgaaaaatcattcctttcagaataaacatttctgggaatggggtctaggaatttatttttaaccaactctccaggtagttttcaggcagccttcagtatagtaatctctcatactactattttaaaactctgggaatgttacttactaatatcaaaaatggagaagctaggatatccccaaattatttcattagsatgaatgggggaaagtttgcatatatttaagaaagcacaaatgtcttgagtttattaagaatggtaaattggccgggtgtagtggctcacgcctgtaatcccagcactttgggaggccaaggtgggcgaatcacctgaggttcaggaattcaagaccagcctggccaacatggcaaaaccgcatctctcctaaaaatacaaaaattagccaggcatggtggcgcatgcctgtaatcccagctactcggtaggctgaggtggggataatcgcttgaacccgggaggcggaggttgcagtga

SEQ ID NO: 173696 - DNA, 601 bp, Human
tagctttgtaaacaacagaaatttatttctcacagttctggagagtcagaagtctgagatcaaggcaccagcagattcagtgtctggtgagggcccatttcctggttcatagatggtgtcttctctctgtgtcctcacatggtggataaggccaggcagctctctggggcttcttttataagaacactaattccattcatgagggctctactgttgtgtggttacatcacatttgtttattcttcagctgatgaatgtttgagttgtttccacttttgggctatcatggctaatgctgccrtattcatttgtgtacaagtttttatgtgaacctgtgttttcatttttctggagtatatacttaggagtggaattgctgtgtcatgtgctaactcttaatgtttaactttttgaggaactgccaaattattttctatagtagctgtaccattttatattaccactctcaatgttatgagggttctgatttctccacatccaccgatactagttattactggtgtttttttaattatagccattctactgagtatgaagtggtatctcattgtgggttttttgtttttttatttttttgaga

SEQ ID NO: 173697 - DNA, 601 bp, Human
agtgaattaaaatactagcaaatgaaaagactgaaattcttgccagctcagttgaaaggaaaaatatttcttaataagtaaaatgaagggtaatcagagaagggataagataaaatgtgtaacttgctgatggaggaaatccaatagaaggacagagctttgtaggaaggaaggtagattgaaaatagtttatttcctaaatattcgtggtgaaaattggtaaaaataaaatacatagctttaccatttggggaaaacaggacagaaaggagaacaaaaagcatcgaaaaaactctgtaargagaaaacacaaagattgtagaaataaaagacctatgtatcagtaatcataatataggtaagcatatttcaatatggagttgaaagtaaagaggtcaggcatggtggctcatgcttgtaatcctagcattttggcaggccaacatgggagggatctcttgaggccaggaattcaaggccagcctgagcaactaaatcttgtctctacaaaaaaaaattttttttttaaattagaaaataggctatggccataccaccctgaacgtgtccgatctcgtctgatcttggaagctaagcaggg

SEQ ID NO: 173698 - DNA, 601 bp, Human
atggtgatacttctcaaagcagaagtggcagtggaagtgaacgaggtaagttcttattttgtttacccgaaagaagttaaaatcattgtattccaaatttaatttttttctgtacttcactggttggaaacaaatttaatttttgaagttaaaggtaactgttattgcttttatacactgtgaggaccataaatttacacagcctgttttagatagttccttaataccctccaggttattgcctctctgatccagcaattccattataggaattatatactatagatgtatttggaaatamatgtacaaggatgttcactgagatgtcatttataataagtaaaaactgaaaatcacctaaaattcataaataaaaaactgtttaagtccgggtgcggtggctcatgcctgtaattctagcactttcggaggcctaggcaggcagatcagaaggtcaagatgagaccatcccggccaacatagtgaaacccccgtctctactaaaacaaaacttagctgggcatggtggtgtgtgcctgtagtgccagctactcaggaggctaaggcaggagaatcgcttgaatccgggaggcggaggttg

SEQ ID NO: 173699 - DNA, 601 bp, Human
caactcatcatttacattaggtatttctcctaatggtatcccttcccctgtcccccaccttccaacaggccctggtatgtgatactcccctcctcgtgtccatgtgttcttattgttcatctcccacttatgagtgagaacatacagtgtttggttttctgtccttgtgatagtttgctgagaatgatggaaccagggaagttgatggtgtaactctcagttcaaggccaaagacctgagaacctcttggtggggcggagtcagggggcgggggattgctggtacaagtcctagagtccawaggccagagaacctggagttctgatgtccaaggacaagagaagaagggtgtcccagctccagaagagagagaaaatttgcctttcctctgcctttttgttctgtctggcccctagcctattggatggtgcctgcccagattggatgagggtcgatcttcttactctgtccactgatacaaatgccagtctattctaaaacaccttcacagacatacccagaaataatggtttatcagctacctgggtatcccttaatctggtcaaattgacaccgcaaattaaccatcacagctagcatc

SEQ ID NO: 173700 - DNA, 601 bp, Human
ggttttgcctatgtgccttttcttctgctgatagtactccctattttttcactaataaatcataaccatgagtatgactatattctgagtctggtgagtcttcctagcaactactgaactgggaatggtcttggggacacccctccaacacaggttcttttagaaaatacattcctttgctgattaggaaagaaatataacagtttaaacaaagtgtagtaatatgtaatagtctcctctacgtaaaatcatcttgaatactacagaaactaaaaatgtacaaggttctatttaattgttycaagtatttgtaagaagggaatttaaagttttttggaacttgttctctttgaagacaagcaacgaaaataaagatgtgcacagccttacatcttgaccgattgtcacttatgaatttctttaataggtggttacaaaggtttaaatgaagaagtaataacaggctctggaaagagtaagttttccttaaacaaggtgtttgatttttatagtgagagttcttttacctttcaattttaaaaaacatgtatctcttttttatttgatcctcttcaagattcttggaagtcagaagcagaag

SEQ ID NO: 173701 - DNA, 601 bp, Human
cttatttcataataagaactgatttttaatgacttttaaattgcccatgtgtatacattttatttctctgttctgaggtatttaggttctttctaacttggggctattgtaaacaaaattgcaatgtacatcttgctacatagtttttctgttttggccagatatgatgtcttacacctgtaatcctagcactttgggaggccaagatgggcagatagcttgagcccaggagttcaagaccagcctggaaaacatggtgaaaacccatctctacaaaaaagaacaaaaactagctaggtgyagtggtgcacccctgtagtcccagctacttgggagcctgagagattacctgagcctgggaggtcgaggctgcagtgagctgtgattgcgccactgcattccagcctagatgacagtgagaccttgacttatatataaaaaaaaccaacagttttctgttttaagtattttcttagaatagagttttatcaattttaatgttaaagagcaggaacttattttaaagcttgtaattaatgtatatttgtgcctgcagtctatcagaagtccaatttcagtataccctttgccaacatttagt

SEQ ID NO: 173702 - DNA, 601 bp, Human
tgcccaggaatgccatcaaaggaacagcgccaaacccttatgttcagtgcaacttttccagaggaaattcaaaggttaagtttttttcttaaaaataatttaattatatatatatacatacttttatcaaagtggaagcactgtgaatatcctatttttagagatttgtcgttaagattttaatataggtagtttaaaaagtagatgtatttctaaaacgtttgccacattttccattgtttcttacctttattcctggctttgtgttaacatcacattttatttaaaaagtgtgtgtgtktgtgtgtgtgtgtgtgtgtgtgtgtgtgtgtgttgttgttgttgttgcatagaatccagctagggtttaataagtgcttactaaattaagttatttttattattatgccttcttttcaaacctaaatctataggatttgggagaactgaggctttggtagaaaattcatataccaattattggcagatatttgaggatcatgttatataccatggggtctaatgaattcagagattagggtgacacatccctactggaatggtgactctttttcctgccagccccttgtctcaaggagcc

SEQ ID NO: 173703 - DNA, 601 bp, Human
ccaaacccttatgttcagtgcaacttttccagaggaaattcaaaggttaagtttttttcttaaaaataatttaattatatatatatacatacttttatcaaagtggaagcactgtgaatatcctatttttagagatttgtcgttaagattttaatataggtagtttaaaaagtagatgtatttctaaaacgtttgccacattttccattgtttcttacctttattcctggctttgtgttaacatcacattttatttaaaaagtgtgtgtgtgtgtgtgtgtgtgtgtgtgtgtgtgtgtgtgtgttgttgttgttgttgcatagaatccagctagggtttaataagtgcttactaaattaagttatttttattattatgccttcttttcaaacctaaatctataggatttgggagaactgaggctttggtagaaaattcatataccaattattggcagatatttgaggatcatgttatataccatggggtctaatgaattcagagattagggtgacacatccctactggaatggtgactctttttcctgccagccccttgtctcaaggagccagaagtgcccaggcaacagcagaagctta

SEQ ID NO: 173704 - DNA, 601 bp, Human
tgttcagtgcaacttttccagaggaaattcaaaggttaagtttttttcttaaaaataatttaattatatatatatacatacttttatcaaagtggaagcactgtgaatatcctatttttagagatttgtcgttaagattttaatataggtagtttaaaaagtagatgtatttctaaaacgtttgccacattttccattgtttcttacctttattcctggctttgtgttaacatcacattttatttaaaaagtgtgtgtgtgtgtgtgtgtgtgtgtgtgtgtgtgtgtgtgtgttgttgttgttgttgcatagaatccagctagggtttaataagtgcttactaaattaagttatttttattattatgccttcttttcaaacctaaatctataggatttgggagaactgaggctttggtagaaaattcatataccaattattggcagatatttgaggatcatgttatataccatggggtctaatgaattcagagattagggtgacacatccctactggaatggtgactctttttcctgccagccccttgtctcaaggagccagaagtgcccaggcaacagcagaagcttatacagatgggt

SEQ ID NO: 173705 - DNA, 601 bp, Human
tgcaacttttccagaggaaattcaaaggttaagtttttttcttaaaaataatttaattatatatatatacatacttttatcaaagtggaagcactgtgaatatcctatttttagagatttgtcgttaagattttaatataggtagtttaaaaagtagatgtatttctaaaacgtttgccacattttccattgtttcttacctttattcctggctttgtgttaacatcacattttatttaaaaagtgtgtgtgtgtgtgtgtgtgtgtgtgtgtgtgtgtgtgtgtgttgttgttgttgttgcatagaatccagctagggtttaataagtgcttactaaattaagttatttttattattatgccttcttttcaaacctaaatctataggatttgggagaactgaggctttggtagaaaattcatataccaattattggcagatatttgaggatcatgttatataccatggggtctaatgaattcagagattagggtgacacatccctactggaatggtgactctttttcctgccagccccttgtctcaaggagccagaagtgcccaggcaacagcagaagcttatacagatgggtcctatgg

SEQ ID NO: 173706 - DNA, 601 bp, Human
ttgttgttgcatagaatccagctagggtttaataagtgcttactaaattaagttatttttattattatgccttcttttcaaacctaaatctataggatttgggagaactgaggctttggtagaaaattcatataccaattattggcagatatttgaggatcatgttatataccatggggtctaatgaattcagagattagggtgacacatccctactggaatggtgactctttttcctgccagccccttgtctcaaggagccagaagtgcccaggcaacagcagaagcttatacagatgggtcctatggttcaacataagattttatgatttttttactttataatggtttatcataggtattaattgcatttttgacttaagatattttggacttaaaataggtttatcgggatgttaaccctgttgtaagttgggaaccatctgtaattcagcaggactcttgctattttctctagtggaactgcgttctctttgggaaccaagacgtcaaaacctgtagaacataaagttggaggacaagaagggatgggaagcatagatttccctagtgggtcattgagagtgatggtaggtgggcc

SEQ ID NO: 173707 - DNA, 601 bp, Human
taagttgggaaccatctgtaattcagcaggactcttgctattttctctagtggaactgcgttctctttgggaaccaagacgtcaaaacctgtagaacataaagttggaggacaagaagggatgggaagcatagatttccctagtgggtcattgagagtgatggtaggtgggccagtagtgcttgctctcctggattcccagactcatgcaccatatatggatatttgatttgaggaattaccgtgtcatgttggataatgccctgtcttcataaagagttgcctccaaactcacccttgarctgttttttctgcagacagttccaatgttccaatgttctctcaggttggcagcttctgagtggtgcagtatatatattacctgtgaatcctatggttatgggcctgtcccaacacctcttttgctttaaagttggtcccctggtttgatagaatgttacatgggatcctgtgctagtatatcaaacattcccaaacccttgaatagtggtgctggctattgatttattttttatatggtaaatctttgtgtaaagttaggaagagttctttattgggggaaaatagaactcataagacag

SEQ ID NO: 173708 - DNA, 601 bp, Human
ttgtcccccaggctggagtgcaatggcgcgatcttggctcactgcaacctcaatctcccgggttcaagcgattctcctgcctcagcctcccaagtagctgggattacaggcgcctgccaccacgcctggttaatttttttttttttttttgtatttttagtagagacggggtttcaccatgttggccaggctggtcttgaactcctgacctcaggtgatctgcccacctcagcctcccagagtgctgggattacaggcatgagccaccacacccagccctatatagtattttcaggtggaratggggtatttgcattcccaccatttgctttggtaactatctaattagcagcctgactctttttagattcaccctgaaatgggaaagtatttgtatgttggccacccaaaatggcaaacgtactattgtcagtcagtaatatttgtcgaggatcttttgtgaatcatatttgattataagctctggggatatatgttaaacaaaataagctcctatctgaccttgagttgtttacattctttgcttcctgactctccctcagttgcttcattttatctgttcttaaatgttaccagttgc

SEQ ID NO: 173709 - DNA, 601 bp, Human
aaggactcagctggtaaataagggactgctacataggagggagaggcattgaagagagatttgggcctccccatttatccctaaaaactcatctttctcattagcaactttgtccactcccctatatttctatgtgatctaaagcaagacttctcaattgcagctgatagtgagttaactgtgtgtcaagatattgatacccttaacctttggggcaggcacacctatcctgattccgctatgtccctgggcctttcatctcgtctcacttgttttgcccaattgtgctatgcaaatactmctttctatgtgtgtcgtgacagacagagcactgacctaagatctggtttgcttgaaatcattcatttgaagtagagtaatttaataggtaatattttcagaaaacaactaataatagcataaataaaagcaatgagtggagaacagaatttgtgtctcaggcttacatttcaggttttactaaaaaataattcctgcttattgcagtttatttcttttagttcatgcttttttttaagtgttatacacatattttatatagttttgcgtggatagcaaatccacttgtaattaccatatc

SEQ ID NO: 173710 - DNA, 601 bp, Human
agacagagcactgacctaagatctggtttgcttgaaatcattcatttgaagtagagtaatttaataggtaatattttcagaaaacaactaataatagcataaataaaagcaatgagtggagaacagaatttgtgtctcaggcttacatttcaggttttactaaaaaataattcctgcttattgcagtttatttcttttagttcatgcttttttttaagtgttatacacatattttatatagttttgcgtggatagcaaatccacttgtaattaccatatccatactttgacaaactttttytctagtagttatgtattttgcaaaatcctaatattttatactgatctttcacaatagtacttgggtgatataagtaaccaaccatcttatagctgttataatctgctgtctgattaatattgagataacacctacaggaattcagtggatattatggatactgatggagaggaggataagttaaagaataatcttttgtttttcaaggttggctgcagagtttttaaagtcaaattatctgtttgttgctgttggacaagtgggtggagcatgtagagatgttcagcagaccgttctcca

SEQ ID NO: 173711 - DNA, 601 bp, Human
ttgctttattgccaaggctggagtgcagtagcatgaccatggctcactgcagcctcaagctcccaggctcaagcagttcttccacgtcagtcccctgagtagccgggactacaggcgtgcaccaccatgcccaaccagttttttagtttttgtagagatggggtttttaccatgttgcccaggctggtcttgaactcctgggctcgagtgatccactcacattggcctcccaaactgctgggattacaggtgtaagccaccattcctggcccaatttttatttttgaagtcattttttttrgttcggttgtttagccttattttgagactggaagcaaaaattttaaatatgttcattttaataccttctcattacctcataggctaggtctacttacatgttacactttctccatccacaccctccattttagtacttgcgtttcagcttgaatgtcagtgttgagagagaaatgcgaaggtggttcatcagctaatttccaataatgagcaaaaagaaaaaatggaaaggtgacttaaaaagcacttacaggcttctggtctttaatttgtcctaagttttataaaaacttttaaaaac

SEQ ID NO: 173712 - DNA, 601 bp, Human
gtcattattcaaatgcaataatcacatttcaggggaaaactttatttgcatttttactgagaatcattggcattgctatccattgcaacagttatgaaaaagaatatagaaggcacaaagagtgtgctagacagtaatcttttttgcttacttcaaattcttccataattttttctgacagcctgtgtctacctcatgaccataataatctcagagatagtcttgatgacaagaagtttggtcttatgtttggcttgcttattggcatgggtgcagcaagattgttcattaacaataaatrggcctccttaagtttgctgaacagtattgacttactaaagtcacaaaattaacttttgtctggaagttttcataaggaatgtcagattgaactttaaaaatcctttattatttgctatctaagggataggaaactaagtctcagaaactctctctactaggtttcacctgcagtacctataaattggagtgaatctcactctacgaaaggtcccccatatttcctgtggttcctgtcctgtcaggaagtgtatgaccttccttaaaatctccaaggctgggccatgtaagccaagcacca

SEQ ID NO: 173713 - DNA, 601 bp, Human
gaagttttcataaggaatgtcagattgaactttaaaaatcctttattatttgctatctaagggataggaaactaagtctcagaaactctctctactaggtttcacctgcagtacctataaattggagtgaatctcactctacgaaaggtcccccatatttcctgtggttcctgtcctgtcaggaagtgtatgaccttccttaaaatctccaaggctgggccatgtaagccaagcaccaggtcagcttatatgggaggtctttgtaggcattggttccataaggaaagccaacctttgttcyttaaaaaaaagtatctggtcctacctaccattccattttcaaatacgaaatccaggtgagatgttagttggacaggtaacttgtccacttatatcttggttaaaggaggcagacagattcttatttaactgttgcaggtaactaccatgaaaactaaggagacttagttaagaaatctgaatttgggttgggatggggtgtcagtgagatgcgagatcagatatgattttagaatgtttgattttagtttacaaaagcagagtctactaaaatgtgtaaatgacagctagcttaagagga

SEQ ID NO: 173714 - DNA, 601 bp, Human
caggtaacttgtccacttatatcttggttaaaggaggcagacagattcttatttaactgttgcaggtaactaccatgaaaactaaggagacttagttaagaaatctgaatttgggttgggatggggtgtcagtgagatgcgagatcagatatgattttagaatgtttgattttagtttacaaaagcagagtctactaaaatgtgtaaatgacagctagcttaagaggaaaaaagccttcttcatatatccagaaaatagaatattaaaataatattaacagtattgcaaacaaatggccayagagagatattctccataagctcattcagtccttatgtaattcttatttcattgtatatgttagggatcagcttgcatgattctgtctgtttctagaaggactagtcctggaaatctcactcagtccagtgatagggtctaaaagttgtcaaagcagtcaactttagaaccttctacccaagactctattctttgaagtattaatagttcttcacaaggcttggagtctgtcctttaggacatagactctgatctatagcttacagcacagcctttgggcaagcatctaaagaaaacaaa

SEQ ID NO: 173715 - DNA, 601 bp, Human
taagaaatctgaatttgggttgggatggggtgtcagtgagatgcgagatcagatatgattttagaatgtttgattttagtttacaaaagcagagtctactaaaatgtgtaaatgacagctagcttaagaggaaaaaagccttcttcatatatccagaaaatagaatattaaaataatattaacagtattgcaaacaaatggccacagagagatattctccataagctcattcagtccttatgtaattcttatttcattgtatatgttagggatcagcttgcatgattctgtctgtttctaraaggactagtcctggaaatctcactcagtccagtgatagggtctaaaagttgtcaaagcagtcaactttagaaccttctacccaagactctattctttgaagtattaatagttcttcacaaggcttggagtctgtcctttaggacatagactctgatctatagcttacagcacagcctttgggcaagcatctaaagaaaacaaaagctgtctgaagatgacagatttaatgatcatggtaaatttgttaccggtaattgttaaatattgagggtctgaggaaggttcatgataagaataa

SEQ ID NO: 173716 - DNA, 601 bp, Human
cagacctctttagaggatcttggagactctgggaaagacttactttgtcataaagtgtcagtttgttccagaacattgaaaaagcacaatgaaagacaaaatgggaactgagttcacctgtagatgtagaatagggtccagacatttatatttttacagaatgccatgtgtaagtctgatgtacatccctagtgaagaaccactgaagaagatgttagattcaagttaggaaagaggtaaggttagagacgttttaaaaagtgaaattatgactggcaacactgtactattgcatcaggcmgcataccttcaagactttgataaatatagggaaactctatagaattactttatagaattttgagcagtgtttctcctgagggtaaaagtatactttggatggtgagagaacttacaaatcatgagggactcccgtaaagcatacacacacacacacaaaaaatagaggccgagtatcacttatccaaaatacttgagaccagaagtgcttcatattttttttttctttttttggagacggagtttcgctcttgtcgcccaggctagagtgtgactgcgtgatcttggctcactgcagcct

SEQ ID NO: 173717 - DNA, 601 bp, Human
tttgagcagtgtttctcctgagggtaaaagtatactttggatggtgagagaacttacaaatcatgagggactcccgtaaagcatacacacacacacacaaaaaatagaggccgagtatcacttatccaaaatacttgagaccagaagtgcttcatattttttttttctttttttggagacggagtttcgctcttgtcgcccaggctagagtgtgactgcgtgatcttggctcactgcagcctctgtctcctgggttcaagcgattctcctccctcagcctccccagtagctgggatttcakgcacctgccatcacgcctggctaatttttgtatttttagtagagatggggtttcaccacattggccaggctggtctagaactcctgacctcaggtgatccgcccgccttggcctcccaaagtgctggaattacaggtatgagccaccatgcctagccatgtttcggattttttttaattaacttttggaatatttgcagtacgtttatcacttgatcatccctaatccaaaactctgaaatgctccagtgagcatttcctttgagcatcatgtcagtactcaaagagtttgggattttgg

SEQ ID NO: 173718 - DNA, 601 bp, Human
gggctctctctgagaaatctcaaaagttttctgggtgaatttcttcttctaaatttttaatttgatcttaaaaagacaaaaggagttgtcagaggagagttgaatatttgattagtgtaggattcgtgggtatcagaaaaactatttggttatcaatttaattgaagtgacaaaacatttagaagtaaacatagaaagtgacatggttgtaaataaccacagctctttcataaatagggaaccttttctctttagtctttttttcttctttttttcccttctttagtctttttttttttttaaacagacctaataaagtcaacagaatctctgctgtctaggctgattacaaggaaggtaaagaataactttttatccagtgtaatggctctgaggaaaaaaaactctcataagcgaaagcattaaacagtaaattaagaaagtaattccatacaaactgagtgacctttgctagaatattaacaccttttatagcttattttaacccaagtgttttaaatcaaagcagataaaattcagtttccaagttttatctttcattgtgctttttcagttttctggaacaaactgacattttagg

SEQ ID NO: 173719 - DNA, 601 bp, Human
aaatttgaatagaattcctttaagagactttgtaatttaatgtgttaatacttccgtaggggccgggcgcggtggttcacgcctgtaatcccagcactttgggaggccgaggcgggcggatcacgaggttaggagattgagaccatcctggctaacacggtgaaaccccgtctctactaaaaatacaaaaaaaaattagctgggtgtggtggcaggtgcctgtagtcccagctactcaggaggctgaggcaggagaatggcgtgaacccgggaggcggaggttgcagtgagccgagattgygccactgcactccagcaagccgagattgcgccactgcactccagcctgggcaacagagcgagactgcgtctcaaaaaaaaaaaaatgcatttctcagaggcttagacttgtctttcactcttccttaagctcttttcctagatacctgcacagttcactatctttatatctttactaagataccatctaattggggtatctaaagtaggcctgtctaataagcctgtcttaaagtatctaaagtaatcatctctggaccctttatcttgctgattttttcctttttagtactaaatgcgt

SEQ ID NO: 173720 - DNA, 601 bp, Human
tgaaagtagacattttatgcatgtgtatataacaagtaaacttttccaatatttaatactttatgttgcatatgaagtcaattttttttaaaggctcaacaggatgttcctgcatggttggaagaaattgcctttagtacatacattcctggcttcagtggtagtacaagaggaaacgtgtttgcatcagttgataccagaaaggttagtagaaaggaaaacttgagaacttgtcttctagttactctttgtaaatgttgtgcttaatattgtgaagtaactataatatttaataatcaarccattgttttcgtgcctggaaggtagctactttattatttcattaacattttatgtatatacatatttttggttttaaaggtcaggaattaactttgagatttatgcctaaacagtctcctttcccagattttaaattttaatttggaatcttttaaacttctgatggaattatttaatttttgaattctgacaacattaattaatataaaatacaggacctgttggggttacaagtcttttctttttcttttctttttttttttttttgagatagtgtctggctctgttgtccaggctg

SEQ ID NO: 173721 - DNA, 601 bp, Human
aaacaatgagcatgttaattaaatatttatgctgattcattgagtgtagtgcattaagttttccccacttgtcaaaactattgacttaaaaaatatttttcttgaaacattttgtgcaatttagatttcctcatttgacaggagccttttttcaggtgaatcagatttagtgagaataaagttctttgattatttggggaagacatggtagatactttgagtccttgctctcagtctgagtgatgtaactttaaagctgtcataaaattaaatgtttgtttgtttctttttttttttttttaaataattaccagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaa

SEQ ID NO: 173722 - DNA, 601 bp, Human; identical to SEQ ID NO: 173675

SEQ ID NO: 173723 - DNA, 601 bp, Human; identical to SEQ ID NO: 173676

SEQ ID NO: 173724 - DNA, 601 bp, Human; identical to SEQ ID NO: 173677

SEQ ID NO: 173725 - DNA, 601 bp, Human; identical to SEQ ID NO: 173678

SEQ ID NO: 173726 - DNA, 601 bp, Human; identical to SEQ ID NO: 173679

SEQ ID NO: 173727 - DNA, 601 bp, Human; identical to SEQ ID NO: 173680

SEQ ID NO: 173728 - DNA, 601 bp, Human; identical to SEQ ID NO: 173681

SEQ ID NO: 173729 - DNA, 601 bp, Human; identical to SEQ ID NO: 173682

SEQ ID NO: 173730 - DNA, 601 bp, Human; identical to SEQ ID NO: 173683

SEQ ID NO: 173731 - DNA, 601 bp, Human; identical to SEQ ID NO: 173684

SEQ ID NO: 173732 - DNA, 601 bp, Human; identical to SEQ ID NO: 173685

SEQ ID NO: 173733 - DNA, 601 bp, Human; identical to SEQ ID NO: 173686

SEQ ID NO: 173734 - DNA, 601 bp, Human; identical to SEQ ID NO: 173687

SEQ ID NO: 173735 - DNA, 601 bp, Human; identical to SEQ ID NO: 173688

SEQ ID NO: 173736 - DNA, 601 bp, Human; identical to SEQ ID NO: 173689

SEQ ID NO: 173737 - DNA, 601 bp, Human; identical to SEQ ID NO: 173690

SEQ ID NO: 173738 - DNA, 601 bp, Human; identical to SEQ ID NO: 173691

SEQ ID NO: 173739 - DNA, 601 bp, Human; identical to SEQ ID NO: 173692

SEQ ID NO: 173740 - DNA, 601 bp, Human; identical to SEQ ID NO: 173693

SEQ ID NO: 173741 - DNA, 601 bp, Human; identical to SEQ ID NO: 173694

SEQ ID NO: 173742 - DNA, 601 bp, Human; identical to SEQ ID NO: 173695

SEQ ID NO: 173743 - DNA, 601 bp, Human; identical to SEQ ID NO: 173696

SEQ ID NO: 173744 - DNA, 601 bp, Human; identical to SEQ ID NO: 173697

SEQ ID NO: 173745 - DNA, 601 bp, Human; identical to SEQ ID NO: 173698

SEQ ID NO: 173746 - DNA, 601 bp, Human; identical to SEQ ID NO: 173699

SEQ ID NO: 173747 - DNA, 601 bp, Human; identical to SEQ ID NO: 173700

SEQ ID NO: 173748 - DNA, 601 bp, Human; identical to SEQ ID NO: 173701

SEQ ID NO: 173749 - DNA, 601 bp, Human; identical to SEQ ID NO: 173702

SEQ ID NO: 173750 - DNA, 601 bp, Human; identical to SEQ ID NO: 173703

SEQ ID NO: 173751 - DNA, 601 bp, Human; identical to SEQ ID NO: 173704

SEQ ID NO: 173752 - DNA, 601 bp, Human; identical to SEQ ID NO: 173705

SEQ ID NO: 173753 - DNA, 601 bp, Human; identical to SEQ ID NO: 173706

SEQ ID NO: 173754 - DNA, 601 bp, Human; identical to SEQ ID NO: 173707

SEQ ID NO: 173755 - DNA, 601 bp, Human; identical to SEQ ID NO: 173708

SEQ ID NO: 173756 - DNA, 601 bp, Human; identical to SEQ ID NO: 173709

SEQ ID NO: 173757 - DNA, 601 bp, Human; identical to SEQ ID NO: 173710

SEQ ID NO: 173758 - DNA, 601 bp, Human; identical to SEQ ID NO: 173711

SEQ ID NO: 173759 - DNA, 601 bp, Human; identical to SEQ ID NO: 173712

SEQ ID NO: 173760 - DNA, 601 bp, Human; identical to SEQ ID NO: 173713

SEQ ID NO: 173761 - DNA, 601 bp, Human; identical to SEQ ID NO: 173714

SEQ ID NO: 173762 - DNA, 601 bp, Human; identical to SEQ ID NO: 173715

SEQ ID NO: 173763 - DNA, 601 bp, Human; identical to SEQ ID NO: 173716

SEQ ID NO: 173764 - DNA, 601 bp, Human; identical to SEQ ID NO: 173717

SEQ ID NO: 173765 - DNA, 601 bp, Human; identical to SEQ ID NO: 173718

SEQ ID NO: 173766 - DNA, 601 bp, Human; identical to SEQ ID NO: 173719

SEQ ID NO: 173767 - DNA, 601 bp, Human; identical to SEQ ID NO: 173720

SEQ ID NO: 173768 - DNA, 601 bp, Human; identical to SEQ ID NO: 173721

SEQ ID NO: 173769 - DNA, 601 bp, Human; identical to SEQ ID NO: 29336

SEQ ID NO: 173770 - DNA, 601 bp, Human
aaaggctggagttgccaagttggagatgttctaactacaagaaccaatgcaggcctgtggcttggtttcttttgagcagccactcccatgggaacaggtgtctgacttgagccatcttggagcggagcctccatgaatgcattccagcaaaggagactggggcaagaaaatgtgccccagggcatggattgtaatctgtcatggatctcatagacccctttgagaagccatggaaagctataaactctctccccaggaaaatatacctatctattggtgctgacacacacagttttccagmgatttgtggctgacactagggtaagaagcaatgtgctatggccttagaggggaagcctgctgactgcaaaagatcctggcagtgggtctgcataaatagtttggatttggggagaagctttgtgtttagtactttgtctccttttccctgtgacagcagcagatgaggcagagaaggtgagcaggggcccaagggaggttgcagtgcgcagggaagggaagtcccatcagagagtcttgaacgggggactcaggaccttccggagcagatgacttgtcaagatgttagttccttctgtgt

SEQ ID NO: 173771 - DNA, 601 bp, Human
aaggaacataatctctctgagcctcagtgttgtcttctgcaaatcaagtgctaacctctcagatttggggagggccacaagtaaacgaggtcatgtatgtggcttgcaaataaatgtgagctctactcccttaaaatgtcaagaatgaacacaacttctccataaaaatcagagaatgctccgccttgttcgggaggggtggtagaaagtgggcagaggataagaactaaaataacagtcataacctctctgtcttattaagtacctttgcattttgttccccatttcactccatagagcrtttcctgaatgaagcagattaagttacagttttctgattagcatgtttttaaaacaatagcttctcctttcttttccgtcaactgtgctcagacacctatcttagctctgtattaagttgccaagtgactcacttctgaaagggttttcttttcaaatcatgacttgtgtgtgtgtggtggttgtaattacaaattgttgtcaagcccctacatcatttgatggcttgttggtgtctgaggccgagacacagcagaaataccacaggtctagagaaaggcaggagaaatcatcggaggcc

SEQ ID NO: 173772 - DNA, 601 bp, Human
ggaacataatctctctgagcctcagtgttgtcttctgcaaatcaagtgctaacctctcagatttggggagggccacaagtaaacgaggtcatgtatgtggcttgcaaataaatgtgagctctactcccttaaaatgtcaagaatgaacacaacttctccataaaaatcagagaatgctccgccttgttcgggaggggtggtagaaagtgggcagaggataagaactaaaataacagtcataacctctctgtcttattaagtacctttgcattttgttccccatttcactccatagagcgtytcctgaatgaagcagattaagttacagttttctgattagcatgtttttaaaacaatagcttctcctttcttttccgtcaactgtgctcagacacctatcttagctctgtattaagttgccaagtgactcacttctgaaagggttttcttttcaaatcatgacttgtgtgtgtgtggtggttgtaattacaaattgttgtcaagcccctacatcatttgatggcttgttggtgtctgaggccgagacacagcagaaataccacaggtctagagaaaggcaggagaaatcatcggaggccca

SEQ ID NO: 173773 - DNA, 601 bp, Human
aagcttgagtttcccagatcctgctcctctctctttctttgattcttttattctttttttttttttttttttgtagagactggtttttgctattttgcacaaagctggtgttgaactcctgaccttaagtgatcctctagccttggcctctcaaagtgctgagatgacaggtgtgaagcatcatgcctggcccccatactatctagaactcttcctcttgaccaatgtgcattgtctgcctggttctgccttactgcacttctctggttattgctcagaaatgctgtggatattgacttaycggaccaagtttgggatgggcaagtgaccaggctcagcatccgattaattcaagcatccacacctgcatgggctccaggaccaaacaaggtcttggacaggaagatgggagccactcttttcaaagcctccagaatgccagtctctttcgggcctaggagagactgaagaggcattcctccctcttactgccatctacacggtcttagggaaaggggagggactgattttcactgcaaattctcatagatttttttttaactgatctgaagcacaaatccaactcattacctttagcggt

SEQ ID NO: 173774 - DNA, 601 bp, Human
agcagcaaccacgtatgaagtctttacatttgccagatgtggcatgctttatgtttattatctcatttaagcttctctcaaaccctatgagttagggaccaatgtcattctcattttacagacaagaaactaagcatagagcagttaaatcatctactcaagatggcacctctgggaggttacagctctgggattcaaggtctgcccaacgcctagttctatgctcacaagcactgtggttgagatcatcatgcctggcactgcccaaagacaaacaagaccgttttgtgtggtatcaaargtgtcaaaatgggcagcagcctgagactccagcttccagcaggagacaaagtcgctcccatctggacgttccctcaatagccccgaagctttgctttccctttgctttccgacaccacaaggatcgagtcttgccggctagcaaaccagttcgttcagtgttttcaaaacttcagtcatgaatgaagccatcttcagaaattctgccaaagcccaaattagtttcttaatacttttgttaaagactcaccttttctctacctaaattgatttagttctaaaggaaattgtcattactaca

SEQ ID NO: 173775 - DNA, 601 bp, Human
tgggattcaaggtctgcccaacgcctagttctatgctcacaagcactgtggttgagatcatcatgcctggcactgcccaaagacaaacaagaccgttttgtgtggtatcaaaggtgtcaaaatgggcagcagcctgagactccagcttccagcaggagacaaagtcgctcccatctggacgttccctcaatagccccgaagctttgctttccctttgctttccgacaccacaaggatcgagtcttgccggctagcaaaccagttcgttcagtgttttcaaaacttcagtcatgaatgaagscatcttcagaaattctgccaaagcccaaattagtttcttaatacttttgttaaagactcaccttttctctacctaaattgatttagttctaaaggaaattgtcattactacaaagaaagcgaagtgatgtcattgaattctagctggctgctgttgacatgctaaagctctgagcctgaagcggctttatcctccttagaggaaagatcagcaggaggcagaggatagagacaccagcaccccccagtccttccccctggtgggattggaaggcttgacagtcaacctgagaaaagaaag

SEQ ID NO: 173776 - DNA, 601 bp, Human
ttgttaaagactcaccttttctctacctaaattgatttagttctaaaggaaattgtcattactacaaagaaagcgaagtgatgtcattgaattctagctggctgctgttgacatgctaaagctctgagcctgaagcggctttatcctccttagaggaaagatcagcaggaggcagaggatagagacaccagcaccccccagtccttccccctggtgggattggaaggcttgacagtcaacctgagaaaagaaagactttctcacgctgtgttttctgttttattctaatgctgttacttcrcgtcctggctaggcaccatctcaatcaactcagatacccgcagtggctcacgtctgatgccacggaaagcgcaggagtgagcacagcttcagcagaggtggtgctgatgcctagcgggggagttaccttcctgaagccctgggctatttgctggggctgactgaccaaaaagggaaacatgggggcttgtgcttatgaggcggccccacgctcagctgtgctttggttttgtccacttgcttgtcttaattttttttttttcttagacggagtctcgctctgttgcccaggctggagtgc

SEQ ID NO: 173777 - DNA, 601 bp, Human
ttgtcattactacaaagaaagcgaagtgatgtcattgaattctagctggctgctgttgacatgctaaagctctgagcctgaagcggctttatcctccttagaggaaagatcagcaggaggcagaggatagagacaccagcaccccccagtccttccccctggtgggattggaaggcttgacagtcaacctgagaaaagaaagactttctcacgctgtgttttctgttttattctaatgctgttacttcacgtcctggctaggcaccatctcaatcaactcagatacccgcagtggctcacrtctgatgccacggaaagcgcaggagtgagcacagcttcagcagaggtggtgctgatgcctagcgggggagttaccttcctgaagccctgggctatttgctggggctgactgaccaaaaagggaaacatgggggcttgtgcttatgaggcggccccacgctcagctgtgctttggttttgtccacttgcttgtcttaattttttttttttcttagacggagtctcgctctgttgcccaggctggagtgcaatggcgcaatcttggctcaatgcaacctctgcctgccaggttaaagcgatt

SEQ ID NO: 173778 - DNA, 601 bp, Human
agcgaagtgatgtcattgaattctagctggctgctgttgacatgctaaagctctgagcctgaagcggctttatcctccttagaggaaagatcagcaggaggcagaggatagagacaccagcaccccccagtccttccccctggtgggattggaaggcttgacagtcaacctgagaaaagaaagactttctcacgctgtgttttctgttttattctaatgctgttacttcacgtcctggctaggcaccatctcaatcaactcagatacccgcagtggctcacgtctgatgccacggaaagcrcaggagtgagcacagcttcagcagaggtggtgctgatgcctagcgggggagttaccttcctgaagccctgggctatttgctggggctgactgaccaaaaagggaaacatgggggcttgtgcttatgaggcggccccacgctcagctgtgctttggttttgtccacttgcttgtcttaattttttttttttcttagacggagtctcgctctgttgcccaggctggagtgcaatggcgcaatcttggctcaatgcaacctctgcctgccaggttaaagcgattctcctgactcagcctcctg

SEQ ID NO: 173779 - DNA, 601 bp, Human
tagagacaccagcaccccccagtccttccccctggtgggattggaaggcttgacagtcaacctgagaaaagaaagactttctcacgctgtgttttctgttttattctaatgctgttacttcacgtcctggctaggcaccatctcaatcaactcagatacccgcagtggctcacgtctgatgccacggaaagcgcaggagtgagcacagcttcagcagaggtggtgctgatgcctagcgggggagttaccttcctgaagccctgggctatttgctggggctgactgaccaaaaagggaaacrtgggggcttgtgcttatgaggcggccccacgctcagctgtgctttggttttgtccacttgcttgtcttaattttttttttttcttagacggagtctcgctctgttgcccaggctggagtgcaatggcgcaatcttggctcaatgcaacctctgcctgccaggttaaagcgattctcctgactcagcctcctgagtagctgggattacaggcaactgccaccacgcccagctaatttttgtattcttagcagagacagggtttcaccatcctggccaggctggtgtcaaactcctgacctt

SEQ ID NO: 173780 - DNA, 601 bp, Human
ccttccccctggtgggattggaaggcttgacagtcaacctgagaaaagaaagactttctcacgctgtgttttctgttttattctaatgctgttacttcacgtcctggctaggcaccatctcaatcaactcagatacccgcagtggctcacgtctgatgccacggaaagcgcaggagtgagcacagcttcagcagaggtggtgctgatgcctagcgggggagttaccttcctgaagccctgggctatttgctggggctgactgaccaaaaagggaaacatgggggcttgtgcttatgaggcrgccccacgctcagctgtgctttggttttgtccacttgcttgtcttaattttttttttttcttagacggagtctcgctctgttgcccaggctggagtgcaatggcgcaatcttggctcaatgcaacctctgcctgccaggttaaagcgattctcctgactcagcctcctgagtagctgggattacaggcaactgccaccacgcccagctaatttttgtattcttagcagagacagggtttcaccatcctggccaggctggtgtcaaactcctgaccttaagtgatccacccgccctggcct

SEQ ID NO: 173781 - DNA, 601 bp, Human
tcaactcagatacccgcagtggctcacgtctgatgccacggaaagcgcaggagtgagcacagcttcagcagaggtggtgctgatgcctagcgggggagttaccttcctgaagccctgggctatttgctggggctgactgaccaaaaagggaaacatgggggcttgtgcttatgaggcggccccacgctcagctgtgctttggttttgtccacttgcttgtcttaattttttttttttcttagacggagtctcgctctgttgcccaggctggagtgcaatggcgcaatcttggctcaatgcracctctgcctgccaggttaaagcgattctcctgactcagcctcctgagtagctgggattacaggcaactgccaccacgcccagctaatttttgtattcttagcagagacagggtttcaccatcctggccaggctggtgtcaaactcctgaccttaagtgatccacccgccctggcctcccaaagtgctgggattaccggcgtgagccaccgtgcccagccttcgcttgccttttaaaagggcttccaagagcattatcatatgcagaatttttacccagtctccttgtcttggatggcct

SEQ ID NO: 173782 - DNA, 601 bp, Human
gcagtaggctggccaaggctcaatctgacttttgtactttctccagctgtcactggggccaagtaggccctctctgtggcctgccaggcctaggccagattggataagctttttttttttttttttttttaagacagagtctcattctttcacccaagctggagtgcagtggcacgatctctgctcactgcagcctccacttctcaggttcaagcgattcttgtgcctcagccacccgagtagctgggactacaggctcctgccatcacgcctggctaatttttgtatttttagtagagayggggttttgccatgttggccaagctggtctccaactcctggcctcaagtgatctgcccacctcggcctcccaaagtgttgggattacaggcgtgagccactgcgcccggcccacaaataagcctttttataaagcattccaagaacagtgcccctgattttgaacctagctcaacacctgcctctcaaggttaatgagcttttctgtttctttctcctccatccttgctttattactgtgtacacgtggcagcttcctggtccctcacaatggtgactaagagcaaggactctgatgtga

SEQ ID NO: 173783 - DNA, 601 bp, Human
ctgattttgaacctagctcaacacctgcctctcaaggttaatgagcttttctgtttctttctcctccatccttgctttattactgtgtacacgtggcagcttcctggtccctcacaatggtgactaagagcaaggactctgatgtgagactgacagtctcctgttctggctccagcatttcctagttaagttattttagacaacttaatatctgaaaacctcagttttgtcacctctaaattggatataatcataatacctaaattatgaagtattgtgtgcaacaaacaagacaaaatgyccgtaaaatatttaacacagttgatggcacattgtcagctctaaaggaatgtgaactgagataacagttttctccctagttatctcttcctcctactcttccatcgatctttctctttgaatgtgcaagtctcaggagtaagggttcttctatcattttcttgtctctgggagaagagataatggaatgatggaatgaaaggaggcaaatactgtgtccacccttcccacctaccatcatccaggttagtttcagggatccggatataggcataagtaattgactatcagcctggacttt

SEQ ID NO: 173784 - DNA, 601 bp, Human
tgttcggactaccagtttccacattgcaccacggcccctctctgtgggtggacactgtgagtcacaaaatgagtgacttgcttcagattccggcgaccccctgacaggcagcccaagctgcacatcggcttcaggctccccgagagcccagcccaggaagtctcggctttctttttgtttggtttccctccgagcgccagctcctaggaagggcacgtctgccacctgctggctgtaggcagcatggcacccggctgtccctcaggctccagctggagccaggatgcgcaatgctggcccrggtgcaggtcctggagggcccttccttgctggaccccgaggaaggatgtccctcaaagtcttctgcccacttcttaggacatggcccaccctgttcggctcaaagagaagaattcgtagggaatctccaaaggactgggtggagacaggtctagacagacaggccctgccctgagaaaggcaaggcagggagcaaagaccaggaccaaggcccagatgactgggggtgatgagggcgagattgaagaaggggtaacctttgtccttgaagtcttagtgtattagtccattctcatgctgc

SEQ ID NO: 173785 - DNA, 601 bp, Human
ctaagctgcccttcctctgccaggcctccccactgccaacccccaccctcagccccaaacagaacacctgtcccatctcactgcctgcagaaacagggtgtgggggaggtggttagccaggaagtcattagacagaggcacagtccccgataacaaatgacctctcttcctttttttgcattcctttcccctcaccaacatgttattttgtaattttttaaacctacagaaaagtgggaagaataatgcaatgaatattcttcatccagatagatgccacaattgttaacatgtcgttatrgttgctgtgtctctcattctcctgtgtgtatagttgttttgtttgtttgtttgctgaatcatttgcaagtaaattgtagacatcactctacctcaccacgcatctctctcttttgtttttttcttagatggagtctcgctctgtagcccaggctggagtgcagtggcacaatcttggctcgctgcaagctctgcctcctgggctcaccccattctcctgcctcagcctcccgagtagctaggactacaggcccccgctgccacatccagctaattttttgtacttttagtggagacgggg

SEQ ID NO: 173786 - DNA, 601 bp, Human
gccaggaagtcattagacagaggcacagtccccgataacaaatgacctctcttcctttttttgcattcctttcccctcaccaacatgttattttgtaattttttaaacctacagaaaagtgggaagaataatgcaatgaatattcttcatccagatagatgccacaattgttaacatgtcgttatggttgctgtgtctctcattctcctgtgtgtatagttgttttgtttgtttgtttgctgaatcatttgcaagtaaattgtagacatcactctacctcaccacgcatctctctcttttktttttttcttagatggagtctcgctctgtagcccaggctggagtgcagtggcacaatcttggctcgctgcaagctctgcctcctgggctcaccccattctcctgcctcagcctcccgagtagctaggactacaggcccccgctgccacatccagctaattttttgtacttttagtggagacggggtttcactgttagccaggatggtcttgatctcctgaccttgtgatccacccacctcggcctcccaaagtgctgggattacaggcgtgagccaccacgcccagccagcgtctcttaa

SEQ ID NO: 173787 - DNA, 601 bp, Human
attcttcatccagatagatgccacaattgttaacatgtcgttatggttgctgtgtctctcattctcctgtgtgtatagttgttttgtttgtttgtttgctgaatcatttgcaagtaaattgtagacatcactctacctcaccacgcatctctctcttttgtttttttcttagatggagtctcgctctgtagcccaggctggagtgcagtggcacaatcttggctcgctgcaagctctgcctcctgggctcaccccattctcctgcctcagcctcccgagtagctaggactacaggcccccrctgccacatccagctaattttttgtacttttagtggagacggggtttcactgttagccaggatggtcttgatctcctgaccttgtgatccacccacctcggcctcccaaagtgctgggattacaggcgtgagccaccacgcccagccagcgtctcttaagaataagtacattttcctacagaactacaataccattgtttactctcaagaaagtcaacattgacacaataatattgtctaatatgtctatattcaaatttcccacttgtttcagtatcttagtccattttgtgttgctac

SEQ ID NO: 173788 - DNA, 601 bp, Human
tcttcatccagatagatgccacaattgttaacatgtcgttatggttgctgtgtctctcattctcctgtgtgtatagttgttttgtttgtttgtttgctgaatcatttgcaagtaaattgtagacatcactctacctcaccacgcatctctctcttttgtttttttcttagatggagtctcgctctgtagcccaggctggagtgcagtggcacaatcttggctcgctgcaagctctgcctcctgggctcaccccattctcctgcctcagcctcccgagtagctaggactacaggcccccgcygccacatccagctaattttttgtacttttagtggagacggggtttcactgttagccaggatggtcttgatctcctgaccttgtgatccacccacctcggcctcccaaagtgctgggattacaggcgtgagccaccacgcccagccagcgtctcttaagaataagtacattttcctacagaactacaataccattgtttactctcaagaaagtcaacattgacacaataatattgtctaatatgtctatattcaaatttcccacttgtttcagtatcttagtccattttgtgttgctacaa

SEQ ID NO: 173789 - DNA, 601 bp, Human
gagtagctaggactacaggcccccgctgccacatccagctaattttttgtacttttagtggagacggggtttcactgttagccaggatggtcttgatctcctgaccttgtgatccacccacctcggcctcccaaagtgctgggattacaggcgtgagccaccacgcccagccagcgtctcttaagaataagtacattttcctacagaactacaataccattgtttactctcaagaaagtcaacattgacacaataatattgtctaatatgtctatattcaaatttcccacttgtttcagtrtcttagtccattttgtgttgctacaaaggaatacctgaggctgggtgatgtattttttttaaaaaagaggtttatttggcttggatttctgaggactggaaagtccaggattgggcagctgcttttggcaagggcctcaagctgcctccactcatggcaaaagggaaaggggagccaatgtacagagatcacatggcaagaggggaagcaagagggagggatggaagtgccaggctctttttaacaaccagctctcctaggaactaatagagtgaaaccttgcttaccctgagggtgagt

SEQ ID NO: 173790 - DNA, 601 bp, Human
agacggggtttcactgttagccaggatggtcttgatctcctgaccttgtgatccacccacctcggcctcccaaagtgctgggattacaggcgtgagccaccacgcccagccagcgtctcttaagaataagtacattttcctacagaactacaataccattgtttactctcaagaaagtcaacattgacacaataatattgtctaatatgtctatattcaaatttcccacttgtttcagtatcttagtccattttgtgttgctacaaaggaatacctgaggctgggtgatgtattttttttwaaaaagaggtttatttggcttggatttctgaggactggaaagtccaggattgggcagctgcttttggcaagggcctcaagctgcctccactcatggcaaaagggaaaggggagccaatgtacagagatcacatggcaagaggggaagcaagagggagggatggaagtgccaggctctttttaacaaccagctctcctaggaactaatagagtgaaaccttgcttaccctgagggtgagtactaatccatttgtaatggatccacccctatgccccaacattgaggccccacctccaacat

SEQ ID NO: 173791 - DNA, 601 bp, Human
gacggggtttcactgttagccaggatggtcttgatctcctgaccttgtgatccacccacctcggcctcccaaagtgctgggattacaggcgtgagccaccacgcccagccagcgtctcttaagaataagtacattttcctacagaactacaataccattgtttactctcaagaaagtcaacattgacacaataatattgtctaatatgtctatattcaaatttcccacttgtttcagtatcttagtccattttgtgttgctacaaaggaatacctgaggctgggtgatgtattttttttawaaaagaggtttatttggcttggatttctgaggactggaaagtccaggattgggcagctgcttttggcaagggcctcaagctgcctccactcatggcaaaagggaaaggggagccaatgtacagagatcacatggcaagaggggaagcaagagggagggatggaagtgccaggctctttttaacaaccagctctcctaggaactaatagagtgaaaccttgcttaccctgagggtgagtactaatccatttgtaatggatccacccctatgccccaacattgaggccccacctccaacatt

SEQ ID NO: 173792 - DNA, 601 bp, Human
ccacgcccagccagcgtctcttaagaataagtacattttcctacagaactacaataccattgtttactctcaagaaagtcaacattgacacaataatattgtctaatatgtctatattcaaatttcccacttgtttcagtatcttagtccattttgtgttgctacaaaggaatacctgaggctgggtgatgtattttttttaaaaaagaggtttatttggcttggatttctgaggactggaaagtccaggattgggcagctgcttttggcaagggcctcaagctgcctccactcatggcaraagggaaaggggagccaatgtacagagatcacatggcaagaggggaagcaagagggagggatggaagtgccaggctctttttaacaaccagctctcctaggaactaatagagtgaaaccttgcttaccctgagggtgagtactaatccatttgtaatggatccacccctatgccccaacattgaggccccacctccaacattggggatcaaatttcagcatgaggtttggagaggacaaatatccaagtcagcccaaaccacagcactcaatgtcctttttgccattgtttttaaatcca

SEQ ID NO: 173793 - DNA, 601 bp, Human
tcttaagaataagtacattttcctacagaactacaataccattgtttactctcaagaaagtcaacattgacacaataatattgtctaatatgtctatattcaaatttcccacttgtttcagtatcttagtccattttgtgttgctacaaaggaatacctgaggctgggtgatgtattttttttaaaaaagaggtttatttggcttggatttctgaggactggaaagtccaggattgggcagctgcttttggcaagggcctcaagctgcctccactcatggcaaaagggaaaggggagccartgtacagagatcacatggcaagaggggaagcaagagggagggatggaagtgccaggctctttttaacaaccagctctcctaggaactaatagagtgaaaccttgcttaccctgagggtgagtactaatccatttgtaatggatccacccctatgccccaacattgaggccccacctccaacattggggatcaaatttcagcatgaggtttggagaggacaaatatccaagtcagcccaaaccacagcactcaatgtcctttttgccattgtttttaaatccaggatccaattaagagtca

SEQ ID NO: 173794 - DNA, 601 bp, Human
cagtatcttagtccattttgtgttgctacaaaggaatacctgaggctgggtgatgtattttttttaaaaaagaggtttatttggcttggatttctgaggactggaaagtccaggattgggcagctgcttttggcaagggcctcaagctgcctccactcatggcaaaagggaaaggggagccaatgtacagagatcacatggcaagaggggaagcaagagggagggatggaagtgccaggctctttttaacaaccagctctcctaggaactaatagagtgaaaccttgcttaccctgagggwgagtactaatccatttgtaatggatccacccctatgccccaacattgaggccccacctccaacattggggatcaaatttcagcatgaggtttggagaggacaaatatccaagtcagcccaaaccacagcactcaatgtcctttttgccattgtttttaaatccaggatccaattaagagtcacacactgcatttcgttgccatgtcctttactaaaaatacagtcctcccatctttttttgtcttttatggtgttgatgtttttctggaggctaggctaggtgttttgtagaatgccctg

SEQ ID NO: 173795 - DNA, 601 bp, Human
tgtcttttatggtgttgatgtttttctggaggctaggctaggtgttttgtagaatgccctgcaatttgaatctcacaatttggatctgtcatgttcctcatgagtaaattcagggtaactatttttgccaagagtactatctgttgatattttacatcctcagtacatcatatcaggatgcattatttctttttatttttctttcctaatttatcatctacctaattcccaaaatcatgtaaggaagcctacagtaaaacagaaaattagaaattctgcagagggtagaagcagcaaatayaccaaactgcctagcttgatgtatctcattgatctcagctttctggcggccaagacccaaagggaaagctgtctagtggtagaactcgcatttctttaaatcagggttcagcaaactttgtaaaatgtcagatagtaaatgtttggggttatactttctctctacaaaagcagccataaacaaacaggcatggttgttttccaataaaactttatttacaaaaacaaaactgctaggcttggcccaagggcccttatttgctgacccctgattaaagtggaagagagcatactccagtta

SEQ ID NO: 173796 - DNA, 601 bp, Human
tagaagcagcaaatataccaaactgcctagcttgatgtatctcattgatctcagctttctggcggccaagacccaaagggaaagctgtctagtggtagaactcgcatttctttaaatcagggttcagcaaactttgtaaaatgtcagatagtaaatgtttggggttatactttctctctacaaaagcagccataaacaaacaggcatggttgttttccaataaaactttatttacaaaaacaaaactgctaggcttggcccaagggcccttatttgctgacccctgattaaagtggaagasagcatactccagttattaaatgagtaatactttctttttcaggttgagtactgcatattaaaggaaatatttatgtcattatttatttattcagcaaatctttttgaggaatgccatgtgccaagctctatgctaggtattgggtaatacatcaatgacaaaacagacaaaatccctgcctttctggaggacagagtctgatgtgagagacaggtgacatgcaaataaacaaatgtaaatctatgcactgcagtaaggatcatggagggaataagcgggtgcagtgacaaaacagtgggg

SEQ ID NO: 173797 - DNA, 601 bp, Human
caaatataccaaactgcctagcttgatgtatctcattgatctcagctttctggcggccaagacccaaagggaaagctgtctagtggtagaactcgcatttctttaaatcagggttcagcaaactttgtaaaatgtcagatagtaaatgtttggggttatactttctctctacaaaagcagccataaacaaacaggcatggttgttttccaataaaactttatttacaaaaacaaaactgctaggcttggcccaagggcccttatttgctgacccctgattaaagtggaagagagcatactscagttattaaatgagtaatactttctttttcaggttgagtactgcatattaaaggaaatatttatgtcattatttatttattcagcaaatctttttgaggaatgccatgtgccaagctctatgctaggtattgggtaatacatcaatgacaaaacagacaaaatccctgcctttctggaggacagagtctgatgtgagagacaggtgacatgcaaataaacaaatgtaaatctatgcactgcagtaaggatcatggagggaataagcgggtgcagtgacaaaacagtggggatagggaaa

SEQ ID NO: 173798 - DNA, 601 bp, Human
aagggcccttatttgctgacccctgattaaagtggaagagagcatactccagttattaaatgagtaatactttctttttcaggttgagtactgcatattaaaggaaatatttatgtcattatttatttattcagcaaatctttttgaggaatgccatgtgccaagctctatgctaggtattgggtaatacatcaatgacaaaacagacaaaatccctgcctttctggaggacagagtctgatgtgagagacaggtgacatgcaaataaacaaatgtaaatctatgcactgcagtaaggatyatggagggaataagcgggtgcagtgacaaaacagtggggatagggaaatgtcatattgatgggatatttcagggaagatgacacttaaactgagacctagcgaaggtcatagaggggggcttccaggcagaggcaacaataattgccaaggccctgaggtgggaggaatttatcttgcgccattttgaagccaggtgtggctgaagcttagtaaaggggcaatgggagggaggagtatgggaggagatttgtaggtcatggcaggtgtttgcattttattctaagaacaacgagaagcca

SEQ ID NO: 173799 - DNA, 601 bp, Human
ggaagatgacacttaaactgagacctagcgaaggtcatagaggggggcttccaggcagaggcaacaataattgccaaggccctgaggtgggaggaatttatcttgcgccattttgaagccaggtgtggctgaagcttagtaaaggggcaatgggagggaggagtatgggaggagatttgtaggtcatggcaggtgtttgcattttattctaagaacaacgagaagccactgaagggttttaagcatctgtccatccccaatccccaggaactgtcacctgaagaaatcacctagatttcarcatgaattccgaatcctatcacagctatgtgacctccgagtccaaattttctcatctgtaaacaaggctgatgcaagcctcttcatagggctgttataagtatgaaatgcagcaatgtgtgatcaggcagggagtagatgaaactcactgcacctgacgagcacaccagtacctgggcagccgtgttccaaagcaaggacaggtgcagacaactgacacgaacccctgctgtggagaaggacaatgcttcagtactcagcgcgcacaggtggtggtggtggagggggtgtatcttcaaat

SEQ ID NO: 173800 - DNA, 601 bp, Human
gagggaggagtatgggaggagatttgtaggtcatggcaggtgtttgcattttattctaagaacaacgagaagccactgaagggttttaagcatctgtccatccccaatccccaggaactgtcacctgaagaaatcacctagatttcagcatgaattccgaatcctatcacagctatgtgacctccgagtccaaattttctcatctgtaaacaaggctgatgcaagcctcttcatagggctgttataagtatgaaatgcagcaatgtgtgatcaggcagggagtagatgaaactcactgcamctgacgagcacaccagtacctgggcagccgtgttccaaagcaaggacaggtgcagacaactgacacgaacccctgctgtggagaaggacaatgcttcagtactcagcgcgcacaggtggtggtggtggagggggtgtatcttcaaatagaccccattgcccctcccttcaacctctagcccagccacaaccatcagaaagcacgcagtgcacctgcaccccatacgatctcctctggctgacagctaaggagcacgcccggcagagctccatctcaacgctgatctgctgtgttgttttg

SEQ ID NO: 173801 - DNA, 601 bp, Human
atgggaggagatttgtaggtcatggcaggtgtttgcattttattctaagaacaacgagaagccactgaagggttttaagcatctgtccatccccaatccccaggaactgtcacctgaagaaatcacctagatttcagcatgaattccgaatcctatcacagctatgtgacctccgagtccaaattttctcatctgtaaacaaggctgatgcaagcctcttcatagggctgttataagtatgaaatgcagcaatgtgtgatcaggcagggagtagatgaaactcactgcacctgacgagcasaccagtacctgggcagccgtgttccaaagcaaggacaggtgcagacaactgacacgaacccctgctgtggagaaggacaatgcttcagtactcagcgcgcacaggtggtggtggtggagggggtgtatcttcaaatagaccccattgcccctcccttcaacctctagcccagccacaaccatcagaaagcacgcagtgcacctgcaccccatacgatctcctctggctgacagctaaggagcacgcccggcagagctccatctcaacgctgatctgctgtgttgttttgtttttcagttc

SEQ ID NO: 173802 - DNA, 601 bp, Human; identical to SEQ ID NO: 29337

SEQ ID NO: 173803 - DNA, 601 bp, Human; identical to SEQ ID NO: 29338

SEQ ID NO: 173804 - DNA, 601 bp, Human; identical to SEQ ID NO: 29339

SEQ ID NO: 173805 - DNA, 601 bp, Human; identical to SEQ ID NO: 29340

SEQ ID NO: 173806 - DNA, 601 bp, Human; identical to SEQ ID NO: 29341

SEQ ID NO: 173807 - DNA, 601 bp, Human; identical to SEQ ID NO: 29342

SEQ ID NO: 173808 - DNA, 601 bp, Human; identical to SEQ ID NO: 29343

SEQ ID NO: 173809 - DNA, 601 bp, Human; identical to SEQ ID NO: 29344

SEQ ID NO: 173810 - DNA, 601 bp, Human; identical to SEQ ID NO: 29345

SEQ ID NO: 173811 - DNA, 601 bp, Human; identical to SEQ ID NO: 29346

SEQ ID NO: 173812 - DNA, 601 bp, Human; identical to SEQ ID NO: 29347

SEQ ID NO: 173813 - DNA, 601 bp, Human; identical to SEQ ID NO: 29348

SEQ ID NO: 173814 - DNA, 601 bp, Human; identical to SEQ ID NO: 29349

SEQ ID NO: 173815 - DNA, 601 bp, Human; identical to SEQ ID NO: 29350

SEQ ID NO: 173816 - DNA, 601 bp, Human; identical to SEQ ID NO: 29351

SEQ ID NO: 173817 - DNA, 601 bp, Human; identical to SEQ ID NO: 29352

SEQ ID NO: 173818 - DNA, 601 bp, Human; identical to SEQ ID NO: 29353

SEQ ID NO: 173819 - DNA, 601 bp, Human; identical to SEQ ID NO: 29354

SEQ ID NO: 173820 - DNA, 601 bp, Human; identical to SEQ ID NO: 29355

SEQ ID NO: 173821 - DNA, 601 bp, Human; identical to SEQ ID NO: 29356

SEQ ID NO: 173822 - DNA, 601 bp, Human; identical to SEQ ID NO: 29357

SEQ ID NO: 173823 - DNA, 601 bp, Human; identical to SEQ ID NO: 29358

SEQ ID NO: 173824 - DNA, 601 bp, Human; identical to SEQ ID NO: 29359

SEQ ID NO: 173825 - DNA, 601 bp, Human; identical to SEQ ID NO: 29360

SEQ ID NO: 173826 - DNA, 601 bp, Human; identical to SEQ ID NO: 29361

SEQ ID NO: 173827 - DNA, 601 bp, Human; identical to SEQ ID NO: 29362

SEQ ID NO: 173828 - DNA, 601 bp, Human; identical to SEQ ID NO: 29363

SEQ ID NO: 173829 - DNA, 601 bp, Human; identical to SEQ ID NO: 29364

SEQ ID NO: 173830 - DNA, 601 bp, Human; identical to SEQ ID NO: 29365

SEQ ID NO: 173831 - DNA, 601 bp, Human; identical to SEQ ID NO: 29366

SEQ ID NO: 173832 - DNA, 601 bp, Human; identical to SEQ ID NO: 29367

SEQ ID NO: 173833 - DNA, 601 bp, Human; identical to SEQ ID NO: 29368

SEQ ID NO: 173834 - DNA, 601 bp, Human; identical to SEQ ID NO: 29369

SEQ ID NO: 173835 - DNA, 601 bp, Human; identical to SEQ ID NO: 29370

SEQ ID NO: 173836 - DNA, 601 bp, Human; identical to SEQ ID NO: 29371

SEQ ID NO: 173837 - DNA, 601 bp, Human; identical to SEQ ID NO: 29372

SEQ ID NO: 173838 - DNA, 601 bp, Human; identical to SEQ ID NO: 29373

SEQ ID NO: 173839 - DNA, 601 bp, Human; identical to SEQ ID NO: 29374

SEQ ID NO: 173840 - DNA, 601 bp, Human; identical to SEQ ID NO: 29375

SEQ ID NO: 173841 - DNA, 601 bp, Human; identical to SEQ ID NO: 29376

SEQ ID NO: 173842 - DNA, 601 bp, Human; identical to SEQ ID NO: 29377

SEQ ID NO: 173843 - DNA, 601 bp, Human; identical to SEQ ID NO: 29378

SEQ ID NO: 173844 - DNA, 601 bp, Human; identical to SEQ ID NO: 29379

SEQ ID NO: 173845 - DNA, 601 bp, Human
cacacgctgagtcagtggccagagcaaggcttggatccagttctctgctccctttccagagccttgtgatgtcttctctcctacaggaggtgaaaataactgctgtggctggttctgttttgctgactgtaaattgggtcatggtcagggacagtgcataggtgtaaagaagttgctggttgggggttctaatgcaggtttctccaaaagtgaatgccctgttaaaaaaaaattcttaacaaatatacagagattttttttttaaaaaagtgtgacagttctagacacctagagagtaaartgaagaagcctgttttcaggtttcccgcctccctgaatttcccagcatggtccaggctttgaaatttatttatctgcttttggcaatggttgatgggaatttcccacatttattttttagctacagagaaaggacattatctttaaaatctcttcgttgttctctctctttgagtgaggagagaagatgtgaatcctggcagtggttcagagtggacacagcccctgtgtttgtggcataggctctgtgggccccatgccagggagcagtacccccgtgtaaaggagtgggggtttgtcc

SEQ ID NO: 173846 - DNA, 601 bp, Human
ttttttagctacagagaaaggacattatctttaaaatctcttcgttgttctctctctttgagtgaggagagaagatgtgaatcctggcagtggttcagagtggacacagcccctgtgtttgtggcataggctctgtgggccccatgccagggagcagtacccccgtgtaaaggagtgggggtttgtccatttggatagagcaaagatcctccacctcaaatcccacaagaacagttgccacaacctgggccctaagcatctcattttcctatgtagaaattaatgatctggaggagatggsaaaacattccttccagagcctgtgtggattttggccaggggtgcagcaagggggcttaggcacctttttcctctgctgtgtcttagcaggcgtgttgaccatagcaactcccctggggcatacacaccctcttgtagatggagacctttgtccaaagcagccacagctggcaactgtctacaatcttttgggctttctgctgtgctcaaggggatctgggaatggccattgcctagaggggatgggctggtggaggaaggtgggctctgggagccggggagaagggaaaagccatgaatt

SEQ ID NO: 173847 - DNA, 601 bp, Human
cgtgggaattcagagcattttgttggactattttaatctgattggattattttcatgtggtatgtgggttaccacattagaaacgattgatgtgtagaataaatgttcttaacaagtggaggtcaacttatcaaatgatatttacattaagaatagactccacaaattttagttcctgtagctgatatagcatctcatttgttatataatccagtgattcctaatctgtgttcagaggagagaggaaatcgattgcaacagggacgatgccttcattggctggcccaaaactgggagtttwtacaaggcgtcagtctttgccttcctcctccctgccttccctcttccttcttccttccccatactccccaacaaattcatggacttcttaacaactcagagacattagccacaagttccaagacacccccaccccccagcctccccagtcctattttcgcattcatataactaaactctttttctttcttggtggagttttgaaatttatatttttaattctttgctcccttttttcctcttacaaaatgagtgccaagcagctaagttgtgctgagtggtagagtttgagtcagtcttg

SEQ ID NO: 173848 - DNA, 601 bp, Human
aaaggagagtcaaaggtaggtagatggagatgcttcactgagtggggagtattggaggaggagcaggtttggggtggaagcgttgtccttttagagagattgtatttgccattgattgattcattcattgtttctgcaaatatttagtgtgggaaaaagcatgctagacaccaagagagagtggagtcaatgaagaacgataacagcaacaaagactgtagcgcttcctatgcgaggcttgttccagttgcttcagaggctgtgttacccctgttctagagaggaggaactaggcccaggkaggtggggatttgcccagtcgtgggagtcaggatgtgaaacaaggcaccctggctccagagcacaccgtcctctcaaccactgcagagaagctgggaaagagacaaataagtgggtgcttagagcacaatgtgtgtggtgtgccaagagcagctgggagccctgggacccccagggaaccccagccccacctgggcatggtgggcatggctggaggaggcctgctggctttgctggagagtgggacatgcatcaaggtggccagagactgggcttctgggtgtcgtgctgtgactgctgc

SEQ ID NO: 173849 - DNA, 601 bp, Human
gtgaatgagtttctttagggcaggatcttgactctgcagggggcttggaggccttccctagagtggggcttcctaacactgcagagctcttcccaggacgaggggcaagattgggacctactttggaaggttgtttttgtttcggcacctgctctgtttacgaagcgtgggagcctgttttaaattaatgtgcgcctacttagagctacactcatggttttgactatgtttatctttccagtaaataaaacaaaattgttcatttggcacccagcctgtcctgcttgtcatttcttgtctygctgattaactctatggatggggcatgtttctccaaccagattgtaagtttcttgaagccaaggagccctgtggttgatttcttcacatgtggctctctctcctcccacaatggtgcttcgttaattaagcagaaaacccatctctggttagggactggagttgatttcgtttggaatgagtgtgacttcatcatgacctgaaagtgttcagaaccatcttggttagcacaagggcgtggacgtgtgtctactttctacctgatgggatagcatgtttaatttggggttatgacactgaa

SEQ ID NO: 173850 - DNA, 601 bp, Human
ttgattgttgattatgggcaatagatacattttaagaatgatgttgtaggctgtatgaagtcatttgatgattgttttgttaatggcttgcaggtcagattttcatctttttaaattaattatcatagaaggagaaaacaactggatttcagaattgtcccttgaggtgtactggaaactaaggcgtgagggactcataggggtctggcttggaaagtgtattgctatgtccagtttacacataaggatgtgcaaatccagcaggttagctgagctgcccaggaatatccaggcaagaatkaccatattctgataattactcaggcctctgcctcatctccgctgcccccccgccccctgactctcttctgagtgccagattcagcctccatttgaatgccaaatagacaggaaattagcatgcccagaatccacgtctttagtgcactctctccccagctccaaacctgttactgcttgtgttcaacatctcagtaaagctcaacaacatcgacccattacttaggcctcaaaccttgggtggcatcgtcgattgctcttttctttcataccccacattcaacccatcagcccatcccac

SEQ ID NO: 173851 - DNA, 601 bp, Human
gtgtccaaacagtgggataaaggctttactctttgtcttcctgctctgagggcacaagctgcttgtttctctcacaaggacaccgtctgtgttgctcaggtgctggggtgaaaaaaacagcaagcatttgaaaaggctgaagaaggaaagaaagctgagagcggtacagccttggggactgagccatcccattgtcccagaggtgggggtgttatcaagacctgtttttgagccatacctctgactcttcctggaaagttagacccaactcaagaacacactaagagaagtgtttcccccyagccctttcagattgaaaggagacgccaaccttgatgggtggaggtagaaaataaagtcccaaaacagtgtcttgtaagcgaaggggaacatggctgggcagagggcttctggtgaaacttttgggagtattcagttggaactcaggaaaaaaaaattgtttttttggaaagaggtagcagcccccttcagccaaagctcataaatgaaggaatgtctgagactcagaattacagtgaccaaggcaagacattgtcaaaggctgaataagtgagtttgactgacagaggccatctccatt

SEQ ID NO: 173852 - DNA, 601 bp, Human
gcacacaccccgactcaatggaggaccctcatttgtagaagggtaaaatgggtgaggcggaaatgcctgtatggcaccatggagttctgtgtagccagttctaatcctgggctatttggtaaggaatgaagttggagatagtcttctgtcccttacaaccaaaggaattctaactaatagtttgccaagttttatgtttataataaaaaatgacatgctttttcttttggatttttaatgcttttgaattaaaaatgctagaacatgaactgattcttctatcgctatttagatagagccytgcaagagcagagcacgcatgctttctttaagaacaggttggtttgtggtcgtctgaggactgttttaaggagacttattatacacaatcatcccccacaaatgatttctaaagagaggctggtatgaaagaaggagtttccatgattctgtcctgtggttctggggaattctgaaaatgaactttagatatttttgtgaaattcttattttcatatttttggtatctcagagttttcttttctggcttctgtttaacatactcttctttgccctaaatctctcttatttttgctccttg

SEQ ID NO: 173853 - DNA, 601 bp, Human
gattctttttttggtgcaaacccatgatgccttcttcctgattcatctgctacactgtgagttcaagcctggcgtgggacacaggcacagctctcatgccaacgatctcatggttaagttttggaacataatttgaaaaatgtaacccattgagaggcagtaaggacatacggtgagctagtgcgtgtttggacgtctgtgtggaataagtgagtgggtagagaggacatttgtcaaggagcgggagggcgggccattggcttgggggaaatgggctgagactctaggggtggccagcacygcatatggaggccagcagggttgggcttggctaagtgctgtggtgtctggatgcctatgtgagtttcctccagaagttttcagttggcaaagtagaacctgctggatatgtagcaagggtgtggattgtcgggatcctgctgggcgcaggcgtgtgataccagaggtcagaacagaagctgagggatgaggctttgggagctttttgtcatgcactgtcctggagcctcagttactacaaagtctgcaaatgatagaccggagctttggttctgcctgatgctagctcccctgttcctga

SEQ ID NO: 173854 - DNA, 601 bp, Human
ttttttggtgcaaacccatgatgccttcttcctgattcatctgctacactgtgagttcaagcctggcgtgggacacaggcacagctctcatgccaacgatctcatggttaagttttggaacataatttgaaaaatgtaacccattgagaggcagtaaggacatacggtgagctagtgcgtgtttggacgtctgtgtggaataagtgagtgggtagagaggacatttgtcaaggagcgggagggcgggccattggcttgggggaaatgggctgagactctaggggtggccagcactgcatayggaggccagcagggttgggcttggctaagtgctgtggtgtctggatgcctatgtgagtttcctccagaagttttcagttggcaaagtagaacctgctggatatgtagcaagggtgtggattgtcgggatcctgctgggcgcaggcgtgtgataccagaggtcagaacagaagctgagggatgaggctttgggagctttttgtcatgcactgtcctggagcctcagttactacaaagtctgcaaatgatagaccggagctttggttctgcctgatgctagctcccctgttcctgatttttc

SEQ ID NO: 173855 - DNA, 601 bp, Human
ggaagcgtgcagaaataggaggccagtactgaaatgctatctgctctgtgtatgtcagaagaccacaaaccacttataacaaatgaagatctttttatttgttcttatccctttatgtcacttgaggaaagttgctgtgagtaggtgatgatcattacagtgatcactggttgcccaaactgagaagccagacatttggcttggtttctctcccttcctcttgtctctcctaccctgtaaacacatacttggtgattacccatggggagacaagacaggctgggaatatatacttctgcamcttcagcctcctgggttccagcgattctcctgcctcagtctccagaagagctcggattacaggtgtgcaccaccaggcccagctaactttttgtatttttagtaaagatggggtttcatcatgttggccaggctggtctcgaactcctgacctcaggtgatctgcccttctcggcctcccgaagtggtgggattataggcgtgagtcaccgagcctggccccaggcaataatataccagtgggcaagaaaatattcttgctctcatgggacttctgttgggggtcagggtatagggagga

SEQ ID NO: 173856 - DNA, 601 bp, Human
gccccaggcaataatataccagtgggcaagaaaatattcttgctctcatgggacttctgttgggggtcagggtatagggaggaaggcatagagatgaaaaccagtaaataagtaacaggggaaaacattttaaatacattaataactaataaaatagaaataaatctgttggctacttaacaggatgtgccacattccagatacattacgttaatccttatgatctttgggggctaagtattagtattccattttacggatgaagagactgaggctcagagggaagggaggtggcttttckcaggtggaaagccagaccttttcagtggtcattcagttcatagctaaggtcttattttctgtgctctctgtcggctgaaaatgggcaaggtaatttcacatagtgacaggagccatgtcagagaaagagcaggacagtgggacagagagggaccaggctgggggctgtttgagatggagggtcaggaagaaccaaactaagatgtgaacagtgggaggtgttggagctgtggtgcttgcctagaaggaccctcatcgagcaaatagaagcttctggcaggaagaagttaatgtcttgcgt

SEQ ID NO: 173857 - DNA, 601 bp, Human
tgtgtgtgtgtgtgtgcgtgtgtgtgcgctgtacgttaatatggagagatgggcttgggccagtgggaaatagagagacccgcaagcacagagtgacagggtttgatagtaagcagcaggccagcgttgctgcttttattcctcggtaaatccttgcacaatgccatatgctcttgcattccgtagctgctgcatagggtgtgatttagttaatgcccgctctgcaaacaggaaacggtgctcactgctgtgtatgcttttcatggagataaagtgtcaggagcaagaccccaaacctgcraaatcactaatgcaaccgccccccatgccccaaaaggtgggagtgggggataaaaagagtaggaaagtggtgtggggaggggaagctttagggccataactcagacaatttgtcaggcagtggcatcggttgggaggaaaatattgatgtacactttttgtttttgaacctgaagtttgggttttttcggatgcattggaggacttttaaatgttttcggagtgccagagtttggactgttaggtcaccgtaggtaccggcttgcatatcatttcagaggaatattttcaaaactccata

SEQ ID NO: 173858 - DNA, 601 bp, Human
tgtgtgtgcgctgtacgttaatatggagagatgggcttgggccagtgggaaatagagagacccgcaagcacagagtgacagggtttgatagtaagcagcaggccagcgttgctgcttttattcctcggtaaatccttgcacaatgccatatgctcttgcattccgtagctgctgcatagggtgtgatttagttaatgcccgctctgcaaacaggaaacggtgctcactgctgtgtatgcttttcatggagataaagtgtcaggagcaagaccccaaacctgcgaaatcactaatgcaaccrccccccatgccccaaaaggtgggagtgggggataaaaagagtaggaaagtggtgtggggaggggaagctttagggccataactcagacaatttgtcaggcagtggcatcggttgggaggaaaatattgatgtacactttttgtttttgaacctgaagtttgggttttttcggatgcattggaggacttttaaatgttttcggagtgccagagtttggactgttaggtcaccgtaggtaccggcttgcatatcatttcagaggaatattttcaaaactccataaaaacatgcggctttcaa

SEQ ID NO: 173859 - DNA, 601 bp, Human
cttgggggacagagtttcccaaggctggttgccagctggcatggtcccccgttggtgaagtggagacctgtgtttttttggtcattttgcaaagagcttatggatgacagcagttctctgtgcctcgctgggacagagtgtattctgaggtccagcgtctgcatggagatctgcctatccttcacttggggtgctcagtagataacgcggccactttcctatacatttccttaatttaagggaacagcgtaaactcagcccaggtggattaatctctccagtgacttttgaaacttcaatytccaatttccctcttatgtctaggtgtgagtgaggatacgtgtagtaattgtcgcaggtattagtgagaaagggtgcagatcacacaaatatttcacacgttattagttggaccagactttggaggcaagggagggccgtgtcacctaggaaatttgctcttccgtggagatgaaagggcagtgaattaagtgcctgctttttctccctttttccctctgacggttattgatcctcccctggaactgtacagttcacgttctgatctttttcttgacaaagggaattcccagtttgttcg

SEQ ID NO: 173860 - DNA, 601 bp, Human
tttctaaaagaatctctttggtgacttagaagtggagagagctttagaagcatggcacaaataaaaggaaagaggcaaacaccgtcattctacatctgtttattttgttattaacaaaaggcaaggcgattttcattaaagttttgctggggttgggggtgagggtgtagagagcaaaagtgtgagttgtacaccatgactggaatcgcttggacatactcttcagcagacatcgtgtgactgtggaagaaatgagtttcatgaagatgactgatagaaggaagccactgaaccagtcctytatcacctcttccaaggctaaagtttggagccacttgcagaaggctctcctcaaacccctgtgttctttgcctacccctgctgttgccacatcatcttggagagctggctgcttccctcctcaactagaagttcctagtgcctgcttagttcttgtctcttgcttcccaagtgctcacaaaatacatccatgttcgctacgaggaaatggaccacataaggtttccgtgaaaaccttagcccttaggtctaacacagtaggaacagaagttaatgttttcctgacgtagaagtttctctt

SEQ ID NO: 173861 - DNA, 601 bp, Human
agtttagtctttctaggccagattatttagtttttgccatctaggtaaaattcggtccaattaagcgtccattaagtgttttaatataagctggagaaggagttgaacctggaggtcagggctctgtggtctattacagtccccctggggtctctagcccaagggagactccagggtcttaataaatgactgggggtttcattttgaggcctttactaccaaagactgaataatacattgggcatgatggttttgtcctaaacattaacagccacaaaaggtagagagtgtgtctgtttayagatacacatgtatcatgaataattagttggggactgtgcgtcaggtctctcattttacattcgaggaagcaatgcacggaatgaattctggacctgcgaactctgaatttcaattctctgtctcctacttttactggagtgcttgcaaacagtacagtgtttttgttgtgaagttataccgtgcctgtaatctctctgcgggtggccctcctaagccctacttcaagaaatagctctaagctcatgacacccgccccacccgatgcctacatatgtcttatatccttggagtagtgttt

SEQ ID NO: 173862 - DNA, 601 bp, Human
catctaggtaaaattcggtccaattaagcgtccattaagtgttttaatataagctggagaaggagttgaacctggaggtcagggctctgtggtctattacagtccccctggggtctctagcccaagggagactccagggtcttaataaatgactgggggtttcattttgaggcctttactaccaaagactgaataatacattgggcatgatggttttgtcctaaacattaacagccacaaaaggtagagagtgtgtctgtttatagatacacatgtatcatgaataattagttggggactstgcgtcaggtctctcattttacattcgaggaagcaatgcacggaatgaattctggacctgcgaactctgaatttcaattctctgtctcctacttttactggagtgcttgcaaacagtacagtgtttttgttgtgaagttataccgtgcctgtaatctctctgcgggtggccctcctaagccctacttcaagaaatagctctaagctcatgacacccgccccacccgatgcctacatatgtcttatatccttggagtagtgtttggggttgcaaatttgactttagggagacatactctct

SEQ ID NO: 173863 - DNA, 601 bp, Human
taggtaaaattcggtccaattaagcgtccattaagtgttttaatataagctggagaaggagttgaacctggaggtcagggctctgtggtctattacagtccccctggggtctctagcccaagggagactccagggtcttaataaatgactgggggtttcattttgaggcctttactaccaaagactgaataatacattgggcatgatggttttgtcctaaacattaacagccacaaaaggtagagagtgtgtctgtttatagatacacatgtatcatgaataattagttggggactgtgcrtcaggtctctcattttacattcgaggaagcaatgcacggaatgaattctggacctgcgaactctgaatttcaattctctgtctcctacttttactggagtgcttgcaaacagtacagtgtttttgttgtgaagttataccgtgcctgtaatctctctgcgggtggccctcctaagccctacttcaagaaatagctctaagctcatgacacccgccccacccgatgcctacatatgtcttatatccttggagtagtgtttggggttgcaaatttgactttagggagacatactctctgatg

SEQ ID NO: 173864 - DNA, 601 bp, Human
cgaaacccaagtaagcatggatgttaaagaacattaaataaattatataagtatgcctacctgtaacacttttataaggcaaatgcacatgggttattttgccataaacgtgcacatggaccaagatttattctaaagccctcttgtttcagccttgctgctggtgaaggtactactgttcatcagcttttcccttttttacctggcatgcactgtagctggtcttggaaaatgcgataatgatgccataagtacccttgtgcaaaagttgttttttgttccaaaacattgccagttcacrgcatataaaactaccacggatgcttcagccgggtttctttttctccaaataaggcaagcattaatgaagcagctgagggcttgggaaaatattttgtcattcccaaaatgaaatttcttcccctctctaggcctgcccattgatttttcagctgaagcacaagtgtctagccagacttggtgaacagtaggccttgcacctaaacttgtcaattgccattgtcacctctaatgaccattgatataaataatgctcagccttcatatttccatgcatattcacccagagaccagaaggctt

SEQ ID NO: 173865 - DNA, 601 bp, Human
aacttgtcaattgccattgtcacctctaatgaccattgatataaataatgctcagccttcatatttccatgcatattcacccagagaccagaaggctttgtgtagaggatggtgggatcatcccattccatagggaaaaaagggccaggttccctgactccacctgtcattgaattacaagctgggaagctgggccaggcagagctccagttgccagacactgtggccgctctggtaccagctactcctagtacccagtgcaggcaaggtgtttagtgtggcctatgaggatgttgtttaycaggcagcaacctcatgaataggcaaaaggcctgttttgaatgcctcctgtttagaagtctgaaatgtcacatccagacagtttggaaacattttaggtggagtcaagggcagagaccagaagacattcatagatctgcagttgcagatggagactttgttccagctacccatggtgtgagtataccttacgggtgctatttggaataggaccttatttttgttcagtatattggacaaagtaattcctgcttccaaactcacacagtatttatgtggccccggctgtctggcttatcca

SEQ ID NO: 173866 - DNA, 601 bp, Human
tcataggttgtagttaggaaaaagatgttgtgaggctcaggtggtctgagggatatagaattgcttctcaaacatgatatgttgctttgcccaatgcttaggagggagttgcggttaatagttgaagtgttctgcaagtaagtcttttggatcagtataaggctgtgataattcttattatttggtttgtgtccgtgcatgaaagcagaaagcagccagaggagtccatgattcaaggagcatgagaattactgtttgcaacaccatgttttctgaattccagtataccatcagttgtaakatatgcttaaggttggacgcggtggctcatgcctgtaatcccagcactttgggaggccgaggagggcggatcacttgagatcaggagtacgagaccagcctggctaacatggtgaaaccctgtctctactaaaaataaaaaaaatttagctgggcttggtggtgcatgcctgtaatcccagctactggggaggctgaggcaggagaattgcttgaacctggaaggcagaggttgcactgagctgagattgcgccattgcactctagcttgggcaacaagagcaaaagtccgtctcaaaaa

SEQ ID NO: 173867 - DNA, 601 bp, Human
gaacatacagttaagaatagctcaaagaatatgcatttctgctgtgagtggttttgaataaatcaacataatagcccatggttattaacatattatgtgaattggacaatgatatatactttgaggaccttgaactaaatccaccagctaagagcaacccgtaggaggggctccagaaggaccggagttctgggtgttgaggttgtcatacaaagaaatgaacagcagacaactggcagaagaattttctggtaatactcaacccaaagtcaattttcaaatgcttggactgcagcacagcattgactaatgtcagattaattgaatttggacttctaaatgtgggtcagtttgggttggaagtgattttattatccagaaacttctgtgtacccctcttcccccacaagaaatattcagccataattttcccctgttgctgagcttctcttgcaaagtttctgagaagcagtgaatctttctgttagatttcataagaagtagtgctaggcttttgatataattacgtttagatttcaaggaaactttcagtgtgttgaaaaataaattctaaggcataaaggggaaggagtcctcggct

SEQ ID NO: 173868 - DNA, 601 bp, Human
cattggccttgggaggcccagacgtggagcactgtcctggacctcaggctgtttcagggacctctgtggcaggaattgactacccttctctttcaggctcagccatgatgtgcttggctgttcccttgggctctctcttctggaagctcgtcccgtccgcaggcccccttgctgtacttgtaccttcattctccatctctcagcttctgcgcactctgaactttggccattcgcatgctgccagaccccttccaactcttggactcctccttacatccctttaccgttggctcccaattctttttttttttttaatttcccaattaaaacaacaaccaccaccaagaacaagagttaggccctgcctacccttctttggatggggtgtttgtgccaagtagcatcaccaactgctgttcatccttgacatgggtgtcctggggtcaggtgtttcctctggcccagttagcagggaggaatgtcatatggtttagaaaggagggcccagggctggccgtctcttggaggggcccgggatggggtacgcccccttggaaggggatggtggttgcggtgggcgctgtaaatgttgtgtccagct

SEQ ID NO: 173869 - DNA, 601 bp, Human
tacagtgtattcattgagggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagatcaccgtgggaggtagcaggagtcagtctttaaaaaaattattgggccgggcatggtggctcacacctgtaatctcagyactttgggaggccaaggcgggtggatcatgaggtcaggagatcaagaccagcctggccaacatggtgaaaccccgtctctattaaaaatacaaaaatcagctgagtgtggtggcaagtgcctgtaatcccagctactcgggaggctgaggcaggagaatcccttgaaccagtgagtcggaggttgcagtgagccgagatggtgccactgcactccagcctggcgacagagtgagactccgtcttaaaaaaaaaaaaatttatatatatatatatgtatatatgaattaattaatttaatg

SEQ ID NO: 173870 - DNA, 601 bp, Human
tgctttgagggtccactggagcaagagaagcttgagagtctgtctctgagatcccagaacagacatgaagatatggtaccgattcccttggtgctaaaaggaactccaggggaatttcaggaaacccctccttttctcgtctttattctcaccccgtccccccgccacctctctccccaagttcacactcaggagggaggaatcttttaccttttccgttctgggcagcagctgtagggaatgttatcagtgttgggactgggcacgggaccaagccttcctggtgcctggactgcaaccwagctgagagctgacatggcagggcgagttgtgtgtgagttggctgcccctaggctcataggcctagcacaatagagaccctgtcaatggagggacactatcaggcaggtcactatcaatgtgacagacactatcaggcaggtcacattggtgcagatccttggaggactcccccccaccccccatgagtggattcctccaggtcaggggctggctgggactgtggatgctggagtaagtggaattgtgggtgcactctgcttcagcagtactctccaaggagaatgattgttttaataaa

SEQ ID NO: 173871 - DNA, 601 bp, Human
gcccaggctggagtgcagtggcacgatctcggctcactgcacctctgcctcctggattcacaccattctcctgcctcagcctccagagtagctgggactacaggcacccgccaccacgcccgactaattttttgtatttttagcagagacggggtttcaccgtgttagccaggatggtgtagatctcctgaccttgtgatcctcccgcctcagccttccaaagggagggattactggcgtgagtcaccgcgcctggcctttattttttatttcttttgagatggagttttgctctgtcacscaggctggagtacggtggtgggatctcgcctcactgcaacttgcgcctcccgggttcaagcgattctccagcctcagcctcctgagtagctgggattacaggcgtgtgccaccgcctccagctaatttttgtatttttagtagagaccgggcttcaccatgttggccaggctggtctcgaactcctgacctcaggtgagcgtcctgccttggcctcccaaagtgctgggattacaggcgtgagccactacacccagccaatcagttgcttttaaactacttaaataaaaagagccaaccc

SEQ ID NO: 173872 - DNA, 601 bp, Human
cctgccttttgggaagaaatgaaaaaagaagcagcacgagtctccatacatcatgattgtgatggcactgggcctgagaccttttctgctgtccaggtaaaaatgtgaagaccatggttttgaggtttcttaataaattcaggtgttaagtgccaagtgatgctcccagcccctgagctagagcaactatgctgttcatgtccccaggaatggaagtggaccctagttaggtgctggtggccagccatgtgtacctagggcagggccaggtcgtgtgtgtgtgtgtgtgtgtgtgtgtgtgagagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagagaaagaaatgttgaattatcatcttggtgatggtcaactctgaaagcctaaattttcatgatcaccaaagtgtttggatttaaaagggtggctcactccgtaattccggcactttgggag

SEQ ID NO: 173873 - DNA, 601 bp, Human
gagcaactatgctgttcatgtccccaggaatggaagtggaccctagttaggtgctggtggccagccatgtgtacctagggcagggccaggtcgtgtgtgtgtgtgtgtgtgtgtgtgtgtgagagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagrgaaagaaatgttgaattatcatcttggtgatggtcaactctgaaagcctaaattttcatgatcaccaaagtgtttggatttaaaagggtggctcactccgtaattccggcactttgggaggctgaggcagaaggatcacttgagcccagaagtttcagactaggctgggcaacaaagcaagacccggtctctaccaaaaaaaaaaaaaaaaaaaaaaaaaaaaaatcaaaaaaattagctgggggtggtggtgtgctcctatagctccagctactcaggaggctgaggcgggaggatcgc

SEQ ID NO: 173874 - DNA, 601 bp, Human
cagtgtgactcaccacaccggactgcctggccctgctgcctgccgcccatccttgcggcctggacgactccatgtgcgagttgctggcgcagcgtccagaaaacagaccacaccccaggaatgatgatacgttatagcatttctctgctctgtaagagaggcaccagggtcgtgtgctgggtctggggtttgtccattccacatccggtgctgctgttgactctggtgtcggccgctggtgagctggctgtagctggtcacctctgggtggtttctggggcggtcgcaggctgactaacayaccaaaggtcagccagggtgttgaagctggcacctttcttcctggagcacagacgtcatcttggatcttttagatacttggacttactttatgcagaacattctggatttgtgaattagatggactctttattattttgtatttggattatttctttaaagagatcagagataaaaatatcattgttttgccagtttgctaccaccagcccacacccctcttcccgttgtccaaaaagggggtggttagagttttcttgagtgactgggctattatgattagcagattactaaagctgtg

SEQ ID NO: 173875 - DNA, 601 bp, Human
atcttttagatacttggacttactttatgcagaacattctggatttgtgaattagatggactctttattattttgtatttggattatttctttaaagagatcagagataaaaatatcattgttttgccagtttgctaccaccagcccacacccctcttcccgttgtccaaaaagggggtggttagagttttcttgagtgactgggctattatgattagcagattactaaagctgtgtgattttaacaagacgtaaacacatatgggaacccctccttccatatcttgctaatgtcaattarcaacatattaatcttgctaatgtcaatcctgtcacttcatacatttataaatattagggacatttaaaagagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccataggcagattttcataccagttgc

SEQ ID NO: 173876 - DNA, 601 bp, Human
ccatatcttgctaatgtcaattagcaacatattaatcttgctaatgtcaatcctgtcacttcatacatttataaatattagggacatttaaaagagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccayaggcagattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagg

SEQ ID NO: 173877 - DNA, 601 bp, Human
cttgctaatgtcaattagcaacatattaatcttgctaatgtcaatcctgtcacttcatacatttataaatattagggacatttaaaagagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccataggcarattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctgg

SEQ ID NO: 173878 - DNA, 601 bp, Human
agagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccataggcagattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctggctctgttgtccagatcataactcactgtaaccttgatctcctgggctgaagcaatcttctcaccttagtctcccaaagcatgctgg

SEQ ID NO: 173879 - DNA, 601 bp, Human
taaactttaaagctggggcctccacgccataggcagattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctggctctgttgtccagatcataactcactgtaaccttgatctcctgggctgaagcaatcttctcaccttagtctcccaaagcatgctgggattacaggtataagccacagtgcccagcctgaaaagaatactttaaatgggcggggtaatggtggcttatgcctgtaatcccagcactttgggaggcagaggcgggcagatcacctgaggtcaggagttcgagaccagcctggccaacatggtgaaaccctatctctactaaaaatac

SEQ ID NO: 173880 - DNA, 601 bp, Human
cctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctggctctgttgtccagatcataactmactgtaaccttgatctcctgggctgaagcaatcttctcaccttagtctcccaaagcatgctgggattacaggtataagccacagtgcccagcctgaaaagaatactttaaatgggcggggtaatggtggcttatgcctgtaatcccagcactttgggaggcagaggcgggcagatcacctgaggtcaggagttcgagaccagcctggccaacatggtgaaaccctatctctactaaaaatacaaaaattagccgggagtggtgatgggcacctgtaatccgagctctcctggaggctgag

SEQ ID NO: 173881 - DNA, 601 bp, Human
acagtgagctgagatcgtgccattgcactccagcctgggcgacaagagcgaaactctgtgtccaaaaaaaaaagaaaagaaaaaagaaaaaaagagtatctttaaatgaatggcaacccaatttgcaaatgtattttttttaatgttgccaattactttatgtgtttaaaaaatatctttctggtttactagggtattcttcaaaaaaagagaaaagattaaagctgcacagacatgatgatgtaaaagctagtagcttctcaagctgtgaaaggtctgtggtgcagagaatagctccctrtgagctgaattttgtttgctgtggtgcagcatgggtttagatcctacctggttagtgaaagagataatgtgaagtcattgcatttgcatttgtcaaaatcctagttttccacttacctaatagttttttgtttgtttgtttgtttcattttgtttttaaagacaggatcttacagccggggcctgtaatcctagcactctgggaggctgaggcgagttgatcacctgaggtcaggagttcgagacacacctggccaacatggtgaaaccctgtctctactaaaaatacaaaaattagcca

SEQ ID NO: 173882 - DNA, 601 bp, Human
aggctgaggcgagttgatcacctgaggtcaggagttcgagacacacctggccaacatggtgaaaccctgtctctactaaaaatacaaaaattagccaggcgtggtggcacgtgcctgtaatcccagctactggggaggctgaggcaggagaatcacttaaacccaggaggcgaaggttgtagtgagccgaaatcacgccactgcactccagcgtaggcaacagagcaagactccatctcaaaaaaaaaaaaaaaaaaaaaagacaggatcttgctctgtcacccaggctgggatatactgrcttgatcatagctcactgcaacctttagctcctggactcaagcaatcctccagcatcagcctcctgagcagctgggactataggtgtgaattaccatgcctggctaacttttttattttttgtagagacagggtcttaccctattgcctaggctggtttcgaactcctggcctcaagtgatccttttgcctttgcctcccaaagtgctgggattacatgcgtgaaacaccacacctgaactagtctttttgttgttgttgttaaagtgagagacccagaccaaaatcatctttcttctcc

SEQ ID NO: 173883 - DNA, 601 bp, Human
gcccaaggcaactgtcaatctactttctgtttctatggatttgcctgttctggcattagatatatacatgaagtcataaaatttgtggtcctttgtgactgcttctttcgcttaacttaaatgttttcaaggttcgtccatgttgctgcatgtatcaggacataatttctttctttttcttttcttcttttttttttttttttgagatagagtcttgctgtgtcgcccaggctggagtgcagtggcatatctcggctcactgcaacctctgcctcccaggttcaggcgattcacctgcctyggcctcctgtgtagcaggcccatgccaccacgcctggcttgcttatttatttatttatttatttatttatttatttatttatttattgtatttttagtagagatggggtttcaccatgttggctaggctggtgtagaactcctgacctcaagtgatctgccctccttggcctcccaaagtgctgggattacaggcatgagccactgtgcctggccaggactttattccttttatggctgaataatatttcattatatggatatcccatattttgttgacccattcatcagttgatggcaa

SEQ ID NO: 173884 - DNA, 601 bp, Human
tggcaacagcagattctttttttgttttttttttttctgagatggaattttgctctgtcacccaggctggagtgcagtggtgtgatttcatctcactgcaacctccgcctcctgggttcaagtgattctcctgcctcagcctcccgagtagctgggattacaggtgcctgccacaatgcctggctaatttttgtatttttaatagagacgggggtttcaccatgttggccaggctggtctcaaactcctgaccttaagtgatccacccatcctggcctcccaaagtgctgggattacaggygtgagccagtgcgctgggccagccacagcagattctgacaggtgatgcccttgccagcctggggagccttttggttttgggtttggtttttaaatttgttactgttttggtggttgtttttacctgttgtaaatattaagaagcctaggcatgatgatgctctgaagacaggaaaatttgttttgtcccgatttgccacacggactcctgcctgcatctgcgttgatgtggccacacggagagctgctctgctcaggagatccagcccgggccagcagctttataatcagttctgatcgc

SEQ ID NO: 173885 - DNA, 601 bp, Human
ttggaattcatatactggggcaagtattggaaccaaggttgccagcgaatggggctggcaagtcttttttcaagtttccttgtgtgttcccattctgaacaaggtggtgtcaagttgatcctgcctgtgggaatgcattgttcttgaatatttatatctttgtatgctcccattgggatttctcctttcataatatctgaaaagaacttgttttcattaaagccatttcaatttcgtacatttttatgcaataatttagtgtttatggtgtctcttaaccaacatggcttgttttcataarcacccgagaaggtttaaataacattttctcataaattagccctcgtttgcacacttattcagttattgcatcatgaagaccctctggagtttgatgttgtcaggaaacatattagcagaaaatagtgtgttattatctaatgctaataattggttagtggaaatgagaaaagaggatatgtaattggggttcctgtggctaacaagatgtgaattatgaaagcatttccaggagaaattccaggggtgttccaggaacctgttatttacattttaaaacatttgattcccattgaaaggg

SEQ ID NO: 173886 - DNA, 601 bp, Human
ggtttttcatgcttgctcgctattgacttgtctggaaagattatactgttaaggacagagactctgtcagttgcatatggaaataatggatataaagattgcaaggagagttcattttccacctgcttgaggtcacattgaacctcatccctgttgcggaaaacaaatgggagtgatagctggtgccagttagtgtatggatgtcctcgaaattagatgtgccttcaaaaagacttgatttaatgttagccaggtctgtttgaacttcattattactattattattttgagatggagtgtygctctgttgcccaggctgcgcccaggctggagtgcagtggcatgatctcggctcactgcaacctctgcctcccaggttcaagcaattctcctgcctcagcctcctgagtatgtgggattacaggtgcctgccaccacgtctggctaatttttgtatttttagtagacacagggtttcaccatgttggccaggctggtctcgaactcttgacctcaagtggtctgcctgccttgacctcccaaagtgctgggattataggtgtgagccactaccattttttttttttttttgcgtgccttg

SEQ ID NO: 173887 - DNA, 601 bp, Human
agtcatggaattccataatctgcatcatcaagtgtcatggtctgtagctgggaagctggagacccaggagagtccatggtgcagctctagtctgagtctaaaggctggaggactggtagaactgatggtgtaattccttttcaaaggccggtgggctggagcccagagatgctgctttagctcaagcccgaaggcagttactcaggaggatgccggctggtttggaggaagatcagccttgtattctgttcaggccttcagctgatgggctgaggcctgctcacatcaaggaggaccatcygccttactcagtgaatgttaaacttatctaaaaatatcctcagagaaacatccagaatagtgtataaccaaatatccgggcaccttgtgacttagtcaaactgacacataaggccaggcatggtggctcacacctgtagtaatcccagcactttgggaggccgaggtgggcggatcacttgagaccaggagttggataccagcctggccaacatggtgaaacccggtctctaccaaaaaaaatacaaacattagccgggagtggtgttgtgcacctgtattcccagctactcgggaggct

SEQ ID NO: 173888 - DNA, 601 bp, Human
gccttcagctgatgggctgaggcctgctcacatcaaggaggaccatccgccttactcagtgaatgttaaacttatctaaaaatatcctcagagaaacatccagaatagtgtataaccaaatatccgggcaccttgtgacttagtcaaactgacacataaggccaggcatggtggctcacacctgtagtaatcccagcactttgggaggccgaggtgggcggatcacttgagaccaggagttggataccagcctggccaacatggtgaaacccggtctctaccaaaaaaaatacaaacattwgccgggagtggtgttgtgcacctgtattcccagctactcgggaggctgtcacaagaatcgcttgaacccgggaggcggaggttgcagtgagctgagattgcacccctgcactccagcctgggtgacaaagtgagactctgtctcaagccacccccccccaaaaaaaaaaaacaaaaaaccctgacacataaaattaatcaccaccagagttttctgaggcaaagaggagtaaagctgttgcctttttcttcttgcctgtgaggttggttgagattcttctaacagccaacaggtgttggc

SEQ ID NO: 173889 - DNA, 601 bp, Human
tctctaccaaaaaaaatacaaacattagccgggagtggtgttgtgcacctgtattcccagctactcgggaggctgtcacaagaatcgcttgaacccgggaggcggaggttgcagtgagctgagattgcacccctgcactccagcctgggtgacaaagtgagactctgtctcaagccacccccccccaaaaaaaaaaaacaaaaaaccctgacacataaaattaatcaccaccagagttttctgaggcaaagaggagtaaagctgttgcctttttcttcttgcctgtgaggttggttgagaktcttctaacagccaacaggtgttggccaatgttactctgattgacacctttctttttttttattcaggtttccctctgtcacccaggctggagtgcgggggcacaatcatggctcactgcagccttgatcttccaggcttaaccaaacctttcaccttggccttctgagtagctacaggcctgcaccaccacatctggctattttttttttttttttaatttttagtagagacgaggtcttgctatgttgcccagtctagtcttgaactcttgagctcaagcagtcctccagccttggcc

SEQ ID NO: 173890 - DNA, 601 bp, Human
aaaccctgacacataaaattaatcaccaccagagttttctgaggcaaagaggagtaaagctgttgcctttttcttcttgcctgtgaggttggttgagattcttctaacagccaacaggtgttggccaatgttactctgattgacacctttctttttttttattcaggtttccctctgtcacccaggctggagtgcgggggcacaatcatggctcactgcagccttgatcttccaggcttaaccaaacctttcaccttggccttctgagtagctacaggcctgcaccaccacatctggctattttttttttttttttaatttttagtagagacgaggtcttgctatgttgcccagtctagtcttgaactcttgagctcaagcagtcctccagccttggcctctgacagtgctgggattataggtgtaagccaccacacccagccctgagtgacattatttcatacaaaattctcatctctggaggcctttgtatttttaggggttttgtttttcaaatgctttttacctctttctatacttgttcatttttaaatgtttcctggcagagcaattagtattttctggcttactaggtgctatt

SEQ ID NO: 173891 - DNA, 601 bp, Human
ttcaaagccagtagcccctgatgcgctgttggacgtgaactataaatttggctctgaggttcccaggcatggaagaatatctagatctgtacagagaggttgtgtgtgtgtttaacatttccataatgtacaatttcctctaagagtaaaggccatgaggaaatgcccgtggaagataaaggagaccatgtggtctgtggcaaccatggatacatttctttcccaacgcattctctgaggcactttggtaactctgcctctttgctctcagcattgtgttagaaaataaagccagcagacwaggattaaaccctcatgttgctgggttccttctagaaacaattggagggctaaccaagtcacctttggtggaaggcagtaaggtgagtcattgctgtggctggactgaataggatagccttagctgtaaaattgggctgatctttcaaatggactcatgcttgccgaatgactcacgctcctgtttacaaatcagctctgtgaagaaatgcagagtgggaggctctgcttgccagacggagaccttagacctccaggggtggagaacggagtacttcctctggtgctcggcttcccttcc

SEQ ID NO: 173892 - DNA, 601 bp, Human
ggattaaaccctcatgttgctgggttccttctagaaacaattggagggctaaccaagtcacctttggtggaaggcagtaaggtgagtcattgctgtggctggactgaataggatagccttagctgtaaaattgggctgatctttcaaatggactcatgcttgccgaatgactcacgctcctgtttacaaatcagctctgtgaagaaatgcagagtgggaggctctgcttgccagacggagaccttagacctccaggggtggagaacggagtacttcctctggtgctcggcttcccttcctgggggcagatctctcagcttctggttggtggctctcaaaatccagacacaaggtcagctgcagccagcgtgggccctggagtagctccagttatggggcagcaatggccccctctcattttgagagctcactttgcctgtggatggttttaatccatctggataaacttgaggcccatgggaataccatatactatggtaaccatgtacactgctctaaagatgtggctgctgttgtataactttttcctttatttttgtcaatttcctattttccagagtcttgcatacccactatgtct

SEQ ID NO: 173893 - DNA, 601 bp, Human
gataaacttgaggcccatgggaataccatatactatggtaaccatgtacactgctctaaagatgtggctgctgttgtataactttttcctttatttttgtcaatttcctattttccagagtcttgcatacccactatgtctactgtgatagtgaacgtaaaaacatacaagatgttggtgttatcctcaatctcttattcttaatcctgaacaaattacatgaaaaaatcgttcatggagtttttcttcatataaaactttttacaatgaacataaagggcatagctatttcttttttttwaaaaagaaacgtagaatattatttcttggttgtgaaatcgcccttcttggaccccaagttgttttttacagccctaaattctcttgtttatagagcctgtttatagagccatagacaggccaatgggtctctacagcaggcacctgcatgagttgactgggacctgagctatattccccctctgccatttactagcagtgtgaccttgggcatgctccttacagtctctgagtcagtttcctcctctgtgaaatgggcatgatactacctacctcataaggtaggggtgaggattaatgg

SEQ ID NO: 173894 - DNA, 601 bp, Human
aaatgtgggttagggcagaaaggaaggctgggggctgtgtgtgccttggtgacgtgtccccctcgctcccgagccttactctgttcccctttcttcctggcagcagagccccctcccttgctgcactcagggacatgactgtcagcacttctaccccccctcagacttcactgtcagcactcaagtcttcagggacatgaaaaggagccactccttacaaaaagttggggagccctggtgtattgaggtaggtctcggagcagaatcacggtatgagatgagctagctctaaaatgaagcygcccacccaaagtttacctctctctagggcagggcccatccactgcgatccctgaattcttgttgggtcactgtcattttgggtgccatgatgtctgggtgtgctgaccgctgatagggatatcatagccataaaaacgcctgtttacaaggagagggtggagggtggtgctcgcatgactccaggatgcctggctcccagtgaaggccctcgtgatccagtgccacacgtaacttctgtgaaaatgaggagcacaacattatcccattaaacttggccccaggaagtgtctcttgggac

SEQ ID NO: 173895 - DNA, 601 bp, Human
tggtgacgtgtccccctcgctcccgagccttactctgttcccctttcttcctggcagcagagccccctcccttgctgcactcagggacatgactgtcagcacttctaccccccctcagacttcactgtcagcactcaagtcttcagggacatgaaaaggagccactccttacaaaaagttggggagccctggtgtattgaggtaggtctcggagcagaatcacggtatgagatgagctagctctaaaatgaagccgcccacccaaagtttacctctctctagggcagggcccatccactgygatccctgaattcttgttgggtcactgtcattttgggtgccatgatgtctgggtgtgctgaccgctgatagggatatcatagccataaaaacgcctgtttacaaggagagggtggagggtggtgctcgcatgactccaggatgcctggctcccagtgaaggccctcgtgatccagtgccacacgtaacttctgtgaaaatgaggagcacaacattatcccattaaacttggccccaggaagtgtctcttgggactcttcacagttcacaatggaggagaagttaccacctcaactttgcc

SEQ ID NO: 173896 - DNA, 601 bp, Human
attcagccagattcgaaccctttagatcccttcctctagggaattaaggttggtagaccagctgagtaaatgtgactcagaaagtcaatatccacctgggcagggatgagtcatttctttctagttagctattcatgtacattttaaagctcgccacacaaagtcattacattgaggctattaacatgtttaatagtgacaataatagggtgtgacccatggcatataaccgcattcagataagaagaaagagttttcttttttcttcttcctgtaattgctcagtcaataccattttcayggaaatacttgcaaacaaacttttaaaaagttcattgtccaaagccttccctgattccttgtttccttcctcttcaggggttctataaacttttcctgatcagtggccggggattagcgagatggtgcactctgtcctgattttgtggttgacctacccttttgctggtgttgagcctgtttttattgcattttttggggtgtgtgtgcgcgtgcacgcgcatgtgtgttttttcaggagggggcacattattgctgctacttgcttattaacctctcaatctagaaatttcagggaaga

SEQ ID NO: 173897 - DNA, 601 bp, Human
gtgttttttcaggagggggcacattattgctgctacttgcttattaacctctcaatctagaaatttcagggaagaagagacttccgctaaatttgccaagctagacacataaacagggagttagccattttggtgagaggaaatgaaacttttcttgggtttattagaccacatcctatgtggcttattttatgtctgatttctaaaaagcatgtcatcacggtcaaagttttatttttgcttgttagtcatttgaaacaaatatagatattgcttcatttcctgggtactgtatttttcrgtacgtggtatgtatggaaaatttgggtttacacaatgaagtgcactagaagggaagtatttgctaatttagaactctctacattataactttggattagcaagcattcggctaactaaacattttcatttatctcctacccctgattatataaagaagcagatgagacaaccaaagaaatacccctccaagacaaagtgaatattttgaaatacttcctctcagtcttttaaaaaatgtgatttaaaaatcgtaggtgggatcatactatacatgcacttgttttctgtttattttaca

SEQ ID NO: 173898 - DNA, 601 bp, Human
ggtcaaagttttatttttgcttgttagtcatttgaaacaaatatagatattgcttcatttcctgggtactgtatttttcagtacgtggtatgtatggaaaatttgggtttacacaatgaagtgcactagaagggaagtatttgctaatttagaactctctacattataactttggattagcaagcattcggctaactaaacattttcatttatctcctacccctgattatataaagaagcagatgagacaaccaaagaaatacccctccaagacaaagtgaatattttgaaatacttcctytcagtcttttaaaaaatgtgatttaaaaatcgtaggtgggatcatactatacatgcacttgttttctgtttattttacatctctctatactagaaacactttcctatatatgccacaaaaactgtgaaagtactaatgattatccctcctgtcccttaatatgcttagctattgccccaatgaactcagactgtttccaaagttccgctgttggccgggcactgtggctcatgcctgaaatcccaacactttgagaggctgaggcaggtggatcacttgaggccaggagtttgagaccag

SEQ ID NO: 173899 - DNA, 601 bp, Human
ccccagttcatgctcactgggtaggatgggaggtgggactgccagattatttttattttttcctttcccacattgtctatctgccaatatttttttgttgaagtcttttaggctaaatgagcggacaaattttctctgctgatcaaccgccgtggtagcatcagtgggcactgcagtgcctccctgggaatttttaatgcctcagtgaggtcatattcccagtgtagagggaacatgacgtagtcccactctacttatcagatgcagagcttgctaccaggaaaacagacgcggagaagcygggatcatttctggccccatttccctcattgttcaccattccttggactgcaaagagatgtcattgtaaacgctatccttttcattttgtatactaagcaggaagcccaggcactctctgtggaggtcttccaaggagctcatccatgcagaagataggagtgttcctgcaccctgcatcctagcctcagtgagcccacttgacaccccccagggtgctgcaagctgtgcccatgtctctccacgttagtggctacctcccttttcccctttcgtcgtgagtcacgtattttctttgtgt

SEQ ID NO: 173900 - DNA, 601 bp, Human
ctctgtcacgtagtgctcatcccagctcctgcctgctaggtttgtggcaatatttgtggtaagccttgtggttcgccaggggccagggtgacagatgagaagtccacttgttcctgagaaatgagctccactagaaagtaggagcagcttgtaaccaaccagggggaagtcctgtgtgtaggttgtcacaactctctctcaggacaaatttctttcctcttgccagttgtagaagaacccatgaggaggccgggcacggtggctcacgcctataatcccagcactttgggaagccaaggcrggtgaatcacctgaggtcaggagttcgagaccagcctggccaacatggtaaaaccccatctctactgaaaatacaaaaattagccagacatggtggcaggcacctgtaatcccagctcctcgggaggccgaggcagaagaatcacctgaacctgggaggtggaagttgcagtgagccaagactgcaccactgcagggtgacagagtaagactcttgtctcggaaaaaaaaaaaaaaaaaaaaaaaaaaaccaaccatgagaaagatatatggaggtgagagggaaaggtgtaccctggag

SEQ ID NO: 173901 - DNA, 601 bp, Human
ttcattgtgggctgtccttgcctgtacacctagcatgctctggaaccctttgtggatttatgagaattcaagctaattccaacagtggccaaagaaaaaaatagccagggaaatatgttattgctaaccatataggcctcagagtgaaaacggcttttggagtattctgctttgaattatttattttagtctttctcagatgtcaggacagatttttaagatttgggcataatgtttaaaatgaagatggtatgtctgtagattttattgacccaacttggtccccccaggctgtcctcayctgccccactacttagatgaaaccaggaatggcaagaggagagcatccaagccgcctgcaccagccctcagtgcatccccacccaggctctggaacgagctgctacatgcacgggaagaccagagctgccgtcttcctggctgttgttcagagcttatgctttcttagggaaaagtacaatgtagggctatgtgtgtggtggggatcttctgtgtgtgcttgtcctccccctgggaaatgatgagaggtgacccccgagctcccagctcagtgtcacactcgagtgaacagtagatgatg

SEQ ID NO: 173902 - DNA, 601 bp, Human
atatatcttatctcataagatagctgggcacagttgttcaggcctatattgtcagggctttgggaggcctcaaggatcgcttgaaggcaggagtttgagaccagcttgggcaacatagcaagaccccatctctacaaaaaattaaaaagttatccaggcatggtggtgcatacctgtagtcccagctacttgggaggccgaggcaagagaatttcttgagtctaggagttcgaggctgcagtgagctctaattgagccactgcactccagcttgggtggcagaacgaaaccttgcctcttraaaaaagaagagaggggctgggcgcggtggctcacgcctgtaatcccagcactttgggaggttgaggtgggcggatcacaaggtcaggagatcgagatcatcctggctaacacagtgaaactctgtctctactaaaaaatacaaaaaattagctgggcatggtggcggccgcctgtagtcccagctacttgggaggctgaggcaggagaatggcgtgaacccaggacggggagcttgcagtgagccgagattgtgccactgcactccagcctgggcgacagagcgagactccgtctcaaa

SEQ ID NO: 173903 - DNA, 601 bp, Human
aaggatcgcttgaaggcaggagtttgagaccagcttgggcaacatagcaagaccccatctctacaaaaaattaaaaagttatccaggcatggtggtgcatacctgtagtcccagctacttgggaggccgaggcaagagaatttcttgagtctaggagttcgaggctgcagtgagctctaattgagccactgcactccagcttgggtggcagaacgaaaccttgcctcttaaaaaaagaagagaggggctgggcgcggtggctcacgcctgtaatcccagcactttgggaggttgaggtggscggatcacaaggtcaggagatcgagatcatcctggctaacacagtgaaactctgtctctactaaaaaatacaaaaaattagctgggcatggtggcggccgcctgtagtcccagctacttgggaggctgaggcaggagaatggcgtgaacccaggacggggagcttgcagtgagccgagattgtgccactgcactccagcctgggcgacagagcgagactccgtctcaaaaaaaaaaaaaaagagaggtgtggtggctcatgcctataatcccagcactttgggaggccaaggcgggtgga

SEQ ID NO: 173904 - DNA, 601 bp, Human
ttacaggcatgagcacctggccatatctgtattttttaattcacttctttgatttgggaggaaagaaacctgaaccctcttcttagtgggagtgggataggctttaatgttaatactatgcatcatgtattaaaaatccactatccttctggcactggattaagcttttcataagtattattgtttcacccttacagctgccacagaagagaaaaaccaatattatttaaagtttatgtataaataagctagtcgctaacatgtactcagcacttactgtataccaggctctgccttaagyggttttcatatattaactcatttaatctgctcaatttgtgggaaccattttttctcattttatagagaggaaactggtgcagactttttttttctttttaataatttgtccttggttccactgaaagtaattgttaggactgggatttgaaggctgggtcttcaaatgttgtccaaacgaggctgcccacctccccatcaatgacaaccttctgtcctgtaatgtggaagtgggcccagctgtatgagaagctcagagcacacagatgctgtccagatatgctggcttctgatccttgca

SEQ ID NO: 173905 - DNA, 601 bp, Human
tattcttctcatagccagaggccaagatcccttgtggagcagtgcctgaatttaatagatgtcatctggacaccagggaggggcattgagaagcactgggggaaaagtcttagaagtgagattttacccctaacgccgtctcccagcctcttatttatccttttcagggcaatgcagcctgtgatttttttggtggtaccatagtgtcatataccatactctacaattctaggacaaaggacacagtgtcctaatggtcttgcagatggcctaaaatacatatggtaagccacttatttamtttgatctcaaatatctcagcattactgagctctacacctggatgtttacaaagcctgaagatctgtacccactgctgtaacatcaggtgacactcaaggaacacaattctactcttctggctgtctggggtcttgggtcccaggctagggtctaaggcagacaagacagtaccatcccattagcttggtacatgaggcttaaacagttcctcgaagtcatggggtgaaggagggcacagttaactcagcccccgcttattcaaatatcagattgctggctgatagtctccctccctgca

SEQ ID NO: 173906 - DNA, 601 bp, Human
gggactccagcttttgggacagcttgagtccatttagtaaaatgttattgaggacttctgtgccaggcagggttctggtgttggggacaagggtgtgagtgagaggactgagttgttgcctttaggaagtgtaccgtctagccaggagtaacggcttgagtcgaagtcggctcccattgggcctcttagggagtcccagtttgctctgaggcctgctcctctctgggaagaaatcaccttgagagcttctgggatttggaactccctgcatggttggatcccttccatcttcatgtgaatygtcttggtaatgaggctgcccaggaaagccataacacagggacatttggtgggcaggtccactttcgaagttctgggagttaccgtggctattgttctgactgcagtctagatgctcccaggcccatttctctcctttttcactctttagttctgcctggtgaccagggaggtgccccgcacctcacctgtctagtggggtttcccaccacacttccaattcttgctcattcaacatcaagtctttgctctgcctttcttcgaatcacgaagatcctgtctgccagaagcatcctgtcca

SEQ ID NO: 173907 - DNA, 601 bp, Human
ctgggaagaaatcaccttgagagcttctgggatttggaactccctgcatggttggatcccttccatcttcatgtgaattgtcttggtaatgaggctgcccaggaaagccataacacagggacatttggtgggcaggtccactttcgaagttctgggagttaccgtggctattgttctgactgcagtctagatgctcccaggcccatttctctcctttttcactctttagttctgcctggtgaccagggaggtgccccgcacctcacctgtctagtggggtttcccaccacacttccaattattgctcattcaacatcaagtctttgctctgcctttcttcgaatcacgaagatcctgtctgccagaagcatcctgtccaggttccaggcagacgacagtctctgagcattccagggtcttacagtttagaaagaggagagagcaagagaatcttaaaagcaccataagctggagctgtttagaatagagcaaacggcccttggggctctggcaattgatgtttgtaattagtatcctgatttattaagaagagtttgttgtctccaggattaaaacaaaacaaaacaaaaaaatagattct

SEQ ID NO: 173908 - DNA, 601 bp, Human
cttggtaatgaggctgcccaggaaagccataacacagggacatttggtgggcaggtccactttcgaagttctgggagttaccgtggctattgttctgactgcagtctagatgctcccaggcccatttctctcctttttcactctttagttctgcctggtgaccagggaggtgccccgcacctcacctgtctagtggggtttcccaccacacttccaattcttgctcattcaacatcaagtctttgctctgcctttcttcgaatcacgaagatcctgtctgccagaagcatcctgtccaggytccaggcagacgacagtctctgagcattccagggtcttacagtttagaaagaggagagagcaagagaatcttaaaagcaccataagctggagctgtttagaatagagcaaacggcccttggggctctggcaattgatgtttgtaattagtatcctgatttattaagaagagtttgttgtctccaggattaaaacaaaacaaaacaaaaaaatagattctttagggagattaattgggactgtcctgtgggtaaggagatagtaagaagatagcagtaagtggaatgttacctaacaggta

SEQ ID NO: 173909 - DNA, 601 bp, Human
gggaaatggacctgagtgcactgagaatattaatgcaaacagaccccaaccagagtaatgtgttcactgtggttggggtgggtgggtttgtagaatctgttacagaatcttggaattgtgagagcagactgataactctaacctgaccactcttcaaatcctctcttgaacagtgaggaagcagaggctcagagaaagaagactgctgtaagatcaagcaatcgtgtgtagccagacagtgggagaatcaagactagaatccagatctcttggttttcctctttcccctcggccacctccrattcaagggagagtttaattttgtgaaccattcctgttaagtgccattaatttcaaggtctttctggattagtgtgtgaaattcagtgtgttcagtatgaattcacttattttccacttgaaatcctgatttttctcggatgccccgggtgttgatatgatgatcaggaggctcgtgatggtgatgaggatggattaatataatcatctctgctaaaggttaacgagaaagcagtgagctggaattgatacataaaaaacactgaaaacttttcaagcagtgaatgtgctttagcgatac

SEQ ID NO: 173910 - DNA, 601 bp, Human
atgatcaggaggctcgtgatggtgatgaggatggattaatataatcatctctgctaaaggttaacgagaaagcagtgagctggaattgatacataaaaaacactgaaaacttttcaagcagtgaatgtgctttagcgatacatagacaatcagatcttaccatttatgtgtgtattttgaatgatgaatgaataactagtctttcccagaggactggtatttgggaatctttttataaagtgttgctttctgggctttcattaaaagctcaaacatagaaatgtatgaaaatgatcctttkaaaacaagtttggcaccaacactatgtgagaaaacttgaaaagtatataggttgtggatcaccagttctcgaactcaggaccaccctgactgagttgaccatgatcagaatggatgcaagagttcactggttttataatttttgcgaagagctgtcttctgcccttagcactcccatgtcctgtaaccaggaaacaagccggtgccctgggttgagttcagcaagtttgttttgacttgcagcccatcatgggagtgaaactctcattatgtaatgttaaactgggcctggaatgtcagc

SEQ ID NO: 173911 - DNA, 601 bp, Human
gaaattactaaccaactgggtgcggtggctcacggctgtaatctcagtcctttcagaggccaaagcaggaggatcacttgagcccaggagtttgagaccagcctgggcagcatggtgaaacctcatttctacagaaaatgcaaaaattagccaggcgtggtggcatgtgcccatcacctcagccactcgggaggctgagatgggaggatcacctgagtccaggaggtggaggctgtaatgagctgtgatcacgccactgcactccagcctgggcaactgagtgacaccttttctttaaataaataaaataaataaataaataaaattattaaccagctaatctcaaatcaattcttctaaatcctctgagcttgtttgtttttctgtctgtaaaatggggctgttttcatgtgagacttagattatgagaaatagtcacgcctaaacttccttgaggagatgctagacaaaaacaagatggttttgaaaaaaataacaccaccgtccagactgtactaagatgcctggttgcatttgaaaccagtttcacagtctgctttgggcaggtgattgcgacatgctttccatctgtgcctaatgg

SEQ ID NO: 173912 - DNA, 601 bp, Human
ttactaaccaactgggtgcggtggctcacggctgtaatctcagtcctttcagaggccaaagcaggaggatcacttgagcccaggagtttgagaccagcctgggcagcatggtgaaacctcatttctacagaaaatgcaaaaattagccaggcgtggtggcatgtgcccatcacctcagccactcgggaggctgagatgggaggatcacctgagtccaggaggtggaggctgtaatgagctgtgatcacgccactgcactccagcctgggcaactgagtgacaccttttctttaaataaataaaataaataaataaataaaattattaaccagctaatctcaaatcaattcttctaaatcctctgagcttgtttgtttttctgtctgtaaaatggggctgttttcatgtgagacttagattatgagaaatagtcacgcctaaacttccttgaggagatgctagacaaaaacaagatggttttgaaaaaaataacaccaccgtccagactgtactaagatgcctggttgcatttgaaaccagtttcacagtctgctttgggcaggtgattgcgacatgctttccatctgtgcctaatgggagt

SEQ ID NO: 173913 - DNA, 601 bp, Human
taatctcagtcctttcagaggccaaagcaggaggatcacttgagcccaggagtttgagaccagcctgggcagcatggtgaaacctcatttctacagaaaatgcaaaaattagccaggcgtggtggcatgtgcccatcacctcagccactcgggaggctgagatgggaggatcacctgagtccaggaggtggaggctgtaatgagctgtgatcacgccactgcactccagcctgggcaactgagtgacaccttttctttaaataaataaaataaataaataaataaaattattaaccagctratctcaaatcaattcttctaaatcctctgagcttgtttgtttttctgtctgtaaaatggggctgttttcatgtgagacttagattatgagaaatagtcacgcctaaacttccttgaggagatgctagacaaaaacaagatggttttgaaaaaaataacaccaccgtccagactgtactaagatgcctggttgcatttgaaaccagtttcacagtctgctttgggcaggtgattgcgacatgctttccatctgtgcctaatgggagtatactcccagctccacatggcagcaggaacattg

SEQ ID NO: 173914 - DNA, 601 bp, Human
tgcagcatttaaagaaattaaattagttttcctgggctcctcaccatctaatttgtttcccattagagataaataatgacgtttggggcatcataaacccaaggatttccatgttagttttccaaggacctttttttaagagagaggggaataagaatatttgggtcagatgttttaagatgttaaatataaaaatcagccttttaagaatcaaatgcaaagccagtcacttagccttgaatttcccactgtgattccacttttcaaaacccaggatgaccatcatgatgggtttcgttgkactatcagttgttacaggtcaaatcatagtctcatgattgttaaaatcttaataaggccccctctaatcctgtgagttttcagaaggaaatccctgtgaacaatcctggaattgctttgcctggtaacatcttatttactgacaatatccccagctgagctctcttggttaatatgtttgctctggcactgtagttcctttttaatcagaaatgcttatcagtaggttgcatggttggggaaaatggcatttattttgtagcattttcccaaggaatattggatgaatatttctttagta

SEQ ID NO: 173915 - DNA, 601 bp, Human
tttcgttggactatcagttgttacaggtcaaatcatagtctcatgattgttaaaatcttaataaggccccctctaatcctgtgagttttcagaaggaaatccctgtgaacaatcctggaattgctttgcctggtaacatcttatttactgacaatatccccagctgagctctcttggttaatatgtttgctctggcactgtagttcctttttaatcagaaatgcttatcagtaggttgcatggttggggaaaatggcatttattttgtagcattttcccaaggaatattggatgaatattyctttagtactaaatatataatggtctttgtcttaagaacttattagcactgagatttctgtgttggaattttctttattgataccggtttgtaggttctggagagtccaactgatatttttttgcatctcgatcagaagctctgactttttggtccttagcagagaatacatcccttgatatcttggaggcgcccttagtggagtcaatggtgtgtgggcttaaggagaagtcagggcattagcaggtctgtattttcctccagcgtggagttttgtcatttctaatgatgacaatctat

SEQ ID NO: 173916 - DNA, 601 bp, Human
atttctgtgttggaattttctttattgataccggtttgtaggttctggagagtccaactgatatttttttgcatctcgatcagaagctctgactttttggtccttagcagagaatacatcccttgatatcttggaggcgcccttagtggagtcaatggtgtgtgggcttaaggagaagtcagggcattagcaggtctgtattttcctccagcgtggagttttgtcatttctaatgatgacaatctatcagtccacatggttcaaaatgaagataaattgaattaatatatgtgagttaacygactcattgatataattatactgtgaggatttctttagtgtaacctaacacatttagtagtgttaattgtaatggctttgcacgggagcacttaatttcctaagcaaacagaataatttattaattctcaaaaagcgatttcaaggcctagactgagagagaaagagtatgtgttttactgtagtctcagtttgctttggcttatcagattgaaaattgctaagaatttttttccagattccaacttgttattgctacatttccatgtgtgcccaattcaatagcgtattgaaatgaaag

SEQ ID NO: 173917 - DNA, 601 bp, Human
gtttgtaggttctggagagtccaactgatatttttttgcatctcgatcagaagctctgactttttggtccttagcagagaatacatcccttgatatcttggaggcgcccttagtggagtcaatggtgtgtgggcttaaggagaagtcagggcattagcaggtctgtattttcctccagcgtggagttttgtcatttctaatgatgacaatctatcagtccacatggttcaaaatgaagataaattgaattaatatatgtgagttaaccgactcattgatataattatactgtgaggatttmtttagtgtaacctaacacatttagtagtgttaattgtaatggctttgcacgggagcacttaatttcctaagcaaacagaataatttattaattctcaaaaagcgatttcaaggcctagactgagagagaaagagtatgtgttttactgtagtctcagtttgctttggcttatcagattgaaaattgctaagaatttttttccagattccaacttgttattgctacatttccatgtgtgcccaattcaatagcgtattgaaatgaaagtaggaaataggtaccgtccagtaaatcttaatt

SEQ ID NO: 173918 - DNA, 601 bp, Human
tcctaagcaaacagaataatttattaattctcaaaaagcgatttcaaggcctagactgagagagaaagagtatgtgttttactgtagtctcagtttgctttggcttatcagattgaaaattgctaagaatttttttccagattccaacttgttattgctacatttccatgtgtgcccaattcaatagcgtattgaaatgaaagtaggaaataggtaccgtccagtaaatcttaattaagttattgaaaattgaagagcactgaataataaagcagttctaattgcagttaaaactgtattsgcagcagatatgcttgaacagggatgataaaacagctgaggaagagcgttggatggcagaatcgaaaaagggtaatacacagattaaatgcaaaactcaaatgttttgtgaaatgtaggcaagctgtgtaaacctattttttgctggaaagcatgttttctgtcatgtcagaaatgatcacaggaatccttttaatattcatttaaatagtttttaattggcttcagagagtttaaagttcagcatgaaggtgagatctaagcttactaattagatcgaatgcagtttgacttaaagagc

SEQ ID NO: 173919 - DNA, 601 bp, Human
gtgataattaggtgaagcacattgggcagatgaataatggttttgtctctggcttggactatttggacgaggcttatatgtctgtcttgaggtgatcagtgggaagaggggaaattttactggaaacttgtttcttaaagaagagaaaggggtatgtggatagtaagacttatttagttttgtagggagggacagagtgttggtttttctccataaaaacatttgggttttgaatgacagactttgttgccttttctttttcattttttaaagttttcaaccaactggtcatctggggggtgtgtgtgtgtgtgtgtgtgtgtgtgtgtgtttgttcacctacacatttgcctggagtatagtgagaacccaggaaaatggataggccctaccaggagaggctgcaatctgttggggaagttttttttttgtttttttttgtttttttttttttgttttttttattttattttattcccaagccttggttgctatttgatagtaagtgtggtccaggctgcatattttataaactttctattaaagttgtggcatgttatcataaaactcaattgcgatactttgtattacgctctgggat

SEQ ID NO: 173920 - DNA, 601 bp, Human
tgatagtaagtgtggtccaggctgcatattttataaactttctattaaagttgtggcatgttatcataaaactcaattgcgatactttgtattacgctctgggattgagagatagacataggattaaaaaaacaatttctaggcatttctagatgataaatttaattttctttgctatttggaggtcttctttgaaaatgcaattgtaatgaacgcattcagaactggagaatagatttacccttggcttcaaatagtcgacgttatcaggcgctgtcattcgttccttcctattttcggsctgctaattgatgtttttgatgtcagcaagaaaattgaagaaaatgtcatgtgtgaaccagtgcggaagttaataagattgacttcgttgacagaatttacaatgagagcagagaccgcataatgggaccgctgcgaattcgtgtgctctctttggagtcaaaattgacacctcacgctaggccagtggtcgataggagagatggaacatttgggaaagttcctaatctcatttttccccccttaccttttggtctccgatggtgatttagtttcaccggcagctgtttatccagggggc

SEQ ID NO: 173921 - DNA, 601 bp, Human
acaatgcttattttttatgctgttttgagtttgaaagcaaaagagtcttaaaaaggttagattaagatgtgtcttaaggaaagatatactaatatcggtcagggtcattgcagatgcttaggttatgtgcaataaagccgaaacacaaatccctccctgaataaagaaaccatgttggcactaagatcagtccttgaacataacagaaggttataacttgcaagcaaaaaataataaagttcttggccacatgtctccacccccaaaagaaacattttagccatggtgtcccttaaggtgtttttttttttaaaaaaacttatcgaaggtttcaatataatagactaattttccagttatgtggcaaagtttattggatttgtgtgtataattatggattggattagttgagtttggttcagtgcatctgattatcttctggcctttagggaaatgcgctaaaaccctaatatgtccactacccccaagcggtctctttttgaaggcgccgcacaaaatgtggtctctaccagcgcttggcctccaaggatcttcagtgagagacattattcttggaatatccaattaattccacgggcag

SEQ ID NO: 173922 - DNA, 601 bp, Human
tcatttgaaatgacaagggagccattgagtaggacattaggaggaggaaggactattctttggagtggttggtaatcagagtcttgggtactgagaaaatcataccttctagaggagtgttcagaggcagaatgtcttctgttttcaaggggacgtaggagggtgttatgaaatactgagttgcaccgagcacaagaaaatttacaacaaactaacagcaccagtgtcacaggaggataccgatagcggagtagattgtggtggattagattatggcctacaaaccctgagtttcagaacwgtttctcaaccagacaaagcctcaggaagtatgaggccaagagcagttacacatgcattaaattggctaaatgcttggctcagaaaaataatgtctgatggtgtcacctgcatctctttcatcttccagactcttccaaacttggattttattaaatcaggatgcttcttgttgatttaaaggcatgatagatgtcttctaatctaaggagtattgtagacaaaagcaaagagggagtatggtcaaatgaaggtacttctatcccttcgcaaaatggggggaaaagggattgaggcaaaa

SEQ ID NO: 173923 - DNA, 601 bp, Human
tctcaatatatatattgtggggggaaatgcacacgtacgcacttgcacacgcacacatacacacaacacacacacacgtgcacgcacacatacacacaacacacacacacacacacacaaatgaaggcaagtatttattaaaatcacagccctttaaaacttccattatgttttgtcatgggggtgctgaggcagccctgacatttgcaatggggaaaacacgttgccatattgattgaagaaaatacgtccattagtttcttcctgtaatacacggattcggaacaacagtaacacaatyattacataacacactgtaaatcaaaggaatatatgaagcttctattagtcgagcacattttactctgaacttagtgacattcttctgtccaaaatcagcatacaaagaatcaaacctcttggcaaaggatatgtccttagacattgattcttctcctgaagtatcaagatacacttctgcttaaattctgacattctagtttatacataagattattttttaacctagaacataacaacctttcttaaatgatttaaatccaaacttctctatgaaactgagagttaatagggtttatct

SEQ ID NO: 173924 - DNA, 601 bp, Human
tttttaggacctattccaaaaacttgttggatataaagagcactgaaagagagaagaagaaaagttggggcaagataggatgtttgtatgtatgtttgagatttttctttgttttcagcgattttactggggtccttctgacgggataggcataaacattatggggtgtgtggcagagatgacatcagtggctatggcaggaggggatttggaaaggctctttttttgggcaaaaggggagggtgtaaagatacagagttcaaagatgcaaatcacgagaaagtagaaaccttaaaaaaawtttttttatgagaactttgccatctgtatatacagcacaggcttcccagcatcgaaggtcagattcacacccttttcgaacaaaactctaatttagaatgttcatctaagggttgataatggtattagaaggccagtagggtggtcagtgggtgttgtagattagctcagtggccattacagctttacctagacccccacgattcattgggtagattaaccatcacatctgtcattttatcccttttaccacatttaaaatacgaaaaggggggtggaaatatcatctcgaagacaactt

SEQ ID NO: 173925 - DNA, 601 bp, Human
ttttaggacctattccaaaaacttgttggatataaagagcactgaaagagagaagaagaaaagttggggcaagataggatgtttgtatgtatgtttgagatttttctttgttttcagcgattttactggggtccttctgacgggataggcataaacattatggggtgtgtggcagagatgacatcagtggctatggcaggaggggatttggaaaggctctttttttgggcaaaaggggagggtgtaaagatacagagttcaaagatgcaaatcacgagaaagtagaaaccttaaaaaaaatttttttatgagaactttgccatctgtatatacagcacaggcttcccagcatcgaaggtcagattcacacccttttcgaacaaaactctaatttagaatgttcatctaagggttgataatggtattagaaggccagtagggtggtcagtgggtgttgtagattagctcagtggccattacagctttacctagacccccacgattcattgggtagattaaccatcacatctgtcattttatcccttttaccacatttaaaatacgaaaaggggggtggaaatatcatctcgaagacaactta

SEQ ID NO: 173926 - DNA, 601 bp, Human
atttgggatctgctgcatgtatcagaggctttcgttgagttgtgttgtttcctgtgtgtttatgacagaaagatgtcatcgttaaaggaaacttaagagtttctgtaaatgtaatggttcatcctgaataaagtgagagagacagtgcttggaatctggggaataagggtggaaagagctgagctgatgaaggtgtttcttgtcaaatttgtataggaattatttactgtgctgtctttcctgagccgctacagtaaaagtgaagacatggaaaattatcccagatgggacgaatcgctcrttctctgttctttttttaaaaagaaaagatttcagaaaaaaaaaaaagtcgtctttttctttagaacagtatgaataaaatctggacagctgtcgaaaaagatatgccgtctgcatttttttttaatttctagccaccaccataactaaatagcttgaatagtacctcttttcttttttttccccttcatacataatgatctctacttcattaaaagcgtattaatctggttcccagtctcttgggagacaccttaagatgatgatattgtgggttttttccccccgaattgtttaaaaa

SEQ ID NO: 173927 - DNA, 601 bp, Human
aaaagttctgaagcattggaaggcagggctgcggaaataatacgatcacagtccgctaaaaaatttgacacctctgatgcagtttctttgagtgaaatttctacaaagttgcaacaaaaaagcatagcatggtaagtcagcacattcttgattttgtttaatctttttgatcttttcaattatcgctatttgaagatcaatagtcattttttcctactatgcttagaagacgcgcagcggtggtttaatatgtgttaggaccatttgctttaaaggaacacatccacaagtttcggtaggtttttttttttttttaagttagtcatgaaaaatgttatacagtaaattgttctgaattcttttacatatgggtgtttttaatgatctatattggtttttgtatccccccacctccaaaaaaaagaattcagcaagataattaagctctggatgttgccaagaattttgagagtactttcagttggcagaaaactttggagtgaagtggtccctccaagtttatctaaattcagcgagtttcctcccctgccttctctgaatggcatcagatagctattaaagcgtaatttcactggagaac

SEQ ID NO: 173928 - DNA, 601 bp, Human
agttgcaacaaaaaagcatagcatggtaagtcagcacattcttgattttgtttaatctttttgatcttttcaattatcgctatttgaagatcaatagtcattttttcctactatgcttagaagacgcgcagcggtggtttaatatgtgttaggaccatttgctttaaaggaacacatccacaagtttcggtaggtttttttttttttttaagttagtcatgaaaaatgttatacagtaaattgttctgaattcttttacatatgggtgtttttaatgatctatattggtttttgtatcccyccacctccaaaaaaaagaattcagcaagataattaagctctggatgttgccaagaattttgagagtactttcagttggcagaaaactttggagtgaagtggtccctccaagtttatctaaattcagcgagtttcctcccctgccttctctgaatggcatcagatagctattaaagcgtaatttcactggagaactgcaaagcattactttcaccaacttaggtgaagttctttggactattgaaattgcctttatgtttgctaagtcggcaaacaaaatatcaggctttgttcttttgat

SEQ ID NO: 173929 - DNA, 601 bp, Human
aaacgaaaaagagaaattgactatacctccccccaccccgaatttcagcttgtgactataaaaacatgcttttttattattattaacttggacgtgaatacggaggggtttcgggttttttttttttttctgtccaccaagttaaagacaccaatgctccaccctcctcgctcccctcctccccatccccaaatattttcgtaaagaatcagcattttgctacttttcgtccatccattcctccaagacccatttccccttcctcccttcttgaacctctttatttaaaacaaaacaaaastttgctgatgctgcagatgcggaccgtggaatgtaaatgagcagttcctcccacctccttacttcattcctcctgcacatgattgtaatttcatgctgaaaggaaaggaagctttcgtttttgttttgttgttgttgttttgttttgttttggggaagtgtttttttgttgttgctgtctttttttttaaaccctacagaactttgcagcacttgatcaccttttgatttttttgtgggaatgttctaagcgtggtgtacttctgacaaactgggggcaccctggggatgaatttagagt

SEQ ID NO: 173930 - DNA, 601 bp, Human
ccccaccccgaatttcagcttgtgactataaaaacatgcttttttattattattaacttggacgtgaatacggaggggtttcgggttttttttttttttctgtccaccaagttaaagacaccaatgctccaccctcctcgctcccctcctccccatccccaaatattttcgtaaagaatcagcattttgctacttttcgtccatccattcctccaagacccatttccccttcctcccttcttgaacctctttatttaaaacaaaacaaaagtttgctgatgctgcagatgcggaccgtggratgtaaatgagcagttcctcccacctccttacttcattcctcctgcacatgattgtaatttcatgctgaaaggaaaggaagctttcgtttttgttttgttgttgttgttttgttttgttttggggaagtgtttttttgttgttgctgtctttttttttaaaccctacagaactttgcagcacttgatcaccttttgatttttttgtgggaatgttctaagcgtggtgtacttctgacaaactgggggcaccctggggatgaatttagagtagtgcgatgggatggcaaatatccggaaag

SEQ ID NO: 173931 - DNA, 601 bp, Human
cctacagaactttgcagcacttgatcaccttttgatttttttgtgggaatgttctaagcgtggtgtacttctgacaaactgggggcaccctggggatgaatttagagtagtgcgatgggatggcaaatatccggaaagagtttctgaggagcagtttttagtttgaagaaattcaagaaatttccctttactttttaaggaagagggggtctgtctagcatgagttagcttatgttgctgcgtcctttttttttttttttttttttccatttttcggtcttttgagaaagctagaaaatarattcttagtcaaagttgcccatcctgtttgccgcactttataagttattgttgctgaatgattgggagctgtccatcagcggcagagaacttgcagtttacttaagaaattgcgtgtgtgacaaaagcagctgccaggagtgtggtggtccgcgtgaatagagggagagaaggcaattagggggctgtgtggttggggctttttacttgtcaaagtggaggctcattgcttttgttaccaccatgtaaagggaatggcagggttttgttttggtattaagggccttaaagattgctgcct

SEQ ID NO: 173932 - DNA, 601 bp, Human
tgcttcaagccacacaagtccaggatcccatgtggcagcaggggtgttttcttacctgcatgcaaatcggagttgtgtgtttgcttttgaagagggtgaaatggcttaacacttggggtgggaaaagaccggaaaagcgttctggatgagttttgtcccctgcaactttttctgtctgtaatccctccatgagcagccaccctcccacactcccctccttcatgtaaaagaggacgatttctggcctgtgatgtctgagtgtctcaactcaagttaagttaaaaccacacaaatgtacccrgccctggatcccataagagccccaggaaaagtaagtcgggtttgtggaattcagctctagcctttgcatccctctgccgtttcccttccttctctctctctctctttctttctctctctgtgttcctggggaaagctcacaaaactcaacagtcaaaaaagcgagttagcattctgactattggaatactagcgagcccaggaagcttcgtttcttctgcttccagggaggtcagttgaaaatctttcaggcacattctgttactctggaaggaagagagggtgtatacagggcaggcaa

SEQ ID NO: 173933 - DNA, 601 bp, Human
ggaaaagaccggaaaagcgttctggatgagttttgtcccctgcaactttttctgtctgtaatccctccatgagcagccaccctcccacactcccctccttcatgtaaaagaggacgatttctggcctgtgatgtctgagtgtctcaactcaagttaagttaaaaccacacaaatgtacccggccctggatcccataagagccccaggaaaagtaagtcgggtttgtggaattcagctctagcctttgcatccctctgccgtttcccttccttctctctctctctctttctttctctctctstgttcctggggaaagctcacaaaactcaacagtcaaaaaagcgagttagcattctgactattggaatactagcgagcccaggaagcttcgtttcttctgcttccagggaggtcagttgaaaatctttcaggcacattctgttactctggaaggaagagagggtgtatacagggcaggcaaggccctgcaaagtgtcacttccgtgtcactgtgacaagaaaatatcctttcctcctccctcccctctcccatcgcagccctctccctaagaaatttgttttgagggatttgacaatcttg

SEQ ID NO: 173934 - DNA, 601 bp, Human
ggagagagggaaaaccaaggctgttatgtaccctagggacacaattttagtgggaatggaagatttgagtggtaagggaggcgcagtggcctccggggtctctctgttccagcagttgggcggttggcacctcaatttgaattgctgggtgagtagtggggtgtgtggtgtgtgtatggggggatgtgtgtatgttcgtgtccatgcttatggtattgaccattaaacctatgctttttcccccccttaatttagatcatgggaaggaaaaaacaaaacaagaataaatggtcaactcaakctatgccctttctttgagtccttttcacagcagttttttggggagggggagaaagggttaaaaaaagatggggaggagagaagtctcactttcatcacagtccttacacttctatggtaaggcagaccctgttcccaaagtacgggtgagctggaatctgggaaggggtggtacggtttggaatttcttctaacaaataattgttttcttcacccaccagggtgggctccatcagaaaagagagaaggaaaaatgacattgcctcatagaggagcatactttaaaagcttgaaagttttg

SEQ ID NO: 173935 - DNA, 601 bp, Human
gagagagggaaaaccaaggctgttatgtaccctagggacacaattttagtgggaatggaagatttgagtggtaagggaggcgcagtggcctccggggtctctctgttccagcagttgggcggttggcacctcaatttgaattgctgggtgagtagtggggtgtgtggtgtgtgtatggggggatgtgtgtatgttcgtgtccatgcttatggtattgaccattaaacctatgctttttcccccccttaatttagatcatgggaaggaaaaaacaaaacaagaataaatggtcaactcaagmtatgccctttctttgagtccttttcacagcagttttttggggagggggagaaagggttaaaaaaagatggggaggagagaagtctcactttcatcacagtccttacacttctatggtaaggcagaccctgttcccaaagtacgggtgagctggaatctgggaaggggtggtacggtttggaatttcttctaacaaataattgttttcttcacccaccagggtgggctccatcagaaaagagagaaggaaaaatgacattgcctcatagaggagcatactttaaaagcttgaaagttttga

SEQ ID NO: 173936 - DNA, 601 bp, Human
caactctttggttcaatctaggattgtgtaaactgtcaggaatggtggtgaagagagtggaggctgtgttgcaaatgtgtatgttgtgttactgcaaatatcacacccagtacagtctcccatgttgaggttctagaccctagtttactcaaattacctgcgttacttaatagtggtcctgttggctttgatgagagtaaaccactattcttgatgtcttaggagaagggagttcctttgaaaacgtaaattcccgactccagtgatacaggtattatgatctctgtattgtcacaacagsctgctgcatcggcattttctggaagcagcagagcctgaaaccttgtattcttagggaaacctcccctttgtggtttggggttgttggggacctggctgagctgtgtaatagaattctttccttctgcaatattttggaatgtgatgaaatcctgacatgccctccagattacgtagttctgcacacatttgaggatttttgaaaaaattcaactttgcctgggtcactccctcgttaccttaaacttgcaacacatcagctggagatcagagggagcagcaattgtgtttgccctccttg

SEQ ID NO: 173937 - DNA, 601 bp, Human
ttcactacttctttctttaattccccaggatgtaataaccattatgctcttaaaatttactctaaatcaaaattggtgatttcctttccattatatttaggaatccctagatttggggttgttgtatttggtggcgagggggtggtctggaaatcattattatttgttaaaagttgttttgaatttgagcttttggatttcttcatttgggataggttcgatttatttctggctcgattttgaagatctgctctcctagaaacagctgtactctcttacccaattcccaaacattctctgygaactcgggcacttaacaagattgattatgttaacgctaatcatttaatacccaagtagtagagaaatatttggcaggagggtggaggttgcaaattcctgggaaattacttaggggtgaagtggctggttcttcatccctgagacctggcagaggattaggacagagggccccgttgtgcctgtcgcactccctcactgacctccaggttgagaattttgtgacgctgccggagggaggcagaggcaggcaggaagaaaaccctggaaactcgctgatcaggggcgagcctggaccggg

SEQ ID NO: 173938 - DNA, 601 bp, Human
cgctatgcttaagggttcttgaaaggtcaaaggtcagccacaggggcgcctccccctccccattcccccccactgtagtcgatgaatacgatgaatactttgggtggaagggctttgtgtgccttgagggctgttaaaggaccttttctttatgatttaactattcaatgctcaaaacccatggagcctaaggaaccagacagaggaaagcttggctttgccaaagagcgttttctccaggtagaaagcataaagccctgaatgatttaaagtcagatgaggattttggttccttttaaayagatattgtttacttcatttaatggttcggctttttagtagactttttctttagtttcttgtcagcccagaactgacgacataaagtgtttttatcatctgaatcctgctgggccgagatactgcatgtttgtatttgagaagcagaaacatcctattaaatgtctttaccccttccatccccagtcttcccataatcagccaaatgtgtaaaaatccctgctaaaaatattcaatgccctgtggcattgtggctaaggcagggaacactgagctccacctaatttggggtttaggggca

SEQ ID NO: 173939 - DNA, 601 bp, Human
gaagaatgaaaactcgggtcttccttgaattcagttcttgaatcactgtgtgcaatgccagttgcccctaaaacccttttaaaggcacagttgtaattgagatagtgtctgcaagggtattgaactggatggtccagaaggaccactaagctctgttctgtgattctaaggagactacatttaaagagcgccaacatttacttgaagttaatctgtgattggctttgtctttccctttgaatgcttgcagttgcaatttggtggttcttctgcagtttaggagaatgtgctctccattccrcagactgggcacttgggaggacataaagttctagaagacatagtccttgtccctaagggacttaggtatagtgggaccaagaagggtgcacacacacccccagcaatgggcatcgtgtgatgtaggaagaaagggttctggggtctgaggccggagagacataggcatttgtaagaagaaaatccctccatcatagaggattccaggtagaggcaggttggctggagtggcaattagtccctggttttggcaggtatgaccacagagttctcctctcttgcaagggaacccatgagcttg

SEQ ID NO: 173940 - DNA, 601 bp, Human
acagttgtaattgagatagtgtctgcaagggtattgaactggatggtccagaaggaccactaagctctgttctgtgattctaaggagactacatttaaagagcgccaacatttacttgaagttaatctgtgattggctttgtctttccctttgaatgcttgcagttgcaatttggtggttcttctgcagtttaggagaatgtgctctccattccgcagactgggcacttgggaggacataaagttctagaagacatagtccttgtccctaagggacttaggtatagtgggaccaagaaggrtgcacacacacccccagcaatgggcatcgtgtgatgtaggaagaaagggttctggggtctgaggccggagagacataggcatttgtaagaagaaaatccctccatcatagaggattccaggtagaggcaggttggctggagtggcaattagtccctggttttggcaggtatgaccacagagttctcctctcttgcaagggaacccatgagcttggacagagaggaagttctgttctttcacagggacctgcctggcatgcagttgaggtcagagggagtaaggctagtcctagtacaggt

SEQ ID NO: 173941 - DNA, 601 bp, Human
gctatcttcctcttttgttgtaaagtagagaaagagggttttccccacatctccccttagtcctgcttagaagatggctgtgggatttgtgcttctttactgtagacagatcatgtcatctggacagcttcttcctaacaataaaaataatattaataataaaccactgtaatagataataaataacaaacttatcatgtgctaggttctgtgctaagccttttcctgggttccttaagaactaggatttgattcatgatcagaacccatggctctttgcctctgtgcttgcctgtgtgcrtgtggtcctcatggcggaacacaagaaccacccacaacacccagcaagcaggcccaggatgcttgggtcctgagcccagacccactgtgaatgaattagggcctactgagagatttcctaggattggggaatctgaatgagtgaaaagcatcccgggagatgcttgactaggggctgactgctgctggttctgatgcccaccactagccctttctcttcccatgtgatccttctcctggctgatggtggtcctgctcccgtggcacttgatcagtccttccaccccttagtaatcatctt

SEQ ID NO: 173942 - DNA, 601 bp, Human
gccttttcctgggttccttaagaactaggatttgattcatgatcagaacccatggctctttgcctctgtgcttgcctgtgtgcgtgtggtcctcatggcggaacacaagaaccacccacaacacccagcaagcaggcccaggatgcttgggtcctgagcccagacccactgtgaatgaattagggcctactgagagatttcctaggattggggaatctgaatgagtgaaaagcatcccgggagatgcttgactaggggctgactgctgctggttctgatgcccaccactagccctttctcytcccatgtgatccttctcctggctgatggtggtcctgctcccgtggcacttgatcagtccttccaccccttagtaatcatcttcccttctctgggctatgggtggttctccccactggccctggtgtttttccacactcactttaaactgtctggagctggtctgctttctttcatgtcagcgggtatgtatctttccaaccaaagagaaaacttctggaaggcagcaacagtcatttgccctgcctcctaacagtctccactttgtccgtgtctgtctctttccctcccttcctctcct

SEQ ID NO: 173943 - DNA, 601 bp, Human
tgaattagggcctactgagagatttcctaggattggggaatctgaatgagtgaaaagcatcccgggagatgcttgactaggggctgactgctgctggttctgatgcccaccactagccctttctcttcccatgtgatccttctcctggctgatggtggtcctgctcccgtggcacttgatcagtccttccaccccttagtaatcatcttcccttctctgggctatgggtggttctccccactggccctggtgtttttccacactcactttaaactgtctggagctggtctgctttctttcmtgtcagcgggtatgtatctttccaaccaaagagaaaacttctggaaggcagcaacagtcatttgccctgcctcctaacagtctccactttgtccgtgtctgtctctttccctcccttcctctccttttcccttttccttctccacctcagcacacagtgggagcttccttgttccttatttctcaagttgtcctgagcaaatcttcctcttaaggaatccttagtgcctgtccttgaggtgcccagcactggctgtgggcagcagcccttcaccctggccatggcctgccccgcccttca

SEQ ID NO: 173944 - DNA, 601 bp, Human
atcatcttcccttctctgggctatgggtggttctccccactggccctggtgtttttccacactcactttaaactgtctggagctggtctgctttctttcatgtcagcgggtatgtatctttccaaccaaagagaaaacttctggaaggcagcaacagtcatttgccctgcctcctaacagtctccactttgtccgtgtctgtctctttccctcccttcctctccttttcccttttccttctccacctcagcacacagtgggagcttccttgttccttatttctcaagttgtcctgagcaawtcttcctcttaaggaatccttagtgcctgtccttgaggtgcccagcactggctgtgggcagcagcccttcaccctggccatggcctgccccgcccttcatggctgccccttttatggaagtgttgctggtttccaaagctccatctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttct

SEQ ID NO: 173945 - DNA, 601 bp, Human
ccttagtgcctgtccttgaggtgcccagcactggctgtgggcagcagcccttcaccctggccatggcctgccccgcccttcatggctgccccttttatggaagtgttgctggtttccaaagctccatctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttctgtagtttttttctggggyatctagagagaatgccttatttttctttccacacataaccacaaaaaagttaaaagcactttttaaaagacactttcccctcaattacctgtggtaagaaatgctgttcttatattacattccttcctcacccatttaaaaaaaaaaaaaaaaaaaggacaagaagagaaatagtaaagagaactaactgcttagtgatccctcagctcaacaggcactagtgggcagcactaggaccttccttcttttcttttaatgcaattccttttccttgatgttaatgcaagttgtgccttccta

SEQ ID NO: 173946 - DNA, 601 bp, Human
ccttgaggtgcccagcactggctgtgggcagcagcccttcaccctggccatggcctgccccgcccttcatggctgccccttttatggaagtgttgctggtttccaaagctccatctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttctgtagtttttttctggggcatctagagagaakgccttatttttctttccacacataaccacaaaaaagttaaaagcactttttaaaagacactttcccctcaattacctgtggtaagaaatgctgttcttatattacattccttcctcacccatttaaaaaaaaaaaaaaaaaaaggacaagaagagaaatagtaaagagaactaactgcttagtgatccctcagctcaacaggcactagtgggcagcactaggaccttccttcttttcttttaatgcaattccttttccttgatgttaatgcaagttgtgccttcctaaaagtaataaaag

SEQ ID NO: 173947 - DNA, 601 bp, Human
gtttagagctttctggtaaagttcacactcccacccaaaccgtgagtggggttttgcatccatgctgtctgtgaaggattgtagcatgcccgctgtttctaagggcagggaggggataggagctgtcggggggtggctaaggaggctggctgggtgggatttgggccctgccagtttcttgtaagtggtggttttcctagatggtcccctgtgcagcctgcgtgcctcctggaggtggggccttggggtaggaggtccccacaacatgtggaaacgcagtaggcatgggagattgaagtcyccacttctgactcacctgctaatgggaaaagtgcagactcttgggctccataatggggtaggggttgagaaggtattttaaaagccaggcttagtggggaaataaaaactaaagcagacccacccagagagctgtcttacaactatctattattttcacatggactggggggagtatgggatgggcagagttgagtgcatcttagaaaatccaggtgagaggctgtggccaagggaacccacgggcccggtgctctgaagccctgggctgctggaaccggcttgacggtgtctttctctg

SEQ ID NO: 173948 - DNA, 601 bp, Human
cattactctgttttaattctgtggtattgtgccttttgcctcccacttcaatggcatacatcaattcctctctgtcagagtggactacaggatgtgctcctgtggaactggcagatgtgcggtggcacgtacttgcagaatccgctcatgtgtgccttgtgaagctcttagcccctgcgacgcacgcggtgcccattcagcaggtgggcttaatccccacagacgactctgtcctctagcggatgaagttccagaatggagtacacaagcctccaacacctccttgtctgttcagctctgwctctgccttagataagatgccagatggcatttgatcagtttctccagctcatccaaatagaggcagagacattttagaggagtcaccatttttgaaaaaaggcaagggtagtaacttttcaaatgccacagctcaaaaagtgtgttagaaatcagaggagtagctcttgtgcaggtaaggcatgaaactccgcagggtgaagggccagagttgtaagagcaacagggattaccattgcttcattctccaccaggtgctgagcctttttgatgttgtttcttttaaacttgaaacaatcac

SEQ ID NO: 173949 - DNA, 601 bp, Human
gtgtgtgttagaagccagggttggggagggggctgcgggagggcacagaaaaggtgttgctgaggtgtcctgtgggaatacaggcaaatccacagccattcaggtggcttatgttactggcacttagcattccgcgaccatggtccccagaggctctgtggacagaggtgccctgcagttcctttgggaattgcagaagactactggaacttccacccaatgaagctggtcatgacccttctgctgttggctgcccaaactgcagtcatgtcattgggttgaggctgtcgagtcctccatkttaggtgttacatattttggggcacagaagcaggaacaagaacggccttgttttgaaatccagggttgggattagggcatgttcttgtatgattccaggaccccccacctcatcctgaacattactcccaaggttgacaacaacagtggaaagttttgtctgttgagaagctccatgggactgaatcagcatctctctgagagtctttgcacgttgaatgttttacctaactgtgaacggtgggaatggggcatttggaaccgtcactgcagcatgtggggccttcgtaagcatcaatcc

SEQ ID NO: 173950 - DNA, 601 bp, Human
agaaaggcctttgatgcattagcatactgtggcaggttgtgtgtatgtatatttttgcatgagcatgtgtgtaatatgtgtttcgtgattgtttctgtggatgtatttctccttaccagtgatctgtactctgaacaacacaggacaatacattgaatgctaaaaggaataaatcctggtaaaactcaggtttgagtcttagggaagatggcctttcaaagccttaaggaagataaaattttggagtggcttaccccacaattctacccgtatttctctagttagatagattctatgctgtttttttttttttaataaaaaacagattgcattatgtagtagctgtaccaaataccaaccctgggtatagtttctgtttctctgtctcttcttatttttattgggacggtagacatgaacatgagcttgtgacccatttcttctaaatagatggggccaaccctcgaatagttctcagtgatcatttgccccattcggctgatggggagatatttgaaggctagataaaaaggaatagccaactcagacaaccctctgtcagaaaaagttgtgtgtctttcatgaggatgctattttgcat

SEQ ID NO: 173951 - DNA, 601 bp, Human
tttaatgacatgtttttattcaatgcaatatagccaaaatattatcattttaacatgctattcctggacaacaactattaataagatgttatgttcttttttgtgctgagctttggtacaaaatctgatgtgtatcttatacgcacagcacttctcagtttagactggccacatttcaaatattcaatagccacacgtggctggtgcatatcatagtggtctgtgcagctctaagtctttgaaagttaaaaaaaaacatgtgtgtgtgtgctgtacattcatatatatttatatttcagcrtagaaacatatttacaagatacattcctatccccatgttcttcttttcctccctctgattaattctggctaatttttcagtgactgctagtttatttacaaactggttggcagcagtatgttttagtcgctaattgtttctaatgatagttttattttctgttcatctgattttcagtcaagttaattaaatcggtggaggtttagactttgctgatggtctgaaatcaccaacccattctgatgatggcacataatgaaattagcatgcgttacatggcaggggtgctgtccccagctt

SEQ ID NO: 173952 - DNA, 601 bp, Human
ttcttttcctccctctgattaattctggctaatttttcagtgactgctagtttatttacaaactggttggcagcagtatgttttagtcgctaattgtttctaatgatagttttattttctgttcatctgattttcagtcaagttaattaaatcggtggaggtttagactttgctgatggtctgaaatcaccaacccattctgatgatggcacataatgaaattagcatgcgttacatggcaggggtgctgtccccagcttctttccccagtccctgtggccaacatgggaagccaagaccrgagaagggcctggaaagacaggtcaagatgctgcttttcctacttacaaaacagtaactttagcagtgatagagagttacattcattaagaaaaacaaaccgtggcatatctagcatcggtaactatgccgtggatatcatagttgaagagatccattttctacctgcgatatatcatcaaaatttcaaaatccatgccagtattagttaggtaggaaaacgctcgtgtgttctctggcctagagagaagaggaggcgtaacacttattaaatagtgtcatcacagcctcgcaaagcatg

SEQ ID NO: 173953 - DNA, 601 bp, Human
ttgtgataatggggcgacagaagtataggtctattatacttatggcagttatagcaaatgtaggcagcttgccctgttccagaacaccctttgatattcattctattcagcagtggggccaggacttctcagaattaagtgatgggtcattatactttaaacaccatggagaagcctagattggcaattaaacagctcttgctgacactcacttgtgccaccctgtgaccccctttagattgagatgttggagctccgggccctcagcctgctaaattggtgcaaggctcttctcctgacragagccggctctgaaatctgccggcttcaaagggagcgagatcatgtataaaccataatgtgggtgcaccgtggctcacaaaaaataaggcaggaagagatgaaatgttacaagtgcaagggggaaaatgagagaataatgacaaacctaatgcaactcaaagcaggattgttgcacaggaaaatgcatcctactgcttgtgcataaaatcaaggccggcagatgacatccggttaacagaaacgtgtcaacagtgaagtaaagtgagagtgagtaagagagaagcccctgagacagcca

SEQ ID NO: 173954 - DNA, 601 bp, Human
cattaggccctctagttcccaccagaattggctttgtaaagagcagattgttattccttggatggtacattggactgctttggtttggacttattaagaaagcaacagttgccatgatcttcatctgaacagcttcccatctgctcacttgaatcaccttgccaggttggagcaggaggctgccatattgtttacttttgggattctgccctttctgtccctcactattttttctatagtaggatatgttgcttgaagaggggtgagtcttccaacccagtacaaatcatggtgacaccaygcaaaatagaaaatgagaaaggtgtttgatccagttgtcagtctgcagatgggccaagagtaggttgagattagctctttctgtcctggctaatgtacttggttgggaaatgccaattcaggtcctaaaatgtgccttagagaactgtccaaaaaatgagcagcatgagaggagaaaacacaaactgtttctttcatttataattttgataatcatttagaagacttcttaatgatgcctagacaacatatgaagtaaaagtgatataggaatcctaaattttagaggagaaagggcata

SEQ ID NO: 173955 - DNA, 601 bp, Human
gtttacttttgggattctgccctttctgtccctcactattttttctatagtaggatatgttgcttgaagaggggtgagtcttccaacccagtacaaatcatggtgacaccacgcaaaatagaaaatgagaaaggtgtttgatccagttgtcagtctgcagatgggccaagagtaggttgagattagctctttctgtcctggctaatgtacttggttgggaaatgccaattcaggtcctaaaatgtgccttagagaactgtccaaaaaatgagcagcatgagaggagaaaacacaaactgtwtctttcatttataattttgataatcatttagaagacttcttaatgatgcctagacaacatatgaagtaaaagtgatataggaatcctaaattttagaggagaaagggcatacaaatcagaatcaaaggtttattgtgtgtgtgtgcacctttcctttcctttttttttttgcatctttccataaagggatagaaacttatttaaaatgtccatgacttatgatatgaaccaaataggaactatttgaattttccctgtcttcctgcctcactctctcccattcctgtcaaatgatgggac

SEQ ID NO: 173956 - DNA, 601 bp, Human
acaaaactattcctttgtgccatggtgcagtagaagttagaagcctatttcatcctgagaggagcatgatgggaatatccctgaaagcagccagaggaagtcagcctttggcaggatgcatgaaccgactctggccccagcaagggcagggaaagtgtgctatgcggtgtgtgtgttcctgggctctgtgttggctacaggatctgcctagtcctctcttgggttgtaggaaacaccatgggatgattgtttttactaattgcagtggttgtgaccccacgattcctctcctcccatgagyacgctgtcttccggagacttctgtcacttctcaccattgctggttatcctccattttgcccagtaactccgctttcctctctcgagggatgaaatgcctcttgttttgcctgatactttatttcatgacatttggttccgtgaagggatttcaccatccactcttaggggaacaccaaaacttgtcttaaggccggcacaggcctctcatccccttcctgtcgatgtcttggagccatggatggttacttttccagttacttttgactctcccactggcatcatccgcggtgaagcagct

SEQ ID NO: 173957 - DNA, 601 bp, Human
tttgtgccatggtgcagtagaagttagaagcctatttcatcctgagaggagcatgatgggaatatccctgaaagcagccagaggaagtcagcctttggcaggatgcatgaaccgactctggccccagcaagggcagggaaagtgtgctatgcggtgtgtgtgttcctgggctctgtgttggctacaggatctgcctagtcctctcttgggttgtaggaaacaccatgggatgattgtttttactaattgcagtggttgtgaccccacgattcctctcctcccatgagcacgctgtcttccrgagacttctgtcacttctcaccattgctggttatcctccattttgcccagtaactccgctttcctctctcgagggatgaaatgcctcttgttttgcctgatactttatttcatgacatttggttccgtgaagggatttcaccatccactcttaggggaacaccaaaacttgtcttaaggccggcacaggcctctcatccccttcctgtcgatgtcttggagccatggatggttacttttccagttacttttgactctcccactggcatcatccgcggtgaagcagcttgacgtatagggg

SEQ ID NO: 173958 - DNA, 601 bp, Human
catccccttcctgtcgatgtcttggagccatggatggttacttttccagttacttttgactctcccactggcatcatccgcggtgaagcagcttgacgtataggggtcgaggtcgttaaattattactgaattgagtgaaacatatcatggcctttgaggcttctgtggcaggggctggggacacacagctcttaactgccttggcctggaagtgtcatgggtcacttactcccatcacccattggccagagctagtcatgtgacccaacctaactgcaggagatgctgggaaatgtgcakttactgtgcacaagttattacagggattcagagttaagtcggatatctttactccctcagaacttagcatccgccaggaaatcgcaaacatctgccggcctatgtgatcctgaggaagagctgcttctgcctgctctgatgagtaatttcaggcctccttcctctttcttctcatacttttaaacccgtgcttgccatgtagatgagggaacagggaggtgcccctggccatctttctcgaggccctgcccccttagctggcagcgctagactgtgctcctcctgggagttgaatcagga

SEQ ID NO: 173959 - DNA, 601 bp, Human
ggtgaagcagcttgacgtataggggtcgaggtcgttaaattattactgaattgagtgaaacatatcatggcctttgaggcttctgtggcaggggctggggacacacagctcttaactgccttggcctggaagtgtcatgggtcacttactcccatcacccattggccagagctagtcatgtgacccaacctaactgcaggagatgctgggaaatgtgcagttactgtgcacaagttattacagggattcagagttaagtcggatatctttactccctcagaacttagcatccgccaggaawtcgcaaacatctgccggcctatgtgatcctgaggaagagctgcttctgcctgctctgatgagtaatttcaggcctccttcctctttcttctcatacttttaaacccgtgcttgccatgtagatgagggaacagggaggtgcccctggccatctttctcgaggccctgcccccttagctggcagcgctagactgtgctcctcctgggagttgaatcaggaaggagtgctggcacctctgggatggcgcgtgtgctctgctgagagcccttgtcgccgacagatgggcttgcacggggtctc

SEQ ID NO: 173960 - DNA, 601 bp, Human
agaggcgcgggcatggagatggtccattgcaggcccatgagatgccagcttcatgataaagcacatgaggtccttttaaaagaaattgtacatgaaggaacatagcgcgtttcaacaagatccccgaacagaaggccaaaacaaagctcccaagttgcacaggccccttcccctcacagaaaagataggccatttctacaacagatggccctcagccctgggtggagcctaagcttggtggcatcaccaccttgaggttttcctgacagaacctaacgtgttctcgagtttctttctttctttttttttttttttttgagactgagtcttgttctgtcaccagggtggagtgcagtagcacgatctcagctcactgcaacctctgcctcccaggttcaagtgatcctcctgtctcagcctcccgagtagctgggactacagatatgtgccaccacgcccagctaattttttgtatttttagtagagatggggtttcaccatgttggccaggatggtctcgatctcttgaccttgtgatctgcccgccttggcctcccaaagtgctgggattacaggcgtgagccaccgcacctggacctca

SEQ ID NO: 173961 - DNA, 601 bp, Human
tagcccccatgaatctcagcctctgggaggcagggaggactgagcatgctcccttacacccctcccctccttccctgccttcctgccatcttgctgagtccaaaccccaagcacagaggggcatgatcagacagctctggggcacagactgagaggaggaactcagcacacccttcctttccaaggccagtgacattgtctgacagtggttgccttcaagcaggcagcatcttggttgcttccagcggcagaaagctggccagtgcttacacacgtgtttccagttggagtgttatcagcyatggttctgacaatattctagggtccttagatgagcacacttcctgtatctgcattatttttatagcattagtggggttgatccccaggctcacctttccttaccaaataccatcccatcagactgggattaatgggaggagaagctttgaagtcacatgctcaatttcttgagttgattttccccgacctcatcctttgatgctaagcaagaagggctctgaaattctcattcctatttcttacatgaatgagtagtgaagaggggagatgctggttttggtgcagggcaaaattagtc

SEQ ID NO: 173962 - DNA, 601 bp, Human
attcctatttcttacatgaatgagtagtgaagaggggagatgctggttttggtgcagggcaaaattagtctttctggtttaaacacgaatcacgataacccaaacccaggaaggtccatgctgcgattccctggcacttcttctttgtagtcacttcggtgaccggcttgtgctgcaccctccattgactagccttggcatattgacaagagcaggatgcccctccatccatcccatcctcaccatctctccttccaaccttctcactacggggtgggggaggggaaagccccaaatcttaaaaaaaaaaaaaaaatcaagtttgaatcttaatttaatccacaacctgcaggccatacaaccagttattcttgttcctttgaatcattttctgtttttcttattcttccccctcccccacctttgtttatcctcttctacctgtttttggtggtttcttttttttgtttcgttttttgttttttgtttttgttttaagtttattttgttttatttttgtttcccttcctcccttctcacctgattctgacctctcttgatttggtgtggttcttaacagacaagcccgaaagctctctgg

SEQ ID NO: 173963 - DNA, 601 bp, Human
agtggagccgacagcgacgggcagcccgggcccggcgaggcagaccactgccgccgcatactggtgcgaggtaaggggacagcccgcggccctgctccactggaccctcaccctacccatactggggcccccgacctagctgcagctgacacctctcaattcatatattcattcattcgtcatccagtcattcattcagcaaatattattttgagcgtctattgtgtgctggacattaagctgagtgcaagggacaaagcagcgaatgggaccgaagcggtccccgtttctccgcctctcrggccagtcccctagttctaggcccattcggaacggctactgtggcgggggcagaaatggagtgcgggatgctgagagcctggactccgtcccgtgaccctcaaggcaagtgcggagaaaagcgtcttgcgcgctccgcggggacaggacgtggagggagcagcgtcggcaaccgcgggaggaaaaggccccggctctgcagggcggccggggtgcttcctcgcctcctgcctagccgcgtttcccgtccccggcaatcgggacccgcacggattgcccaggggagacggcgcgggacgcg

SEQ ID NO: 173964 - DNA, 601 bp, Human
gcgaggtaaggggacagcccgcggccctgctccactggaccctcaccctacccatactggggcccccgacctagctgcagctgacacctctcaattcatatattcattcattcgtcatccagtcattcattcagcaaatattattttgagcgtctattgtgtgctggacattaagctgagtgcaagggacaaagcagcgaatgggaccgaagcggtccccgtttctccgcctctcgggccagtcccctagttctaggcccattcggaacggctactgtggcgggggcagaaatggagtgctggatgctgagagcctggactccgtcccgtgaccctcaaggcaagtgcggagaaaagcgtcttgcgcgctccgcggggacaggacgtggagggagcagcgtcggcaaccgcgggaggaaaaggccccggctctgcagggcggccggggtgcttcctcgcctcctgcctagccgcgtttcccgtccccggcaatcgggacccgcacggattgcccaggggagacggcgcgggacgcggagggtggcgtgcgcggcgctagcccgctgtgcttcactctctcggttcccacttcctcgcggcg

SEQ ID NO: 173965 - DNA, 601 bp, Human
gaccgaagcggtccccgtttctccgcctctcgggccagtcccctagttctaggcccattcggaacggctactgtggcgggggcagaaatggagtgcgggatgctgagagcctggactccgtcccgtgaccctcaaggcaagtgcggagaaaagcgtcttgcgcgctccgcggggacaggacgtggagggagcagcgtcggcaaccgcgggaggaaaaggccccggctctgcagggcggccggggtgcttcctcgcctcctgcctagccgcgtttcccgtccccggcaatcgggacccgcayggattgcccaggggagacggcgcgggacgcggagggtggcgtgcgcggcgctagcccgctgtgcttcactctctcggttcccacttcctcgcggcgcctgggcccagccggctctcggcgccgccttcccgcggcctggcctttcacgtccttctctttctccctcggccctcgtcctcctctcgtctttcccggccattcctctcagccgaacgcgccttcccagcaccttcttcctgcaagctcctccatctggactgcgaccgattacccagctcttcccggcctcctctccgcgag

SEQ ID NO: 173966 - DNA, 601 bp, Human
ggaccgggagacccagcgccagaagaggccactggcggtaatggctcccccaggctccttcctgggctccctcctcccggcttcctcctgctgcctctttccagcctcttcacacgcgccgctcgggagagccactgggcctctggaggctaccggcccgagcggatttctttggcctccgcctggggaaggcgaacaggctggaagctggccctgggtcgttccagcgaggggattatgtttgatctgagctcggctaccctcaagctgactgggacaccctgggccagttgggcactayctctctgcggctgctgggtgtgggtggcactggggactggagggtagagcatgcatgcagcccagtgtgagggtgactgatgactgccttgaatacagagacaggggccttagctctgggaaacattcctggtgccagatgtcactgggacagtaggtgctcactgctactcatagttgactgcttgagtcaaggcagttataccatcaggaattccagcaggtgtgtggacctgttgggcaccagggattaaatccgattttattctttagactgtgggatgtcttgagtgaaggcata

SEQ ID NO: 173967 - DNA, 601 bp, Human
gactgccttgaatacagagacaggggccttagctctgggaaacattcctggtgccagatgtcactgggacagtaggtgctcactgctactcatagttgactgcttgagtcaaggcagttataccatcaggaattccagcaggtgtgtggacctgttgggcaccagggattaaatccgattttattctttagactgtgggatgtcttgagtgaaggcataagcagaccttttggttccattaaaaatatctgtaggactgccagagaaatcagtcctccaatcccacacattcccaggggargatctaaagtcactgcctgtgacactcatcaccttgaaccccacctatgggtggacattttcttccccccaggacaattgtgagttctgtgcccacctaacatcctctccactctactaaccctgtatgtagagcaaataagttttgtgtacagatgtcaattaaatagccttcaggggtaaactcataggaagtggaattcaaaagtgaccctccaccctgtgaggtggggccacccaagctgggagcaatccacagccaggcagagatgggcttgcactggatgtgagacagcctgtg

SEQ ID NO: 173968 - DNA, 601 bp, Human
aatacagggtggagagccaaagaggccaaacgtggtgcgtctcctgcctcaaaatgaagactcctacacgtcacacatgggcacggaccagagctgctgagatgataggccgggcgcataacaggcaccccgcacatcgcaccgcggacgcagcgatcctcccatttgtaccctaaggcctgagaaggccgctccacacctccgcgtgcacagtccctagaccagtgagggcggggacggggaaatccttttgttttatattggaaaccttacgccaaaggcaggcaggaagcaaccaaakgaacaacaggccgcctgagccgtggctcaaacagcacagggcagtggccgagcaccaggcttttcggtggagctgggatcccagcaggcagaagaggtggacaactctgaccgcagactccctacaaccccgcgatcgatgctccacctgcacgctcaaacgcacctgtttcccaaattaatccagacgcgaatttaacgaccgattttgatagatccgggaaattctgtccaccagcgtcacccaacacagcaacttttacagacaatgcgtggcgtccgttcctgctcacccaaagcg

SEQ ID NO: 173969 - DNA, 601 bp, Human
tgatagatccgggaaattctgtccaccagcgtcacccaacacagcaacttttacagacaatgcgtggcgtccgttcctgctcacccaaagcggcctctctgggctgacagccacccctgcgggtcctcaaaccccactcgaaaccctccgaacccctgtgtctgggagcagtagggtgggatgactgcaggatcccttgaagaagtgactcgctgcaaccccaccaccagcagcaaaaacgctttcacccgggagctgcatggatgcgcggatggctgggggctgaggggacgcgtgaagyccaggcctcttgcttgggctgggcgattcccgccgtgggacgggtgggattgaccttagtggagtccagtccttcggagaatccgcgggcagtcgggacccacgctccggaaacacccaagtccgaactcgtacacacagcacaatggcgtgcagccgccggggccctaactcccagagacgcgtctgaagaagccatacaagggggcgcagcttcggggctctggctgggaggttactgcagggacagacgcctcgcctccagcagccgggtccaggctcagggccggccggcctctgc

SEQ ID NO: 173970 - DNA, 601 bp, Human
ttagtaaggaccacaggactttagtctcaatatctgagtctgttaatagacctgacaaccgaggaccagcccccaaggcagacgtggaaaggtgtaaatggttcatgcaaggaattgcactttgagatttttgtatttgttttattttttggttttagcatttgtagagggtttcttttttgtttgtttgttttcttggagttgctttacgttattttttccttttacttgttttcggcaggaggcccacattcccatagcgtgcctattcctatgccgggccctctcatttgggtcttcytttgtttcccccccttccataacccttacccccacaaacacacactgaagcagaccagcaacccgaaaaatcatcttgtaggtgtgtcttgtgtgcccagttttcattttcagggaacggttcaggaagattagacagctccttccctcctcaggcgatttctgttccccgcctggtctggtagacccaggaacccatggaactgccaccgcatccccttgccccacacacctgcatcttcagggatggtcccccaggtagcttctggggagtccgaggggcaaggaggccaaatccttt

SEQ ID NO: 173971 - DNA, 601 bp, Human
atatctgagtctgttaatagacctgacaaccgaggaccagcccccaaggcagacgtggaaaggtgtaaatggttcatgcaaggaattgcactttgagatttttgtatttgttttattttttggttttagcatttgtagagggtttcttttttgtttgtttgttttcttggagttgctttacgttattttttccttttacttgttttcggcaggaggcccacattcccatagcgtgcctattcctatgccgggccctctcatttgggtcttcttttgtttcccccccttccataacccttacccccacaaacacacactgaagcagaccagcaacccgaaaaatcatcttgtaggtgtgtcttgtgtgcccagttttcattttcagggaacggttcaggaagattagacagctccttccctcctcaggcgatttctgttccccgcctggtctggtagacccaggaacccatggaactgccaccgcatccccttgccccacacacctgcatcttcagggatggtcccccaggtagcttctggggagtccgaggggcaaggaggccaaatcctttggaagcccggacaaggagtgggtacctgg

SEQ ID NO: 173972 - DNA, 601 bp, Human
tgttttcggcaggaggcccacattcccatagcgtgcctattcctatgccgggccctctcatttgggtcttcttttgtttcccccccttccataacccttacccccacaaacacacactgaagcagaccagcaacccgaaaaatcatcttgtaggtgtgtcttgtgtgcccagttttcattttcagggaacggttcaggaagattagacagctccttccctcctcaggcgatttctgttccccgcctggtctggtagacccaggaacccatggaactgccaccgcatccccttgccccacayacctgcatcttcagggatggtcccccaggtagcttctggggagtccgaggggcaaggaggccaaatcctttggaagcccggacaaggagtgggtacctggggctacaggaaagggaggagatggcagtggcatgcacccgcagtcagtcaaagccaccgggctcaagtcttcctcttttgcgcagcaccggtaaggagagagggtgtctatgcatcacgttggcctgggtgccatttccccaattaccccttggctgcaggctcccttcttgttggctacatttctttgatttctatttt

SEQ ID NO: 173973 - DNA, 601 bp, Human
gttatgtagatatcatataacttatttaactagtcctctattaatggatatttaggttggttgtactttttcattattacaaacaatgctgtagtgaacatctttgtatcctaatttgaacaaatggtttgttttatttttaattattcttatctttttatcccaggcaacacctacctcatttataccatagaatgagtgctcccttgaacaaatggttttttttaaatcttatttatgagacaatttggaacatgtaaaaccaggtgggatattttattatattaaggaataattgtcratttttattgtgataatagtattataggtgacttttttaagagtcccccctttttaagagatacatgttgaaatactcataagtgaaatgttatgacttctagaatttgctaataattacagcagaatagaagaaagaagattattcctgagtttctaatagttgaaattgggggataggtatatcggagctcattgtactgctctccctaattttgtaaatatttgaaatttgtcataataaactgtttaaagtaacaagaatcattttacatatacatggtatgaatataattacagg

SEQ ID NO: 173974 - DNA, 601 bp, Human
gtttctaatagttgaaattgggggataggtatatcggagctcattgtactgctctccctaattttgtaaatatttgaaatttgtcataataaactgtttaaagtaacaagaatcattttacatatacatggtatgaatataattacaggataaattcctagaagcaaacttttaaaatccaaggatatacatttaaagttatgatagtatttccaaattttataccaaaactcttatattgatttatactcttagccatcttgtataaaagtgtcatttctctacgtcctcccaactcagratatacttaattttttagagtgaaatcttttcaagtgacagaataatctcattttattagtagtttaaattgctagtgaggttaagcatgtttttatgtagttattcttcattttaatattctcttctgtgaatttttcatatatttagccatttctctatcggatcactaattgttttctcatcttcgtaagtgccacttatatagtaaggaaatgagccctttttctgtgacatgtattgcaaacaactcccaggtcactttcttaaaaaaaaaaacaaaacaaaacaaaaaacccac

SEQ ID NO: 173975 - DNA, 601 bp, Human
catttctctacgtcctcccaactcaggatatacttaattttttagagtgaaatcttttcaagtgacagaataatctcattttattagtagtttaaattgctagtgaggttaagcatgtttttatgtagttattcttcattttaatattctcttctgtgaatttttcatatatttagccatttctctatcggatcactaattgttttctcatcttcgtaagtgccacttatatagtaaggaaatgagccctttttctgtgacatgtattgcaaacaactcccaggtcactttcttaaaaaamaaaacaaaacaaaacaaaaaacccacaaaaaaacagcaacaaaaaactttctttgtgggattttttttttttctaaactgaaatttaaactctaaccacatttaatggttgttcctttttgggcttctagattctagctcctagttagaaaaatcttcatccagcatttaaaacattatatatgcatacacaaacatattaaaatgtttgctaccaaaaaaattttattccctagtcttttcaccaaaagaaataataaagaaagacaaaaaatgagttgaatctttcctccctgatcgg

SEQ ID NO: 173976 - DNA, 601 bp, Human
gtcctcccaactcaggatatacttaattttttagagtgaaatcttttcaagtgacagaataatctcattttattagtagtttaaattgctagtgaggttaagcatgtttttatgtagttattcttcattttaatattctcttctgtgaatttttcatatatttagccatttctctatcggatcactaattgttttctcatcttcgtaagtgccacttatatagtaaggaaatgagccctttttctgtgacatgtattgcaaacaactcccaggtcactttcttaaaaaaaaaaacaaaacaaaacaaaaaacccacaaaaaaacagcaacaaaaaactttctttgtgggattttttttttttctaaactgaaatttaaactctaaccacatttaatggttgttcctttttgggcttctagattctagctcctagttagaaaaatcttcatccagcatttaaaacattatatatgcatacacaaacatattaaaatgtttgctaccaaaaaaattttattccctagtcttttcaccaaaagaaataataaagaaagacaaaaaatgagttgaatctttcctccctgatcggtttccactcct

SEQ ID NO: 173977 - DNA, 601 bp, Human
tcccaactcaggatatacttaattttttagagtgaaatcttttcaagtgacagaataatctcattttattagtagtttaaattgctagtgaggttaagcatgtttttatgtagttattcttcattttaatattctcttctgtgaatttttcatatatttagccatttctctatcggatcactaattgttttctcatcttcgtaagtgccacttatatagtaaggaaatgagccctttttctgtgacatgtattgcaaacaactcccaggtcactttcttaaaaaaaaaaacaaaacaaaamaaaaaacccacaaaaaaacagcaacaaaaaactttctttgtgggattttttttttttctaaactgaaatttaaactctaaccacatttaatggttgttcctttttgggcttctagattctagctcctagttagaaaaatcttcatccagcatttaaaacattatatatgcatacacaaacatattaaaatgtttgctaccaaaaaaattttattccctagtcttttcaccaaaagaaataataaagaaagacaaaaaatgagttgaatctttcctccctgatcggtttccactcctcaga

SEQ ID NO: 173978 - DNA, 601 bp, Human
gtgacagaataatctcattttattagtagtttaaattgctagtgaggttaagcatgtttttatgtagttattcttcattttaatattctcttctgtgaatttttcatatatttagccatttctctatcggatcactaattgttttctcatcttcgtaagtgccacttatatagtaaggaaatgagccctttttctgtgacatgtattgcaaacaactcccaggtcactttcttaaaaaaaaaaacaaaacaaaacaaaaaacccacaaaaaaacagcaacaaaaaactttctttgtgggattttttttttttctaaactgaaatttaaactctaaccacatttaatggttgttcctttttgggcttctagattctagctcctagttagaaaaatcttcatccagcatttaaaacattatatatgcatacacaaacatattaaaatgtttgctaccaaaaaaattttattccctagtcttttcaccaaaagaaataataaagaaagacaaaaaatgagttgaatctttcctccctgatcggtttccactcctcagaggcaagagaagagtgaggtgcttcttttgccagacttgttcctatg

SEQ ID NO: 173979 - DNA, 601 bp, Human
tttgccagacttgttcctatgtggttacaaaaacacaaacacacacacagaaagagtttacttttactgtttttttaatataaaaatgggtttatgcacacttgccatttcacttagtagtatacaataaacatccatccaggttatgtgtctcattcttgttaatgtttacatatagccaaagttattactagactgtgattttatcgacaattttcctattgataaacattcagcttttcccccttttctccctcttgcaaactatgctacaaacagtgggtctgtatttatcaactaygccaacgtttctgtgtgatagaaagctctataaaaatgctgggacaaaggaacagtgcattttaagtttagctaggcattattcctcttcaaaaaccatatattatatcaatttatgttcttattgagagagcttgagagaacctaattctactcagccttgccagtacaattttccaaatctgatagataaaatatggcatctcaaaaaacaaggatatctcattgctgttataactttcatttttctgattcctctagcccgagtattttttcatatttattaaccacatgcatttct

SEQ ID NO: 173980 - DNA, 601 bp, Human
caataaacatccatccaggttatgtgtctcattcttgttaatgtttacatatagccaaagttattactagactgtgattttatcgacaattttcctattgataaacattcagcttttcccccttttctccctcttgcaaactatgctacaaacagtgggtctgtatttatcaactacgccaacgtttctgtgtgatagaaagctctataaaaatgctgggacaaaggaacagtgcattttaagtttagctaggcattattcctcttcaaaaaccatatattatatcaatttatgttcttaytgagagagcttgagagaacctaattctactcagccttgccagtacaattttccaaatctgatagataaaatatggcatctcaaaaaacaaggatatctcattgctgttataactttcatttttctgattcctctagcccgagtattttttcatatttattaaccacatgcatttcttcttctctgaataatttgttcggtttcccactggactgcttgactttactcactggtttacagaggctgtgtgtataccagacattaggactctgttaagaattcattatgaatattttctccc

SEQ ID NO: 173981 - DNA, 601 bp, Human
tcccaacactcgtctttgccttacatatttttaaaatttattttttattagaaataaattgcttgaaggccgggtgcagtggcttacgcctgtaatcccagcactttgggaggctgaggcggggggatcacttgagccttttgagaccagtctggccaacatggtgaaaccctgcctctactaaaaatacaaaaattagcgggcatggtggtgggtgcctgtaatctcaactactcaggaggcggatgcaggagaatcgttcgaacccaggaggcagaggttgccgtgagccaagatcacrccactgcactctagcctgggtgacagagcgagactccgactcaaaataaataaataaataaataaataaataactttacatttattatctgtctccctccccagtacaaggtttacaggaacaaatgcttttctcttttgctcatttctgtatccccaggccctagaataatatttgacaaataagggcttattaaatacatgttgaatggttgaatatattcagttgttttaatctacataaatgagattaaactacatgttattctgtaacttactttcatacactaatgtctgttca

SEQ ID NO: 173982 - DNA, 601 bp, Human
ttattagaaataaattgcttgaaggccgggtgcagtggcttacgcctgtaatcccagcactttgggaggctgaggcggggggatcacttgagccttttgagaccagtctggccaacatggtgaaaccctgcctctactaaaaatacaaaaattagcgggcatggtggtgggtgcctgtaatctcaactactcaggaggcggatgcaggagaatcgttcgaacccaggaggcagaggttgccgtgagccaagatcacgccactgcactctagcctgggtgacagagcgagactccgactcataataaataaataaataaataaataaataactttacatttattatctgtctccctccccagtacaaggtttacaggaacaaatgcttttctcttttgctcatttctgtatccccaggccctagaataatatttgacaaataagggcttattaaatacatgttgaatggttgaatatattcagttgttttaatctacataaatgagattaaactacatgttattctgtaacttactttcatacactaatgtctgttcacatagcttattgcctcattcttttcaattattacatggtatttt

SEQ ID NO: 173983 - DNA, 601 bp, Human
taaaaatacaaaaattagcgggcatggtggtgggtgcctgtaatctcaactactcaggaggcggatgcaggagaatcgttcgaacccaggaggcagaggttgccgtgagccaagatcacgccactgcactctagcctgggtgacagagcgagactccgactcaaaataaataaataaataaataaataaataactttacatttattatctgtctccctccccagtacaaggtttacaggaacaaatgcttttctcttttgctcatttctgtatccccaggccctagaataatatttgacamataagggcttattaaatacatgttgaatggttgaatatattcagttgttttaatctacataaatgagattaaactacatgttattctgtaacttactttcatacactaatgtctgttcacatagcttattgcctcattcttttcaattattacatggtattttataatacaaatgtaccactatttgttcagccatttctcttgtggaaaatactgaggatgctttcaaatttttggtgttttgagcagtgcagcaacacacaccattgttgtatatactttggagcacctgagcctgtg

SEQ ID NO: 173984 - DNA, 601 bp, Human
tcaggaggcggatgcaggagaatcgttcgaacccaggaggcagaggttgccgtgagccaagatcacgccactgcactctagcctgggtgacagagcgagactccgactcaaaataaataaataaataaataaataaataactttacatttattatctgtctccctccccagtacaaggtttacaggaacaaatgcttttctcttttgctcatttctgtatccccaggccctagaataatatttgacaaataagggcttattaaatacatgttgaatggttgaatatattcagttgttttartctacataaatgagattaaactacatgttattctgtaacttactttcatacactaatgtctgttcacatagcttattgcctcattcttttcaattattacatggtattttataatacaaatgtaccactatttgttcagccatttctcttgtggaaaatactgaggatgctttcaaatttttggtgttttgagcagtgcagcaacacacaccattgttgtatatactttggagcacctgagcctgtgtttctctaggacaaataccaacgaaaataaaatcaggccaggtgcggtggctc

SEQ ID NO: 173985 - DNA, 601 bp, Human
tgtgtttctctaggacaaataccaacgaaaataaaatcaggccaggtgcggtggctcatatctgtaatcccagcattttgggaggccaaggtgggtggatcacttgaggtcaagagtttgagaccagcctggccaacatggtgaaaccctgtctctactaaaaaattacaaaaattagggggcgtggtgatgggcacctgtaatcccagctacttgggaggctgaggcaggagaatcacttgaacccgggaggcggaggctgcagtgagcattgatattgcaccactgcactccagcctgrgcaacagagtgagactctatctcaaaaaataaaataaaataattggagcaaaagttatgtgcatctttaatcttgataaatgcagccttaaaagatggactcaattatggttctattaatagcgtataggagtgtagatttccctacagtgcaccattgttattaattgtcatcattgtttttaatcacttgttaatgtcctttcaaccttatgggatataaagggctttccattgttgctggaacttgtattatattgattactataaagctatgcttatcctttcatatgtttattgg

SEQ ID NO: 173986 - DNA, 601 bp, Human
tgagacagagtctcacggtattgccaggctggagtgcaacggtgcgatcttggctcactgcaacctctccctcccaggttcaagtgattctcatgcctcggcccctgagtagctgggattagaggcgcacgccaccacacccagctaatttttttatttttagtaaagaagaggtttcaccatgttgcccaggctggtctccaatgcctggcctcaagtgatctgcccacctcggcctcccaaagtgctgggattacaggcatgagttaccacaaccagcctctttgactcttaaatgtattttttttttcaaatctgtttcttgtactttaccttgattttggtgcttttgtcatccaagtttttagctttaatatagtcaaatacatcctttgtgtttcctttacagcctccagtttttttgctgtttgttttttgttttttttgagaccgagtcttgctctgtctcccaggctggagagcaatggcacaatctcagctcactgcaacttccccttccctgcctcagcctcccaagtagctggattacaggtgcctgccaccgcatccagctaatttttgtattttttagtagagacgg

SEQ ID NO: 173987 - DNA, 601 bp, Human
acccagctaatttttttatttttagtaaagaagaggtttcaccatgttgcccaggctggtctccaatgcctggcctcaagtgatctgcccacctcggcctcccaaagtgctgggattacaggcatgagttaccacaaccagcctctttgactcttaaatgtattttttttttcaaatctgtttcttgtactttaccttgattttggtgcttttgtcatccaagtttttagctttaatatagtcaaatacatcctttgtgtttcctttacagcctccagtttttttgctgtttgttttttgttttttttgagaccgagtcttgctctgtctcccaggctggagagcaatggcacaatctcagctcactgcaacttccccttccctgcctcagcctcccaagtagctggattacaggtgcctgccaccgcatccagctaatttttgtattttttagtagagacggagtttcgccacgttggccaggctggtctcgaactcctgacctcaggtgatccacctgcctcagcctcccaaagtgctgggattacaggcgtgagccaccacgcctagcctacagcctccagttttgcagcttgcttag

SEQ ID NO: 173988 - DNA, 601 bp, Human
tgtagatggcattttacaaacctatagtaccttatcaaaaccagaaaattgacattaatacaatataattaactagactacagaccttcctcagatttcacctgtttttccttgcactgtttttttgttttttgtatatagttctatgacattttattacatatatagatccatgtcaccaccaccacagccatgatacagtactgtggtgtcaccacaaaggaacttcctcttactactcattgatggccaggtccttcctccatccccaaatcctggcaaccactgatctggtctccamctctataattttgttacctttatattaaataaatggaatcatatagtgtataacttttgggaactgttttttcccctcagtataatttcctgtgtaaattgttgtgtgtttcaatcgttcttcctttttttcctgagtagtatcccagagtacagttacaccacagtttgtttaaccattcacccattgaaggacatctgatttatttccattagggggctattacaaataaagctgctatgatcatttgtatacaggtttttgtgtgaacataggatttcagctgggctgaaatgggat

SEQ ID NO: 173989 - DNA, 601 bp, Human
agatggcattttacaaacctatagtaccttatcaaaaccagaaaattgacattaatacaatataattaactagactacagaccttcctcagatttcacctgtttttccttgcactgtttttttgttttttgtatatagttctatgacattttattacatatatagatccatgtcaccaccaccacagccatgatacagtactgtggtgtcaccacaaaggaacttcctcttactactcattgatggccaggtccttcctccatccccaaatcctggcaaccactgatctggtctccacctytataattttgttacctttatattaaataaatggaatcatatagtgtataacttttgggaactgttttttcccctcagtataatttcctgtgtaaattgttgtgtgtttcaatcgttcttcctttttttcctgagtagtatcccagagtacagttacaccacagtttgtttaaccattcacccattgaaggacatctgatttatttccattagggggctattacaaataaagctgctatgatcatttgtatacaggtttttgtgtgaacataggatttcagctgggctgaaatgggattac

SEQ ID NO: 173990 - DNA, 601 bp, Human
ttacaaacctatagtaccttatcaaaaccagaaaattgacattaatacaatataattaactagactacagaccttcctcagatttcacctgtttttccttgcactgtttttttgttttttgtatatagttctatgacattttattacatatatagatccatgtcaccaccaccacagccatgatacagtactgtggtgtcaccacaaaggaacttcctcttactactcattgatggccaggtccttcctccatccccaaatcctggcaaccactgatctggtctccacctctataattttsttacctttatattaaataaatggaatcatatagtgtataacttttgggaactgttttttcccctcagtataatttcctgtgtaaattgttgtgtgtttcaatcgttcttcctttttttcctgagtagtatcccagagtacagttacaccacagtttgtttaaccattcacccattgaaggacatctgatttatttccattagggggctattacaaataaagctgctatgatcatttgtatacaggtttttgtgtgaacataggatttcagctgggctgaaatgggattacagctcacgcc

SEQ ID NO: 173991 - DNA, 601 bp, Human
atgggattacagctcacgcctgtaatcccaacactttgggaggcccaggcaggtggatcacctgaggtcaggagttcgagaccagcctggccaacatggtaaaaccccatctctactaaaaatacaataattagctggttgtggtggcaggcgcctgtaatcccagctacttaggaggctgaggcaggaaaatcgcttgaaaccagaagacggaggttgcagtgagccgagatcgcgccactgcactccagcctgggcaacaagagtgaaactctgtctcaaaaaaaaaaaaaaaaaaaaraatcagccgcgcatggtggcaggtgcctgtaaccccagctactcaggaggctgagacatgagaatcgtttgaacctgggaggtggaggttgcagtgagctaagattgcaccactgcactccagcctgggggatagagcgagactctatctccaaataaataaataaataaataaataaaacaaaaacaaatatttcatttccctagaataaatgcccatttattctgggcatttattctgggttgtagggtaagtatatttttaactctttaagaaactgcctggctagtagtaccattt

SEQ ID NO: 173992 - DNA, 601 bp, Human
gaggcaggaaaatcgcttgaaaccagaagacggaggttgcagtgagccgagatcgcgccactgcactccagcctgggcaacaagagtgaaactctgtctcaaaaaaaaaaaaaaaaaaaaaaatcagccgcgcatggtggcaggtgcctgtaaccccagctactcaggaggctgagacatgagaatcgtttgaacctgggaggtggaggttgcagtgagctaagattgcaccactgcactccagcctgggggatagagcgagactctatctccaaataaataaataaataaataaataaamcaaaaacaaatatttcatttccctagaataaatgcccatttattctgggcatttattctgggttgtagggtaagtatatttttaactctttaagaaactgcctggctagtagtaccattttccattcccaccagcaatgtaagagagatccagcttccctgcatcctcaccagcttttccactctcagtattttttctttttgctgttctgataggtgtttcttattgcagctttaatttgcctttccctgatggccagcaatgttgaacatttttcatgtgcttatttgtatggcatgt

SEQ ID NO: 173993 - DNA, 601 bp, Human
gcgcatggtggcaggtgcctgtaaccccagctactcaggaggctgagacatgagaatcgtttgaacctgggaggtggaggttgcagtgagctaagattgcaccactgcactccagcctgggggatagagcgagactctatctccaaataaataaataaataaataaataaaacaaaaacaaatatttcatttccctagaataaatgcccatttattctgggcatttattctgggttgtagggtaagtatatttttaactctttaagaaactgcctggctagtagtaccattttccattccyaccagcaatgtaagagagatccagcttccctgcatcctcaccagcttttccactctcagtattttttctttttgctgttctgataggtgtttcttattgcagctttaatttgcctttccctgatggccagcaatgttgaacatttttcatgtgcttatttgtatggcatgttttaatatttggtggcaagtctgaggttgcctttctcgtctgggtcatgcctccatgaccctgagggagacagctgcacttggctgctccctgaggtggcaatccccctttaggtcttgtataaagagg

SEQ ID NO: 173994 - DNA, 601 bp, Human
gtagtaccattttccattcccaccagcaatgtaagagagatccagcttccctgcatcctcaccagcttttccactctcagtattttttctttttgctgttctgataggtgtttcttattgcagctttaatttgcctttccctgatggccagcaatgttgaacatttttcatgtgcttatttgtatggcatgttttaatatttggtggcaagtctgaggttgcctttctcgtctgggtcatgcctccatgaccctgagggagacagctgcacttggctgctccctgaggtggcaatccccctttaggtcttgtataaagagggaaggatggtttgatctcatgtttagggactcaggctcagatgctacagggtgggcttgaggaggcttattaaggggagggtaagacaccagctgtaacagcacccttcctcctattcataccccacaaaacatgtttgataaaatcagtgcctttgagatggattcacttgggagttttgccacaaagttctgagtctgctctcacaattggaaattatggaacctgagcaaaggagactgatccagtcacagtggggtcacacatattatcctatctt

SEQ ID NO: 173995 - DNA, 601 bp, Human
gatggtttgatctcatgtttagggactcaggctcagatgctacagggtgggcttgaggaggcttattaaggggagggtaagacaccagctgtaacagcacccttcctcctattcataccccacaaaacatgtttgataaaatcagtgcctttgagatggattcacttgggagttttgccacaaagttctgagtctgctctcacaattggaaattatggaacctgagcaaaggagactgatccagtcacagtggggtcacacatattatcctatctttttgaaatgtgaacagaattggagytggggagcttgagttgtcctaagaggcctgtagtttctagaacacatccttttgataggctctgcccagcagcttagcaggacctggcctgggatggggagggaggccacctctgagcagtgacacatcctccaccctggctcaccttttccctgaggctgactatgaacaggacggtgcttgagaacctgtgagatctgagccaggactcttgagccaggagccagagcataccctggaaggggagtgtcaatttgcactggcaggacccagaaagagtcagtctcctggggtgggacg

SEQ ID NO: 173996 - DNA, 601 bp, Human
gatgctacagggtgggcttgaggaggcttattaaggggagggtaagacaccagctgtaacagcacccttcctcctattcataccccacaaaacatgtttgataaaatcagtgcctttgagatggattcacttgggagttttgccacaaagttctgagtctgctctcacaattggaaattatggaacctgagcaaaggagactgatccagtcacagtggggtcacacatattatcctatctttttgaaatgtgaacagaattggagctggggagcttgagttgtcctaagaggcctgtagtytctagaacacatccttttgataggctctgcccagcagcttagcaggacctggcctgggatggggagggaggccacctctgagcagtgacacatcctccaccctggctcaccttttccctgaggctgactatgaacaggacggtgcttgagaacctgtgagatctgagccaggactcttgagccaggagccagagcataccctggaaggggagtgtcaatttgcactggcaggacccagaaagagtcagtctcctggggtgggacgcttggagggaggggctcagggtaaccctctagagc

SEQ ID NO: 173997 - DNA, 601 bp, Human
tattaaggggagggtaagacaccagctgtaacagcacccttcctcctattcataccccacaaaacatgtttgataaaatcagtgcctttgagatggattcacttgggagttttgccacaaagttctgagtctgctctcacaattggaaattatggaacctgagcaaaggagactgatccagtcacagtggggtcacacatattatcctatctttttgaaatgtgaacagaattggagctggggagcttgagttgtcctaagaggcctgtagtttctagaacacatccttttgataggctcygcccagcagcttagcaggacctggcctgggatggggagggaggccacctctgagcagtgacacatcctccaccctggctcaccttttccctgaggctgactatgaacaggacggtgcttgagaacctgtgagatctgagccaggactcttgagccaggagccagagcataccctggaaggggagtgtcaatttgcactggcaggacccagaaagagtcagtctcctggggtgggacgcttggagggaggggctcagggtaaccctctagagcagggattctcaaggtaggtcccaccgtc

SEQ ID NO: 173998 - DNA, 601 bp, Human
gtaagacaccagctgtaacagcacccttcctcctattcataccccacaaaacatgtttgataaaatcagtgcctttgagatggattcacttgggagttttgccacaaagttctgagtctgctctcacaattggaaattatggaacctgagcaaaggagactgatccagtcacagtggggtcacacatattatcctatctttttgaaatgtgaacagaattggagctggggagcttgagttgtcctaagaggcctgtagtttctagaacacatccttttgataggctctgcccagcagcttrgcaggacctggcctgggatggggagggaggccacctctgagcagtgacacatcctccaccctggctcaccttttccctgaggctgactatgaacaggacggtgcttgagaacctgtgagatctgagccaggactcttgagccaggagccagagcataccctggaaggggagtgtcaatttgcactggcaggacccagaaagagtcagtctcctggggtgggacgcttggagggaggggctcagggtaaccctctagagcagggattctcaaggtaggtcccaccgtccctgtggatcaca

SEQ ID NO: 173999 - DNA, 601 bp, Human
tgacactccttcatgcatgcatgcatgcacagacacacacacacacacacacacgcacagcttaggacctggctctgacctctccagtaagccttacctgattgatcacattcaattctaacccatcatcccctatgtacttgaggacccagcatatttttcccatctgttccttactctgcaaaggcccagaatcctggctgggacagagtgagtcctttcttcccagaccacattggtagacctggcagttgtactgaggcctattcacatacatttagccacccattagatataataycctgcattgggtggttaaggaatctgggcccagagagggtgagcaacttgtcacaggtcatgcaaccagatccaggcctgaggagctctgcgatagatcacaccaccttttattaagatgctttctggtgatctaactccctagctaatgaactaagctggctcctttcatggcctctgcagatgccaaagggacaattcgggaaattgtcctgcctaagggcctggacctggaccggcccaagcggacacgtacatccttcactgccgagcagctgtaccgcctggagatggagttcca

SEQ ID NO: 174000 - DNA, 601 bp, Human
acacgtacatccttcactgccgagcagctgtaccgcctggagatggagttccagcgctgccagtatgtggtgggccgcgagcgcactgagctggcccgccagctgaacctctccgagacccaggtaagagaccagggccaggccactccactcttgtcctggcagcctgggaactcctggggatatgaggccctgtgagctgctacagggagacccaactttggaggagttcagacaagcatgagggaaagactttaagctacaggtaaaccagagtgaaagagcaaataaatatagcgcygaccacagacagtcaggaaatgccaatgggggccttctggatagatcaggcacttttggatggaatatggaaaaggttcagagaaactgggggagagcagccctcagggcacagggagtggcttgggggggtgttggcatgtaagaggagtgacaagaagggatggtgagggcttggctggttggaaataacgattctggggaagatgaaacattataaaattgggctggggacctctcgcttctccatttctggccctttcccaccctccatcaccttcccttcatctcagggtgcctc

SEQ ID NO: 174001 - DNA, 601 bp, Human
gcccgccagctgaacctctccgagacccaggtaagagaccagggccaggccactccactcttgtcctggcagcctgggaactcctggggatatgaggccctgtgagctgctacagggagacccaactttggaggagttcagacaagcatgagggaaagactttaagctacaggtaaaccagagtgaaagagcaaataaatatagcgccgaccacagacagtcaggaaatgccaatgggggccttctggatagatcaggcacttttggatggaatatggaaaaggttcagagaaactggggragagcagccctcagggcacagggagtggcttgggggggtgttggcatgtaagaggagtgacaagaagggatggtgagggcttggctggttggaaataacgattctggggaagatgaaacattataaaattgggctggggacctctcgcttctccatttctggccctttcccaccctccatcaccttcccttcatctcagggtgcctcagtctcttgttggaaaggaggggtctgcacacccccttcacctgggtaggactggcattttaacagcagtgtgcttaactcaaaagaaaaaaa

SEQ ID NO: 174002 - DNA, 601 bp, Human
aagagaccagggccaggccactccactcttgtcctggcagcctgggaactcctggggatatgaggccctgtgagctgctacagggagacccaactttggaggagttcagacaagcatgagggaaagactttaagctacaggtaaaccagagtgaaagagcaaataaatatagcgccgaccacagacagtcaggaaatgccaatgggggccttctggatagatcaggcacttttggatggaatatggaaaaggttcagagaaactgggggagagcagccctcagggcacagggagtggcttgggggggtgttggcatgtaagaggagtgacaagaagggatggtgagggcttggctggttggaaataacgattctggggaagatgaaacattataaaattgggctggggacctctcgcttctccatttctggccctttcccaccctccatcaccttcccttcatctcagggtgcctcagtctcttgttggaaaggaggggtctgcacacccccttcacctgggtaggactggcattttaacagcagtgtgcttaactcaaaagaaaaaaacttttgtaaattaagcacctaccctgtatgaa

SEQ ID NO: 174003 - DNA, 601 bp, Human
taaattaagcacctaccctgtatgaatggagacccttcaagctggtactagagctataaaatactaccactactactactactactaatacttagtacttacatgtgtcaggcactaagtgctttgcctatgttaagtaactaatccctcccaagaagcagatgatgtcattcccatgttacacgtgaaaggaagttatgcccaaggtcagacaactaattagttccggagctgggctttggacaagcagtctctcatctttatgctgcctataaactgggcaaccttccttgagattgtmaaagaataactcagagacccttctttcagccagagctctagtagtttgctctcatatatgagggagatcaatcaatacatgcattgtaaacgacggccaaaacaggattgataaagtggagaggaagggaggaggggaatgcggaagcactggtctggagcagtgtgctggtttccttccttggagcgaggcgggaggctgtgctggagtgagggcttcccgtctgtgctgtgtggctgctgtcctcccctgtgtccctgcctcagtgaggtcagctctccctgtttccctcagcataat

SEQ ID NO: 174004 - DNA, 601 bp, Human
catctccacctgcacttgtttttccccagctgccactgcagagctcccaaacaaccctgcggggcctccctccagctgggctcaacagggggctgggaagccaggcttgtgctcagagaggaggctgcagtggcagggccaggccagaactcctggggaagtcactgaggcccgtattccctacactgagctgcccttggaggtcaagcccaagcccccctcttccaggaagccttctgcaggcaccttgccctcttcccaagagacccttccacatggcgtgacctggagagacagatattgtgtgtgtgtgtgtgcacgtgtgtgcatgtgtacatgtgtgtggtgttggatgtccaccagtatttgcttccctaggacaagaatgtatttataggccatggctcctcgtcgtgcttcacaaggagcccagaacacagctggacacatagtaggccctcagcaagtcctccgcactgttctcactacaaccctccttcctctgtccccagtcctagggttgacagatagtaaaagtaatggacagctgatgcttattgagcgcttcccatgcaccaggtcctgttccaagggtgtgaca

SEQ ID NO: 174005 - DNA, 601 bp, Human
aggagccacctgtgcttctgaatggactggcctaaaaccgggggctcccacatcgccctctgcaggtttgacaattcactagaatgacgcacacaactcaggaaacacctcccctacacttgctggtttattataaatgacacgagtgaggaagagccagatggaagagacacaaagggcaaggtaagggggaggtgcgtggagctcccatgccgtttccagtgcccccattcccagcacttccacgtgttcgccaaccagaagttctcctggtctccttgttcaagactaaatccaggcyggcctggcacagtggctcacgcctgcaatcccagcactttgggaggccaaggagggaggatcgctcaggagtccaggagttcaagaccagccttggcagcagagggagaccttatctctaaaaaaagttttttaaaacattttttacagtttacactgtaaactgcagggtgtggtggcacacacctgtagtcccagctacttgggaggctgaggtgggaggattgtttgagcccaggaggtcaaggctacagtgagccatgttagcttcactgcactccagcctggatgacagagcaag

SEQ ID NO: 174006 - DNA, 601 bp, Human
atagaatgttctagaagtatcagaaggccagagtggctggagctacagggtaattgggtaagtaggtaggggaggatcatgcgatgcttagagactatggtaatacattgaagagaaagtgacaggagatgattggcattttacagaggttctctggctgccacttggggaagggacccacaggggaaaggagtggacaggtgtggacaggtaggaactactgacatgggtcctgaacagagcagtggtggaggagagaagcgtactaatgtgagaggcactctaatttagtgctggaacmtattaggacttgctcatggattatacgcccagggcaagggaaaggaagtggtttgggtagaacaactgggagaatggtgacaccatataatgagttgagaaactgggggagaagcaagatggtgggagcataatcaagaattttgttttggatcagttaagtttgagatcccagcggagatgtcaagaaagcatgtcagattttggggggagggctggtttttctctggtttaagttatctgagagtctctgtcagagctcttttgggggaaaagataagaaattccttcaagtgccctc

SEQ ID NO: 174007 - DNA, 601 bp, Human
caagccatcctagatacacagataccactcacctcagattaagtatgggcccatggtcacagaaaacagtcttcaaaagatgaatgccatttccagatcaacaatgaatcctggaatttgatattgaccatgagcccaaagaagctggtggataatctcctggaaaattcctctgtagtcctggcagccaagtggaaactgtgcccatctcctggtgcgcggccatggatcacagtgtggcccagaaagaaatcagggagggggcagtgccatgggtcacagtgtggcccagcaagagatygcggaggggggcggggcagccaccaagcactcactgagtcccagggagtcaagatggcagcctccaggaggccacacaggaccctgagaaaacagaggagggagacagcccagaaggtgcactgggcaggtgaggggagaggcacagctgcggaggtgtgctggccccgccaccctgtgaagtcggctaggaatggtttcccagaagtggataaggaccgatcactttggatttaaccttgagaagaggatgaacctgagatggaaatgaaggtttcctggggcaggagggacacattca

SEQ ID NO: 174008 - DNA, 601 bp, Human
gagagacaacatttgcagggccctgtgaacctacccgctagggcctgaagggcctgataggcttggtgggcctgatgggcttgatggtgggaagtagagagttgacccttcttactctcacccttgaagtttgcaatgctgggaagcacattagattcacccacagagctttagaagaatacccaggcctcagccccattccctagagattctgatttaatatgggtgaggcatgaggcccggacatcatcccagaaaattccagtgtgcggccaaggttgagaattcctgacctagcccrtatgtggccaagaaacaagcacccctggtcccagcccctgctccatctgcctctgacttctcctctcctagggtccaggctcaccttctcaggagacgcccaaacccagcaccagcccacacccgcctctccttgctacacccagagctgcaggaagatgggatatgtgggagagcaccttgtaaatgcctggtcattcctcatctgtcacaccccattactgccactccctgagtacgaattgccctctgttttttgggaatgagttagtgccactcccccactagaccctcagcttcc

SEQ ID NO: 174009 - DNA, 601 bp, Human
atcccttactgatatcttcttcaaatgtcccctcttcagggaggctgtatgtgccattccattaacaaaacagtcacccccctccttcctttctgctatcctgccacctttctctaaagcagtgccccccagagtatggcccttgggccactgccagcccataaactgttacctgtctatgacatggtaagtatagaaataaagaataggtatttagaaaaggcctggagcggtggctcatgcctgtaatcccagcactttaggaggccgaggtgggcagatcacgaggtcaggagttcgagaccagcctggccaacatggtgaaaccctgtctctagcaaaaatacaaaaattagttgggtgtgatggcacacgcctataatcccagctactcaggaggctgaggcaggagactcacttgaaccccggaggtggaagttgcagtgagccgagatcatgccactgcactccagcctgggctacagagtgagactccatctcaaaaaaaaaaaacaatgtatatagcaatctttccagtaattcattttaattgtattttttaaagtattggtcctcaacaaaattggacactttataaagt

SEQ ID NO: 174010 - DNA, 601 bp, Human
ctgatatcttcttcaaatgtcccctcttcagggaggctgtatgtgccattccattaacaaaacagtcacccccctccttcctttctgctatcctgccacctttctctaaagcagtgccccccagagtatggcccttgggccactgccagcccataaactgttacctgtctatgacatggtaagtatagaaataaagaataggtatttagaaaaggcctggagcggtggctcatgcctgtaatcccagcactttaggaggccgaggtgggcagatcacgaggtcaggagttcgagaccagcmtggccaacatggtgaaaccctgtctctagcaaaaatacaaaaattagttgggtgtgatggcacacgcctataatcccagctactcaggaggctgaggcaggagactcacttgaaccccggaggtggaagttgcagtgagccgagatcatgccactgcactccagcctgggctacagagtgagactccatctcaaaaaaaaaaaacaatgtatatagcaatctttccagtaattcattttaattgtattttttaaagtattggtcctcaacaaaattggacactttataaagtggtcctca

SEQ ID NO: 174011 - DNA, 601 bp, Human
ggcctcaatgtatatctggtgagtgaatgaatggataaatgaagcaatcaacctcaagtaggtctcataactttctggtcacttttgattattgaatctgcatccgccaggtgcggtggtgtgcacctgtagtcccagaacttgggaggctgaggcaagaggatcacttgaggccaggattttgaggctgcagtgagctctcatgacactagtgtactgcagcccaggcagaaaaccaacactttgtctctaaaaacaaaaataaagaaataaactcaatccaatgtccttcaaaacaccaactcacatctagtttaaatctcatcttctcctgaagccccacacctgcttccccactcagaacagccttgactcactgcttgccagcaaggtttgaggtttgaggaaagcacatctcacataggagcatgaacacccagtcatcctgctgaagaactacaaaaggacccctgcccactctttacctcctcccagtgcagcctctggaggggattgtgatctgtctcagtcacttgctccctcttcccccaacagccacctcctccaggatcagacgacagggggtggcttcaaggaggca

SEQ ID NO: 174012 - DNA, 601 bp, Human
tgcagcccaggcagaaaaccaacactttgtctctaaaaacaaaaataaagaaataaactcaatccaatgtccttcaaaacaccaactcacatctagtttaaatctcatcttctcctgaagccccacacctgcttccccactcagaacagccttgactcactgcttgccagcaaggtttgaggtttgaggaaagcacatctcacataggagcatgaacacccagtcatcctgctgaagaactacaaaaggacccctgcccactctttacctcctcccagtgcagcctctggaggggattgtratctgtctcagtcacttgctccctcttcccccaacagccacctcctccaggatcagacgacagggggtggcttcaaggaggcagagatctttttaaaagactggacatcttctggtgtgaggaggggaagcaccaaggcctcactttctgaaggcctttgctgaagggccagtcactcctagcaggtggtgatgtctggcatggcccaggtggcccagtctgtcttggctctgcctgtcttcttaacctgggcagccctctggctcaagccttctcctccacccatctcttggcaacttc

SEQ ID NO: 174013 - DNA, 601 bp, Human
ctctaaaaacaaaaataaagaaataaactcaatccaatgtccttcaaaacaccaactcacatctagtttaaatctcatcttctcctgaagccccacacctgcttccccactcagaacagccttgactcactgcttgccagcaaggtttgaggtttgaggaaagcacatctcacataggagcatgaacacccagtcatcctgctgaagaactacaaaaggacccctgcccactctttacctcctcccagtgcagcctctggaggggattgtgatctgtctcagtcacttgctccctcttccmccaacagccacctcctccaggatcagacgacagggggtggcttcaaggaggcagagatctttttaaaagactggacatcttctggtgtgaggaggggaagcaccaaggcctcactttctgaaggcctttgctgaagggccagtcactcctagcaggtggtgatgtctggcatggcccaggtggcccagtctgtcttggctctgcctgtcttcttaacctgggcagccctctggctcaagccttctcctccacccatctcttggcaacttctcaaaaccacagcagttgctggactattaa

SEQ ID NO: 174014 - DNA, 601 bp, Human
aaggacccctgcccactctttacctcctcccagtgcagcctctggaggggattgtgatctgtctcagtcacttgctccctcttcccccaacagccacctcctccaggatcagacgacagggggtggcttcaaggaggcagagatctttttaaaagactggacatcttctggtgtgaggaggggaagcaccaaggcctcactttctgaaggcctttgctgaagggccagtcactcctagcaggtggtgatgtctggcatggcccaggtggcccagtctgtcttggctctgcctgtcttcttwacctgggcagccctctggctcaagccttctcctccacccatctcttggcaacttctcaaaaccacagcagttgctggactattaaatcttccaaaagctggaaggaaccagcaaggtcttcctgaccttttcttattgggccctcccctccacggttctcaccctccctgccggtacacctgccccagctccaggcgaggagcagggttggcctctatgttcccagggaaacaagtctgggtgctcccatggtggcctccatgacatgggcctgtagatgctgtggcctgatgagtttct

SEQ ID NO: 174015 - DNA, 601 bp, Human
tctggcatggcccaggtggcccagtctgtcttggctctgcctgtcttcttaacctgggcagccctctggctcaagccttctcctccacccatctcttggcaacttctcaaaaccacagcagttgctggactattaaatcttccaaaagctggaaggaaccagcaaggtcttcctgaccttttcttattgggccctcccctccacggttctcaccctccctgccggtacacctgccccagctccaggcgaggagcagggttggcctctatgttcccagggaaacaagtctgggtgctcccayggtggcctccatgacatgggcctgtagatgctgtggcctgatgagtttctggagtggggcatgaatgccagtctctccttctagtgcctacaagtgattcttttgggccctcccccaacttgcatctgcagggcagcacacccttcctcccatgaggttttgtggcccccaggggactgagcctcagcttcctgcccagttccctttcctcatgtagagtaggaaggggtttggagcactgggtgttgggtagtagaggcagggccagttctgcctcctctcagaggccctgaaaaagac

SEQ ID NO: 174016 - DNA, 601 bp, Human
cacccatctcttggcaacttctcaaaaccacagcagttgctggactattaaatcttccaaaagctggaaggaaccagcaaggtcttcctgaccttttcttattgggccctcccctccacggttctcaccctccctgccggtacacctgccccagctccaggcgaggagcagggttggcctctatgttcccagggaaacaagtctgggtgctcccatggtggcctccatgacatgggcctgtagatgctgtggcctgatgagtttctggagtggggcatgaatgccagtctctccttctagygcctacaagtgattcttttgggccctcccccaacttgcatctgcagggcagcacacccttcctcccatgaggttttgtggcccccaggggactgagcctcagcttcctgcccagttccctttcctcatgtagagtaggaaggggtttggagcactgggtgttgggtagtagaggcagggccagttctgcctcctctcagaggccctgaaaaagacctcttccatgattctggtgactttcttcagactgtggcacctctttgtcctcagctttgaatgtgtggccaacagaagtccccct

SEQ ID NO: 174017 - DNA, 601 bp, Human
ggtgtcacattgagaaacttggcctttataggtgatggggtaggagggtgctgctaaaaacttcaaaccgggcaatggccagattgggttagaaagagctccctccaaaggcagcgtggcggccagcatggatgcagagacctcaccatccccagacaggcatctggcccctcctctggtcatgcccctccctacggaatgaggactctgcaaagccaaggggtctcgcctgccagaagcctgtgcccacctttgagaccacccatccctgccaacaaagtgtccagtttcagaattcccygccaaatggccctgagccacatccggcacctgcctgggcctctccagggtcagtcttcccaagggcagaccacagacattattcagcactccaggcccaagaagcggccaatggggggctatttgcagactgtgaacaggctggggcagccacacacgtgtgggtcagagccagggtgggccatgagccagaggcttccattttttctcttgccccagccctctagatgttacagtttagacctggggcagagacacctttaaaacactggcttcttcaccttggaatcacctggtgagc

SEQ ID NO: 174018 - DNA, 601 bp, Human; identical to SEQ ID NO: 22952

SEQ ID NO: 174019 - DNA, 601 bp, Human; identical to SEQ ID NO: 22953

SEQ ID NO: 174020 - DNA, 601 bp, Human; identical to SEQ ID NO: 22954

SEQ ID NO: 174021 - DNA, 601 bp, Human; identical to SEQ ID NO: 22955

SEQ ID NO: 174022 - DNA, 601 bp, Human; identical to SEQ ID NO: 22956

SEQ ID NO: 174023 - DNA, 601 bp, Human; identical to SEQ ID NO: 22957

SEQ ID NO: 174024 - DNA, 601 bp, Human; identical to SEQ ID NO: 22958

SEQ ID NO: 174025 - DNA, 601 bp, Human; identical to SEQ ID NO: 22959

SEQ ID NO: 174026 - DNA, 601 bp, Human; identical to SEQ ID NO: 22960

SEQ ID NO: 174027 - DNA, 601 bp, Human; identical to SEQ ID NO: 22961

SEQ ID NO: 174028 - DNA, 601 bp, Human; identical to SEQ ID NO: 22962

SEQ ID NO: 174029 - DNA, 601 bp, Human; identical to SEQ ID NO: 22963

SEQ ID NO: 174030 - DNA, 601 bp, Human; identical to SEQ ID NO: 22964

SEQ ID NO: 174031 - DNA, 601 bp, Human; identical to SEQ ID NO: 22965

SEQ ID NO: 174032 - DNA, 601 bp, Human; identical to SEQ ID NO: 22966

SEQ ID NO: 174033 - DNA, 601 bp, Human; identical to SEQ ID NO: 22967

SEQ ID NO: 174034 - DNA, 601 bp, Human; identical to SEQ ID NO: 22968

SEQ ID NO: 174035 - DNA, 601 bp, Human; identical to SEQ ID NO: 22969

SEQ ID NO: 174036 - DNA, 601 bp, Human; identical to SEQ ID NO: 22970

SEQ ID NO: 174037 - DNA, 601 bp, Human; identical to SEQ ID NO: 22971

SEQ ID NO: 174038 - DNA, 601 bp, Human; identical to SEQ ID NO: 22972

SEQ ID NO: 174039 - DNA, 601 bp, Human
ccctgcaaaggtacaagatcactctcttatcctccctccaccaaccagccccactccctcagcgtcccaccccacctcctagctgagcaaactggaagtctcggtgcccctttgacccctcttgtcccagaccccacacctgccagcgcccatgtctgtagctccctcccaccccactgctaccttgtgatggcgatggccttgggctcccagcctggcaccctcctatcctgtctccatcctccagcccttcagacctgacccttgcatcaaatttgcccagggctctccagtgccctcwgcttacaggtcttttcttttttttttttttttttgagacggagtctcactctgtcccccaggctggagtgcagtggcgcaatctcggctcactgcaagctccgccctccaggttcacgctattctcctgcctcagcctcccaagtagctgggactacaggcacccgctaccacgcccagctgattatttgttttttagtagagacggggtttccccgtgttagccaggatggtctcaatctcttgacctggtgatccgcccgcctcggcctcccaaagtgctgggattacaggcgtgagc

SEQ ID NO: 174040 - DNA, 601 bp, Human
agatcaacagcattagcactgcccaggaacgtgttagaaatacaaattcttgggctccacctcagactgacagaatcagaagctctgggggtagggcccagaagtctgtcctcacaagccttccaggtgaactgatgctcaagttagagaaccatcaatctcggattgtaaatcccagtttcctcatctattaaataataataggattattgtgaggttcacatcagacaaatgtagtattattctcccttgagaatagccagcaatgtttctgcctggaatgcagaaatgctaataagcytgattcaacagttggtgccacctcctgccccctctccacctccaccacactctccaccagacctgccattctccatgggacccagtgtggcatggagtcggaacctatacaggtgtccattttctccactgtaaaatgaggccgatctaggaaaccagaactaggtccccagacctgtggttttgcgactatcggatgcatctgtagctttggcagagaaaaataattgggtggtggaggcacctctccccatccctctccgttgcccctacccctttccctctaccaggatttggcaaa

SEQ ID NO: 174041 - DNA, 601 bp, Human
ccagtttcctcatctattaaataataataggattattgtgaggttcacatcagacaaatgtagtattattctcccttgagaatagccagcaatgtttctgcctggaatgcagaaatgctaataagcctgattcaacagttggtgccacctcctgccccctctccacctccaccacactctccaccagacctgccattctccatgggacccagtgtggcatggagtcggaacctatacaggtgtccattttctccactgtaaaatgaggccgatctaggaaaccagaactaggtccccagayctgtggttttgcgactatcggatgcatctgtagctttggcagagaaaaataattgggtggtggaggcacctctccccatccctctccgttgcccctacccctttccctctaccaggatttggcaaatgctacaattctgtttctacagcgccaccttctgcccacattgaatcacacaggcaattactcttcctgcttccgtcctcaaatgtaagaacatttgagggaagaattttgtgtagatcagaggttcttagcccaaggaattaggcccttgaaattgtgtgcagacctttgaag

SEQ ID NO: 174042 - DNA, 601 bp, Human
acctttgaaggtatgcatgaatgtgcctgtgcatttttctggtaggagtttctacagtttcgtctgatttttcagggttcgtgacccagaaaagtctaactctctgatttgtataagttgaacaagcatcagaatatcaggggtgcagggggcttgttaacaggcagattgctaggccccaccccagagctctgattcagcatgcctggggtaggaggcccaagaatgtacatttctatcaagttcctaggtgatgctgctggtatggggaccacacggagaacctctgttctagagaatsttctgactcctgtagtctgtgattcaaattggtccctgtttgagaattggagtaagcactcaccttaaccaccagactccatccccaatgtctgtggctgctttcaaaagagtctgcatcagctctgaagacaatttccaaagaggagcctccgcactgccctggccattgtcagcaggagggaccttagaggcagcattcctgtgcacaaatcccgacaggcttgctaagaacttccagtcctccgtgtgtagacagcagctcccctgtgcctggccacttgctggttgagagctcagt

SEQ ID NO: 174043 - DNA, 601 bp, Human
gatggcccttccccagatctgaccacaatttctgccatttaaagttcattttctctgattttgtccttcagggacacagaacgcaccactctcctctccactctcctctcctgccaccctccctctctcacccacataaactcacatgaaaatgatcactttttttttttctttttgagacggagtcttgctctgtcgccaggctgaagtgcaatggcacgatctctgctcactgcatccttcttctcccgggttcaagcgattttcctgcctcagcctcccgagtagctaggactacagaaaatgatcacttttaaatcactccaccgcctgatttctttggggcacactctggcctgtgttctgtacagcaacttttcccctgaggttgaaacagccctccgtcacctccagggagatgacaaataatgaggcagggcccgtttcgtatcgaaacacaggttatcagagtgggagaggaaaacgagccgggacgtgtgttccacgcgtttcccaggccctcgctgtccgtgctcctgggctccctcttgtggttgagaacccaagacgcctgggtgttcggagctcctcccacctcgga

SEQ ID NO: 174044 - DNA, 601 bp, Human
aagttcattttctctgattttgtccttcagggacacagaacgcaccactctcctctccactctcctctcctgccaccctccctctctcacccacataaactcacatgaaaatgatcactttttttttttctttttgagacggagtcttgctctgtcgccaggctgaagtgcaatggcacgatctctgctcactgcatccttcttctcccgggttcaagcgattttcctgcctcagcctcccgagtagctaggactacagaaaatgatcacttttaaatcactccaccgcctgatttctttggggcacactctggcctgtgttctgtacagcaacttttcccctgaggttgaaacagccctccgtcacctccagggagatgacaaataatgaggcagggcccgtttcgtatcgaaacacaggttatcagagtgggagaggaaaacgagccgggacgtgtgttccacgcgtttcccaggccctcgctgtccgtgctcctgggctccctcttgtggttgagaacccaagacgcctgggtgttcggagctcctcccacctcggagccctcctccccggccggcctagtgctgaggcccccactcc

SEQ ID NO: 174045 - DNA, 601 bp, Human
gatccactgacagtgtcagcggatacacattttacgcattcttttggatactggcatagcaggcgatagtatggatgtactgtaacttactcaatagtcccattattgacagacattcgtatgttctcaggttttgccattacaaatagtacaatattgtatcccttttaaacggacgcttttgtggttataggatagattcccagaagtggaattgctggttcaagtacttttttatttcaaattagatattgacaatttggggcaagatggcttgcccagaagggttgtggtaattcayatttccaccaaccaggtatgagaggacccacttccccacatccttgctggccctgaatatgttctctctgtagttttacctatctaataaatgaaaactagtactgtctcgcttttatttacatttctctgataactaggaaagttgagtgtctgtccatatgtttaccattttgattttgcttccttctccgtgaaatcttcctaccaagcaagttgtgcatacgggagctccttgtttattgctcacaggctatcttttgcaacaataaatgaaacaaagatttcatctattgtgtct

SEQ ID NO: 174046 - DNA, 601 bp, Human
gacagtgtcagcggatacacattttacgcattcttttggatactggcatagcaggcgatagtatggatgtactgtaacttactcaatagtcccattattgacagacattcgtatgttctcaggttttgccattacaaatagtacaatattgtatcccttttaaacggacgcttttgtggttataggatagattcccagaagtggaattgctggttcaagtacttttttatttcaaattagatattgacaatttggggcaagatggcttgcccagaagggttgtggtaattcatatttccascaaccaggtatgagaggacccacttccccacatccttgctggccctgaatatgttctctctgtagttttacctatctaataaatgaaaactagtactgtctcgcttttatttacatttctctgataactaggaaagttgagtgtctgtccatatgtttaccattttgattttgcttccttctccgtgaaatcttcctaccaagcaagttgtgcatacgggagctccttgtttattgctcacaggctatcttttgcaacaataaatgaaacaaagatttcatctattgtgtctctgccata

SEQ ID NO: 174047 - DNA, 601 bp, Human
tttacatgcctggaatgtatttgggtttatgatgtggttatcttctaactagatatcctcttatgttctatatattatttcccctctgagaattaattaatatacaacatttgttctataatagtcctataaaatctgggatctccttctggactttttttctttcctactgatccatttgtctacctcatatcaatttactgcttgacttcagtagctttataacaagttttaatatctgaaaaggcaagtcctctatctctgatctttttcataactactttggctattctcagacatktatgtgaactttaaaataattttattaaattttaaaataaacaataatccattagggttggatcaaatttatatacttttcaaaaggattaatgtttttatgctagtaactaagaacattaagacaataatgttcttcattgtttaggacttgttttatgttattccataatttttttttgtacctttcttgttatatttatttctagctattttatgagttttggccctattgcagatgggatggttttctccgttgcctcttctaactggttactactaaaatagaaaaaaaaggagg

SEQ ID NO: 174048 - DNA, 601 bp, Human
ccctctgagaattaattaatatacaacatttgttctataatagtcctataaaatctgggatctccttctggactttttttctttcctactgatccatttgtctacctcatatcaatttactgcttgacttcagtagctttataacaagttttaatatctgaaaaggcaagtcctctatctctgatctttttcataactactttggctattctcagacatttatgtgaactttaaaataattttattaaattttaaaataaacaataatccattagggttggatcaaatttatatacttttyaaaaggattaatgtttttatgctagtaactaagaacattaagacaataatgttcttcattgtttaggacttgttttatgttattccataatttttttttgtacctttcttgttatatttatttctagctattttatgagttttggccctattgcagatgggatggttttctccgttgcctcttctaactggttactactaaaatagaaaaaaaaggagggggggaatgatttttaaatatttatcttataaacagccaaattatcttattcattctaaaaccttctttctaaaccagaac

SEQ ID NO: 174049 - DNA, 601 bp, Human
atccatttgtctacctcatatcaatttactgcttgacttcagtagctttataacaagttttaatatctgaaaaggcaagtcctctatctctgatctttttcataactactttggctattctcagacatttatgtgaactttaaaataattttattaaattttaaaataaacaataatccattagggttggatcaaatttatatacttttcaaaaggattaatgtttttatgctagtaactaagaacattaagacaataatgttcttcattgtttaggacttgttttatgttattccataatttttttttgtacctttcttgttatatttatttctagctattttatgagttttggccctattgcagatgggatggttttctccgttgcctcttctaactggttactactaaaatagaaaaaaaaggagggggggaatgatttttaaatatttatcttataaacagccaaattatcttattcattctaaaaccttctttctaaaccagaacctcttgagtctttctaaatgtataatataatctgcaaataaagggaattatgtctctttttccgtcagtatacttttactttactttttat

SEQ ID NO: 174050 - DNA, 601 bp, Human
ctatctctgatctttttcataactactttggctattctcagacatttatgtgaactttaaaataattttattaaattttaaaataaacaataatccattagggttggatcaaatttatatacttttcaaaaggattaatgtttttatgctagtaactaagaacattaagacaataatgttcttcattgtttaggacttgttttatgttattccataatttttttttgtacctttcttgttatatttatttctagctattttatgagttttggccctattgcagatgggatggttttctccrttgcctcttctaactggttactactaaaatagaaaaaaaaggagggggggaatgatttttaaatatttatcttataaacagccaaattatcttattcattctaaaaccttctttctaaaccagaacctcttgagtctttctaaatgtataatataatctgcaaataaagggaattatgtctctttttccgtcagtatacttttactttactttttattttgaaacaatttcaattttataaaaatttgcaaagataaaaatagtagtaggaacatccatgtcaccaacggttaatatatt

SEQ ID NO: 174051 - DNA, 601 bp, Human
gcctcttctaactggttactactaaaatagaaaaaaaaggagggggggaatgatttttaaatatttatcttataaacagccaaattatcttattcattctaaaaccttctttctaaaccagaacctcttgagtctttctaaatgtataatataatctgcaaataaagggaattatgtctctttttccgtcagtatacttttactttactttttattttgaaacaatttcaattttataaaaatttgcaaagataaaaatagtagtaggaacatccatgtcaccaacggttaatatattatytcatttgctctatcatttgctctccatgtgtgactgtgtgtgcataattttttcctgatttttttttttttttttttttttttttgagacggaatttcactcttgttgcccaggctggagtgcagtggcaaaatcttggctcactgcaacctccagctccccggttcaagcgattcttctgcctcagcctcccgagaagctgagattacaggcgccctctaccacgcctggctaatttttgtatttttagtagagacagggtttcaccattttgaccaggctggtctcgaacttctgacc

SEQ ID NO: 174052 - DNA, 601 bp, Human
taaattggaatgtagcattttttttttcactccagtataggatccagtctagggtcaggtattgcatttgtcatgtctgtctagcttcctataatctggaacattttcccacagcccttctttgacttcccacagcctttctttgacatttttgaagaatacagtcaccttcaaccaccacctttaaaaaaatagaacactcggccaggcgcggtggctcatgcctgtaatcccagcacttcaggacgccgaggcaggcaggtcaggagttcgagaccagcctgaccaacatggagaaacsccatctctactaaaaatacaaaacattagctgggtgtggtggcacatgcctgtaatcccagatacttgggaggctgaggtaggagaatcgcttgaacccaggaggcagaggttgcagtgagccaagatcgcaccattgcactccagcctgggcaacgagtgaaactctgtcttaaaaaaaaaagataaataaaaataaatagaacattctctgtttatgtttaattttcttttttctttttctggtcttactgtataaacaaaaacttccaaaacaatgttaggtaacaattataatata

SEQ ID NO: 174053 - DNA, 601 bp, Human
actcctgacctcaagcgatctgcccacctcagcctcctaaaatgctggggttaaaggtgtgagccactacacccagcctatgtagggttttttgaggatattctttttggagttaagaaatttcccttttatttcctgttttcaaagagtacttttgttcttttttgttttggttttaatcatggatgggtttttttgacttttttcaaaatgtttttaggtgttcatagtttttaatcttttaatttgttaataaggtgaattacatgaatagattttctcatattagactagccttacwtccctaaaataatcccaacttggtcttttaaaatttctgtttatgtgtatatgtttatcttcatttcttttctttactattttggcttataacttggtcttttttatacattgctagattgggttaatattttgttaggatttgtgcatccatgttcacgagtgagattgcctacaagtttcccataattattttattttggtatcaaggctataattgcctcataaaatgagttaaatacagtaccttctcttcctggctttgaagagcttaagtttcaaattatttattccttgactg

SEQ ID NO: 174054 - DNA, 601 bp, Human
agtcctcactccagtcctccctctcccagcccctgagcaccaactaatctactttctgtctttatggaattgcctattctggacattttctattaatagaactgtgtaatatgtggcctgctgtgcctgacttttttcacttagcataatattttcaaggttcattcatgttgcggcatctatcagtgcttcttttttttaatgaattggcatatttgtttatttctcaattcgtgaaaatgtccttaatttgttgatgtagcaaacaaatttcaactctgctaggcaaaaaaacaaatcygctttgcagtgaacttcatataattcaactgcatacaggcaacacactatatatgaaaaaagttactaactgaattatgggtattaactactgaaaagagttaacagtttattataattttttttttcacaatctaggaagctggcagccagcagcagttctaacacaatttcgggtgctattgggaattcgggaatcttggtggagctgttactgtagtgaaacttgttcgcaaaatacaagcatacttttactagcacatgtgaaggaatctctctaaaattgacctcattggttttg

SEQ ID NO: 174055 - DNA, 601 bp, Human
ttaactactgaaaagagttaacagtttattataattttttttttcacaatctaggaagctggcagccagcagcagttctaacacaatttcgggtgctattgggaattcgggaatcttggtggagctgttactgtagtgaaacttgttcgcaaaatacaagcatacttttactagcacatgtgaaggaatctctctaaaattgacctcattggttttgttctcagcaaactgatctgggccattcaacatagtttttattgtgcctggtgttgatgcctgttctctttttacaatacattcrtgaccattggatgatatcaatttgacatacatggcatcagggacttcatagccaccataggttttctcctctccatccattttgttcttatgaaatcctcctttgcttcccaaggaacttgagaagtttttcattagccccacagccaccatagccgggtccccatgtactgccatagccccattccagggctgccccctgacccggctgcctgcccccatgggttccagggcagtcccttcctttttaatgctgaatgatattctattgtatgaatacatcatattttgtttatccatt

SEQ ID NO: 174056 - DNA, 601 bp, Human
gccattcaacatagtttttattgtgcctggtgttgatgcctgttctctttttacaatacattcatgaccattggatgatatcaatttgacatacatggcatcagggacttcatagccaccataggttttctcctctccatccattttgttcttatgaaatcctcctttgcttcccaaggaacttgagaagtttttcattagccccacagccaccatagccgggtccccatgtactgccatagccccattccagggctgccccctgacccggctgcctgcccccatgggttccagggcagtsccttcctttttaatgctgaatgatattctattgtatgaatacatcatattttgtttatccattcatcagttgatggacattgagttattttcacttttggctattatgaatattgccagactgctttccaaagtggctgcactattttctattcctcccagcactgtatgagcattcaaatttcttcacatcctcaacacttgttattattattttattttatttttttgagacggagtctttctctgttggccaggctggagtacagttgcatgatcttggctcactgcaacctctgcc

SEQ ID NO: 174057 - DNA, 601 bp, Human
cctttttaatgctgaatgatattctattgtatgaatacatcatattttgtttatccattcatcagttgatggacattgagttattttcacttttggctattatgaatattgccagactgctttccaaagtggctgcactattttctattcctcccagcactgtatgagcattcaaatttcttcacatcctcaacacttgttattattattttattttatttttttgagacggagtctttctctgttggccaggctggagtacagttgcatgatcttggctcactgcaacctctgccttccyggctcaagggattctcctgcctcagcctcccaagcaggtgcccgccaccatgcctgactaatttttgtatttttgtagagacagggtttcaccatgttccccaggctgatctcaaactccttatgtgatccacatgcctcagcctcccaaagtgctgggattacaggcatgaaccaccttgcctggcctatcttttttattatagccatcctagagtgtgtgaagtggcatctatctcattgtggttttgattttcgtttccctaataactattgatgttgagtatcttatcttgtggct

SEQ ID NO: 174058 - DNA, 601 bp, Human
ttcatcagttgatggacattgagttattttcacttttggctattatgaatattgccagactgctttccaaagtggctgcactattttctattcctcccagcactgtatgagcattcaaatttcttcacatcctcaacacttgttattattattttattttatttttttgagacggagtctttctctgttggccaggctggagtacagttgcatgatcttggctcactgcaacctctgccttcctggctcaagggattctcctgcctcagcctcccaagcaggtgcccgccaccatgcctgrctaatttttgtatttttgtagagacagggtttcaccatgttccccaggctgatctcaaactccttatgtgatccacatgcctcagcctcccaaagtgctgggattacaggcatgaaccaccttgcctggcctatcttttttattatagccatcctagagtgtgtgaagtggcatctatctcattgtggttttgattttcgtttccctaataactattgatgttgagtatcttatcttgtggctattggccatttgtatgtcgtctttgtagaaatgttttttcaaatcctttgatcaaat

SEQ ID NO: 174059 - DNA, 601 bp, Human
cactattttctattcctcccagcactgtatgagcattcaaatttcttcacatcctcaacacttgttattattattttattttatttttttgagacggagtctttctctgttggccaggctggagtacagttgcatgatcttggctcactgcaacctctgccttcctggctcaagggattctcctgcctcagcctcccaagcaggtgcccgccaccatgcctgactaatttttgtatttttgtagagacagggtttcaccatgttccccaggctgatctcaaactccttatgtgatccacaygcctcagcctcccaaagtgctgggattacaggcatgaaccaccttgcctggcctatcttttttattatagccatcctagagtgtgtgaagtggcatctatctcattgtggttttgattttcgtttccctaataactattgatgttgagtatcttatcttgtggctattggccatttgtatgtcgtctttgtagaaatgttttttcaaatcctttgatcaaatccttttgattattatggtttaaaagttcttcttcttttttttttttttttttggatggagtctcactctatcacccag

SEQ ID NO: 174060 - DNA, 601 bp, Human; identical to SEQ ID NO: 22973

SEQ ID NO: 174061 - DNA, 601 bp, Human; identical to SEQ ID NO: 22974

SEQ ID NO: 174062 - DNA, 601 bp, Human; identical to SEQ ID NO: 22975

SEQ ID NO: 174063 - DNA, 601 bp, Human; identical to SEQ ID NO: 22976

SEQ ID NO: 174064 - DNA, 601 bp, Human
agcgtcactgtgagaagggatgtaggcaagctcccaggtgtctcctggcggagggaaggtgaagaacagaggcagctcctggatggactggcccgggtagatggtggcgttgggcacattttccgactgaatcttcaagcggagccagatgaggatcccagaaaacagcaatggcaggaagagttccaggaccgtcaccaggaccttccgcttctggaagagatacaatagggcacggtgatgggctgcaaggcagaagcaggggcatgcagacagcccttccctcaagggcatccccagragcctctgggctaggcacgcagctgacctccctccagagtctggacgcacctgcagggtgtagttcttccagaggaggagcgccagctgcctgagcacagccatcgtcttgctgaaagggacgcccagtgctagttacagaccaaagacagagagtgtgggtgcgcaatagaaacacgcagagtggggatttggggaaaagccatggaccctttttcctccatgtctctcaccttcttttgtgccactttaactccaaacacccctggagggaagggtacaaggcctgtgccatgcccac

SEQ ID NO: 174065 - DNA, 601 bp, Human
ccaccccacaacaggccccagtgtgtgatgttccccttcctgtgctgggaaaactggctagccatatgtagaaagctgaaaccagatcccttccatacaccttatacaaaaattaattcgagatggattaaagacttcaatgttaggcctgaaaccataaaaaccctagaagaaaacctaggcattaccattcaggacataggcatgggcaaggacttcatgactaaaacaccaaaagcaatggcaacaaaagccaaaattgacaaatgggatctaattaaactcaagagcttctgcacarcaaaggaaactaccatcagagtgaacagggaacctacagaatgggagaaaatttttgcaatctactcatctgacaaagggctaatatccagaatctacaatgaactcaaataaatttacaagaaaaaaccaaacaaccccatcaaaaagtgggcaaaggatatgaacaaacacttctcaaaagaagacatttatgcagccaaaagacacatgaaaaaatgctcatcatcactggccatcagagaaatgcaaatcaaaaccacagtgagataccatctcataccagttagaatggcaatca

SEQ ID NO: 174066 - DNA, 601 bp, Human
tgctgcacccatttactcgtcatttaacattaggtatatctcctaatgctatccctccccccgcccccccaccccacaacaggccccagtgtgtgatgttccccttcctgtgctgggaaaactggctagccatatgtagaaagctgaaaccagatcccttccatacaccttatacaaaaattaattcgagatggattaaagacttcaatgttaggcctgaaaccataaaaaccctagaagaaaacctaggcattaccattcaggacataggcatgggcaaggacttcatgactaaaacacsaaaagcaatggcaacaaaagccaaaattgacaaatgggatctaattaaactcaagagcttctgcacagcaaaggaaactaccatcagagtgaacagggaacctacagaatgggagaaaatttttgcaatctactcatctgacaaagggctaatatccagaatctacaatgaactcaaataaatttacaagaaaaaaccaaacaaccccatcaaaaagtgggcaaaggatatgaacaaacacttctcaaaagaagacatttatgcagccaaaagacacatgaaaaaatgctcatcatcact

SEQ ID NO: 174067 - DNA, 601 bp, Human
tgaacctgggacacagcggttgcagtgagccgaggtcgcgccactgcactccagcttggcgacagagcaagattctgtctgaaaaaaaaaaaaaagaaaaaaagctgaaatacaaatgtttcattcaagagcacgtcttccaggatatagagaaagggcctttgctatcttcaaggattattttagtctttcagaaaccagttatactggatgttttacttttcctataaacaagagtaaatgttcctgaaaagtatttctttctttttttttttaattatactttaagttttagggtacrtgtgcacaatgtgcaggttagttacataggtatacatgtgccatgctggtgtgctgcacccatttactcgtcatttaacattaggtatatctcctaatgctatccctccccccgcccccccaccccacaacaggccccagtgtgtgatgttccccttcctgtgctgggaaaactggctagccatatgtagaaagctgaaaccagatcccttccatacaccttatacaaaaattaattcgagatggattaaagacttcaatgttaggcctgaaaccataaaaaccctagaagaaaacctag

SEQ ID NO: 174068 - DNA, 601 bp, Human
agcctctgggttatttccatgcagatggcccttggccccttggcaaccccactctgccccatgactggggctcacctttgctgaagaaggtgctgaccatgaagctgaaggagatggtagagatggcgaagcacagcaggaaggcgagcaccagggaggggtcgctgcgggacagcacggctacatttggcttcacctgcagggcacaggcatgagtcgggcgtggtgggccggcagaggtggaccaggaggactcctgaccatccctggtcacagggacgcggctccaccgagaggagtkggacattgacagctcctctcccccatgagggacagactctctctgaagtctctgaccacaaagttcttcccaagagggccctcctggggtgccctggctctccccgtcctcaccagagccccaccgacgccatgctcaccttgacacagaagagcagggtcatgaaggaggcggcgatgaggaggaagaggaagaacaagaggaaccaggcactccagtgcagccagctgctgagccccatcatgcgcatgtactcctggggagagaagccatcacgctgctgggggcccgtcactgccc

SEQ ID NO: 174069 - DNA, 601 bp, Human
gccactctcccttccgatcacagcctctgggttatttccatgcagatggcccttggccccttggcaaccccactctgccccatgactggggctcacctttgctgaagaaggtgctgaccatgaagctgaaggagatggtagagatggcgaagcacagcaggaaggcgagcaccagggaggggtcgctgcgggacagcacggctacatttggcttcacctgcagggcacaggcatgagtcgggcgtggtgggccggcagaggtggaccaggaggactcctgaccatccctggtcacagggaygcggctccaccgagaggagtgggacattgacagctcctctcccccatgagggacagactctctctgaagtctctgaccacaaagttcttcccaagagggccctcctggggtgccctggctctccccgtcctcaccagagccccaccgacgccatgctcaccttgacacagaagagcagggtcatgaaggaggcggcgatgaggaggaagaggaagaacaagaggaaccaggcactccagtgcagccagctgctgagccccatcatgcgcatgtactcctggggagagaagccatcacgct

SEQ ID NO: 174070 - DNA, 601 bp, Human
tcattgaaattcgaaccgaagacacatgagccctcagatcgaaatgttcataaagaaaaatcacacctagacttttggcagactcccactaacgatgagtatcggatggcaataaggtaacattataaaattgccaaggaagaacacctatctgtggagaatttcacaggcagctaaaatactatacaggagtgagggcaaaatacagacacctttggacatacaaagtcgaaagcactgaccacttaccaatgcccactagaagaactactcaaagatgtgcttcaacacagagaagagtgactctaaaaagccaggtacacgaaaatcacgtgcacatcagatatgttggcaaagcacaggaatgtcacataggaagtaactgcttatgattttttttctttttttgagacagggtccctctcgttctccaggctggaatgcagtggtacaaactcagctcactgcaacatccgccacctgggcttaagcaatgctcccacctcagcctcccaagtagctaggaccacaggggcatgccaccacacctggctaatttttaaacttttttttttttttttttttttttgtagagacaggg

SEQ ID NO: 174071 - DNA, 601 bp, Human
gactataaaaaacaatcaatcagaaaacaacaggtgttcacgaggatgcaggagactggcaacctgtgtgctgctggtgggaatgcgcagcggtgcagacactgcgggaaagacagtctgacagtctctctcaaaagttaaacatggaattgccataggattcagcaacttcacttctgggtgtacgcccaaagaatgaaaagcagggacccatgtccagcacagcacactcatgacagccacaacacaggggcatccaagagtctgtcaatggatgaacaagtaaacaaaatgtggccccatctacattatggaatatcatctagccttgaaaaggaggggaattcaggctacaacacagatgaaccttggggatgctatgctcagtgaaataagccaggcacagcatataaacactgtacgattcctcttacatgaagtccccagggtcatcaaactcatagggacaggaagtagggtgctggtttccagggaaggggggtgggggagtcagtgtttcacagggactgtttcagtcgggaaacatgaaaaccattctggaggtggacatgggggtgggtgcacaacgatgtgaatgctt

SEQ ID NO: 174072 - DNA, 601 bp, Human
tgggtatggtggcgggcgcctgtaatcccagctacttgggaggctgaggcaggagaatcacttgaacccagaaggcggaggttgcagtgagccaattgtgccactacacttagcctgggcaacagagcgagattccatctcaaaaaaaaaaaaaaagtaattaacagacgtgaaagactgagagataccccctcacacccattaggatggcgactataaaaaacaatcaatcagaaaacaacaggtgttcacgaggatgcaggagactggcaacctgtgtgctgctggtgggaatgcgcascggtgcagacactgcgggaaagacagtctgacagtctctctcaaaagttaaacatggaattgccataggattcagcaacttcacttctgggtgtacgcccaaagaatgaaaagcagggacccatgtccagcacagcacactcatgacagccacaacacaggggcatccaagagtctgtcaatggatgaacaagtaaacaaaatgtggccccatctacattatggaatatcatctagccttgaaaaggaggggaattcaggctacaacacagatgaaccttggggatgctatgctcagtga

SEQ ID NO: 174073 - DNA, 601 bp, Human
aaaaaaagaaattaagaggccaggcgtggtggctcatgcctgtaatcccagcactctgggagacggaggtgggaggatcacttgaggtcaggagtttgagaccagcctggacaacatggcaaaacacggtttctacaaaaatagctgggtatggtggcgggcgcctgtaatcccagctacttgggaggctgaggcaggagaatcacttgaacccagaaggcggaggttgcagtgagccaattgtgccactacacttagcctgggcaacagagcgagattccatctcaaaaaaaaaaaaaaagtaattaacagacgtgaaagactgagagataccccctcacacccattaggatggcgactataaaaaacaatcaatcagaaaacaacaggtgttcacgaggatgcaggagactggcaacctgtgtgctgctggtgggaatgcgcagcggtgcagacactgcgggaaagacagtctgacagtctctctcaaaagttaaacatggaattgccataggattcagcaacttcacttctgggtgtacgcccaaagaatgaaaagcagggacccatgtccagcacagcacactcatgacagccacaa

SEQ ID NO: 174074 - DNA, 601 bp, Human
gaattgcttgaacccaggcagcagagtttgcagtgagccaagattgtgccactacactccagcctaggcaacagagtgagactctgtcacaaaaaaaaaaaaaaaaaaaagaagaaagggggttgtaaaagtatagtttaaaaaaaaaaagaaattaagaggccaggcgtggtggctcatgcctgtaatcccagcactctgggagacggaggtgggaggatcacttgaggtcaggagtttgagaccagcctggacaacatggcaaaacacggtttctacaaaaatagctgggtatggtggygggcgcctgtaatcccagctacttgggaggctgaggcaggagaatcacttgaacccagaaggcggaggttgcagtgagccaattgtgccactacacttagcctgggcaacagagcgagattccatctcaaaaaaaaaaaaaaagtaattaacagacgtgaaagactgagagataccccctcacacccattaggatggcgactataaaaaacaatcaatcagaaaacaacaggtgttcacgaggatgcaggagactggcaacctgtgtgctgctggtgggaatgcgcagcggtgcagacac

SEQ ID NO: 174075 - DNA, 601 bp, Human
gtgtcactataagaccatctggggccaggtgtggtagctcacgcctataatcccagcactttgggaggctgaggctggtggatcacctgaggtcaggagttcaagaccagcctggccaacatggtgaaaccccgtttctactaaaaatacaaaattagctgggcatgctggcttgcacctgtagtgccagctactcagaggctgaggcaggagaattgcttgaacccaggcagcagagtttgcagtgagccaagattgtgccactacactccagcctaggcaacagagtgagactctgtcmcaaaaaaaaaaaaaaaaaaaagaagaaagggggttgtaaaagtatagtttaaaaaaaaaaagaaattaagaggccaggcgtggtggctcatgcctgtaatcccagcactctgggagacggaggtgggaggatcacttgaggtcaggagtttgagaccagcctggacaacatggcaaaacacggtttctacaaaaatagctgggtatggtggcgggcgcctgtaatcccagctacttgggaggctgaggcaggagaatcacttgaacccagaaggcggaggttgcagtgagccaattgtgc

SEQ ID NO: 174076 - DNA, 601 bp, Human
actttttgcgctctgttacattaacatccattggtttatcctgcagtttggattttttttttaatttttggagagagagtctcgctctgtcgcccaggctggagtgcagtggcacgatcttggctcaatgcaacctccgactcccaggttcaagcaattccctgcctcagcctcctgagtagatgggattacaggcatccgccaccatgcccgactaatttttgtatttttaatagagacggggtttcaccatcttggccaggctgctcttgaactcctgacctcgtgatccacccacctyggcctcccaaagtgctgggattacaggtgtgagccactgtgcccggcctaattttttgtatttttagtagagacagggtttcaccatgttgtccaggctggtcttgaactcctgagttcaggcaatccgcccgcctcagtctcccaaaatgctgggattacaggcatgagccactgcgcctggccacactttggatttttactcttgtatgattttataacatgatgcattagttcgtttggaaaatactgctttttgagttacacaaatgttccaaacactggcatattttatcataca

SEQ ID NO: 174077 - DNA, 601 bp, Human
ggatgggagaagaggctcccgacggccgggaaggcttcgaggaggtgacatgtgagaaggagccggaagaggtgagagagtggattacggagagtggagagatgggcatgttttctgtccatgccagcagtgctcaaactgtttggttttcttttctttgtttccttttgagatcgagtccccctctgtcacctaggctggagtacagtggtgccatcatggctcactgcagcctccacctcccgggcccaagaagtcctcccacctccggctagggagagcagctaggaccacaggcacrcagtaccatgcctagctaatttttaaatgtttttgtagagatgggtttccctattttgtcagggctagtctaaagctcctaggctcaagggatcctcccgccctggcctcccaaagtgttgggattacaggtctgagccaccgtgcccagccatcaaaatctttggtcttaagacccttttctatccttaaaaattattaacgacaccaaagggctttttaaatgtgggttatatatatatatccatatttattctgtgagaaattaatactaagaacatttaaaaattctgttaaattt

SEQ ID NO: 174078 - DNA, 601 bp, Human
caaatttcccaatgagctgggctcccattgccatggcgacattagacaggaggcaggagcagagcttctggctcagagtcatccagttgtaccgaggggccacgaagaagtaggggatgtaggtgaagaagtagaggaagcctccgaaggctgctgccatgttggctgcaggtgttggaagacccggggggcgtgagcgtcagtgccctcaaaaggggcttgggctccccgaggtacaggcaaccccctactcctggggccgagccacccaacctgctcctggcacttgccatctacacgrgacacaagctccagcacggggggacaccaggtgtggccggcagccccttctccaagtgagtagtgcccccatcccagggacccccacaccaacacctccagcccctcctccacctcccatccagctgcctccctgacactgcacacctcacgtggctgatcccaaacccctgattcccgcctaagccccacttcttttttttttgagaaggagtcttgctctgtcgcccaggctggagtgcagtggcacgatctcggctcactgcaagctccgcctcctgggttcacgccattctcctac

SEQ ID NO: 174079 - DNA, 601 bp, Human
ttgaggtcaaaagtttgagaccaggctgggcaacacagtgagaccccatctctataaaatatttaaaataaaaaaaaatgaaaactgaaagaggctcaggtcaccgacttagatcccaccatcagtcagatgcgtatgtggtgccaacgctgctggatgctccaaccctcttgtcctccgagctttggcttcttcggcccactgccctgtggctcccatcacctcctgctgtgccgtggagctgggcttccctcgcccggggccgtgtccagctatccagcccacactcagcgctgtatgyggatgctgctgccttcagtggtcccaactgcctgccaaccgtcccaggtggagccttgctgctggcggctcttgtggttgggtgctctcgaaggttactgattcggaaagaacaggctggacaaggcaaacactcacctttcgcctcaaatttcccaatgagctgggctcccattgccatggcgacattagacaggaggcaggagcagagcttctggctcagagtcatccagttgtaccgaggggccacgaagaagtaggggatgtaggtgaagaagtagaggaagcctccgaaggctgc

SEQ ID NO: 174080 - DNA, 601 bp, Human
cctcagcctctcgagtagctgggactacaggcgcctgccaccacgcccggctaattttttgtgtttttagtagagacagggtttcaccttgttagccaggatggtctcgatctcctgacctcgtgatccaccggcctcagcctcccaaagtgctgggattataggcgtgagccaccacgcccagcctttctgatgtaataattttgaatgtctcaggaagctggaagaggccagatgtggtggctcacgcctgtaatcctggctattcaggaggctgaggcaggaggattgcttgaggtcraaagtttgagaccaggctgggcaacacagtgagaccccatctctataaaatatttaaaataaaaaaaaatgaaaactgaaagaggctcaggtcaccgacttagatcccaccatcagtcagatgcgtatgtggtgccaacgctgctggatgctccaaccctcttgtcctccgagctttggcttcttcggcccactgccctgtggctcccatcacctcctgctgtgccgtggagctgggcttccctcgcccggggccgtgtccagctatccagcccacactcagcgctgtatgtggatgctg

SEQ ID NO: 174081 - DNA, 601 bp, Human
actttaggtcaggagttcaagaccagcctggccaacatggcaaaaccccctctctactaaaaatacaaaaaaattagatgggcatggtggtgcatgcctgtgatcccaggtactcgggaggctgaggtgggaggatcacttgaacccagaggcagaggttgagatgagccaagatcgcaccactgcactcaaacctgggaaacagaacgagactcttgtctcaaaaaaaaagaaaaaaagtcctcaaaaccctagactttgagatctctgatgtaataattttattttatttttttgagayggagtcttgtcacccaggctggagtgcagtggtgcgatctcagctcactgcaagctccgcctcctgggttcacgccattctcctgcctcagcctctcgagtagctgggactacaggcgcctgccaccacgcccggctaattttttgtgtttttagtagagacagggtttcaccttgttagccaggatggtctcgatctcctgacctcgtgatccaccggcctcagcctcccaaagtgctgggattataggcgtgagccaccacgcccagcctttctgatgtaataattttgaatgtctca

SEQ ID NO: 174082 - DNA, 601 bp, Human
tttgggaggccgaggcgggcggatcacaaggtcagaagatcgagaccatcctagctaacacagtgaaaccccgtctctactaaaaatacaaaaaattagctgggcacggtggcgggcgcctgtagtcccagctacttgggaggctgaggcaggaaaatggcatgaacccgggaggcggagcttgcagtgagccgagattgcgccactgccctccagcctgggtgaaagagtgagagactccgtctcaaaaaaaaaaaaaaaaaaaaaaggaaaagaaaagaaaaaaagtgagtcgtgatgrtgccattgcactccaggctgggtgacacagcgagatcctgtctcaaaaaacaaaaaagaaaagaaaaaaaatgctgtcgtttatcacttgtttctctcttaggcgtctctgctgccatcaccaatcaatacaggaggcactgggaagatgctaattctaccctttaccaagagcagtggttgatgaaaagtcctcgaaacccagccagcctcagtggctcactcctgtaatcctagcactttcggaggccgagggcagatcactttaggtcaggagttcaagaccagcctggccaacatg

SEQ ID NO: 174083 - DNA, 601 bp, Human
aagtgggcggctcacgcctgtaatcccagcactttgggaggccgaggcgggcggatcacaaggtcagaagatcgagaccatcctagctaacacagtgaaaccccgtctctactaaaaatacaaaaaattagctgggcacggtggcgggcgcctgtagtcccagctacttgggaggctgaggcaggaaaatggcatgaacccgggaggcggagcttgcagtgagccgagattgcgccactgccctccagcctgggtgaaagagtgagagactccgtctcaaaaaaaaaaaaaaaaaaaaaargaaaagaaaagaaaaaaagtgagtcgtgatggtgccattgcactccaggctgggtgacacagcgagatcctgtctcaaaaaacaaaaaagaaaagaaaaaaaatgctgtcgtttatcacttgtttctctcttaggcgtctctgctgccatcaccaatcaatacaggaggcactgggaagatgctaattctaccctttaccaagagcagtggttgatgaaaagtcctcgaaacccagccagcctcagtggctcactcctgtaatcctagcactttcggaggccgagggcagatcactttag

SEQ ID NO: 174084 - DNA, 601 bp, Human
acatggaaacacagatatgtaaaagctaaagtgtcagaagacactgccgactgtagagaaccgttctaatgaaagacaaagcaacgctggacactcccacctccttccacagacccagaccttggcaagctgcagctaggaactgcatggtgccacggcttgactgggccccccaaattcatgtgttggagacttgacccccaatgcagcaatgttgggaggaggcctaactggaggggctcagaccaggtttggtgcccacagcaggctttgcagaatgagagcccacaggccaaaggcygaccaaggaagtgttttactcaatttaatttcataaaaattaagaaaaaaagtgggcggctcacgcctgtaatcccagcactttgggaggccgaggcgggcggatcacaaggtcagaagatcgagaccatcctagctaacacagtgaaaccccgtctctactaaaaatacaaaaaattagctgggcacggtggcgggcgcctgtagtcccagctacttgggaggctgaggcaggaaaatggcatgaacccgggaggcggagcttgcagtgagccgagattgcgccactgccctccagcct

SEQ ID NO: 174085 - DNA, 601 bp, Human
gagcctgggaggtcgaggctacagtgagctattatcatgctactgcactccagcctgggcaatggagtaagaccctatctccaaaaaaaaattgttaaaaagaaagcaaaagaacaaagtttacattttatcaacacacgagtaaacatggaaacacagatatgtaaaagctaaagtgtcagaagacactgccgactgtagagaaccgttctaatgaaagacaaagcaacgctggacactcccacctccttccacagacccagaccttggcaagctgcagctaggaactgcatggtgccayggcttgactgggccccccaaattcatgtgttggagacttgacccccaatgcagcaatgttgggaggaggcctaactggaggggctcagaccaggtttggtgcccacagcaggctttgcagaatgagagcccacaggccaaaggctgaccaaggaagtgttttactcaatttaatttcataaaaattaagaaaaaaagtgggcggctcacgcctgtaatcccagcactttgggaggccgaggcgggcggatcacaaggtcagaagatcgagaccatcctagctaacacagtgaaaccccgt

SEQ ID NO: 174086 - DNA, 601 bp, Human
cacacgtgtgcacatttgaccttgcatggccactgcttggttggcatgccttttcccttcccggttttataacaagttggacagctttcttcaagcctggaagataaactcaggttacaaaataattaagtcacagaccagcaacagctcattcactgactagacaggcttgcatttaatctgtgacatatatgcacatatgtacacacgtacatatgcacccacatctatgatttcggtaaggccaacgtgggtcaatgtgcatttagcataagtcttttttttttttttttttttttttgagatggagtcttgctctgtcgcccaggcaggagtgcagtgctgcgatctcggctcactgcaacctctgcctcccaggttcaagcaattctcctgtctcagccttccaagtagttgggattacaggcgcatgctgccatgcctgggctaaattttttttttttttttttgagatggagtcttgctctgtctcccaggctggagtgcagtggcacgatctcggctcactgcaagctccacctcccgggttcacgccattctcctgcctcagcctcctgagtagctgggactacaggcgccc

SEQ ID NO: 174087 - DNA, 601 bp, Human
tggaggtggtggctcacgcctgtcatcccagcactttgggaggccgaggcgggtggatcacctgaggtcaggagttcaagaccagcctggccaacatggcgaaaccccgtctctaataaaaatacaaaaaaaattaggtgcgtgtggtggtgggtgcctgtaatcccagctactcaggaggctgaggcaggagaatcacttgaacctgggaggtgaagggtgcagtgagctgagatcgcgccactggactccagcctgggcaacagagctagactccgaatcaaagaaaaaaaaaaaaaaagaaatgaccttaactagccatcggtagggaatcagttaagtatatgttgatgggcccacagaatggaacactgtgtgtcactataaatgaaggtggtttgttgggagcaagccccccaaagtctggccataaactggccccaaaactggccataaataaaatctctgcagcaatgtaacacgtccataatggccataacacccaagctggaaggttgtgggcaaggaacacctggcccgcccagggcggaaaaccgcttaaaggcattcttaagccgcaaacaaaagcctgagagatctg

SEQ ID NO: 174088 - DNA, 601 bp, Human
gccatagtgtaagtgtggcatttttctttcttagtgatagacaaagtaaccattacctctaacggtcagtgtcatcttacagttgatggattacagtagtgaacacttgataactacttgtggaagcaaagaatgaaaacagaaatggcctcggctggaggtggtggctcacgcctgtcatcccagcactttgggaggccgaggcgggtggatcacctgaggtcaggagttcaagaccagcctggccaacatggcgaaaccccgtctctaataaaaatacaaaaaaaattaggtgcgtgtrgtggtgggtgcctgtaatcccagctactcaggaggctgaggcaggagaatcacttgaacctgggaggtgaagggtgcagtgagctgagatcgcgccactggactccagcctgggcaacagagctagactccgaatcaaagaaaaaaaaaaaaaaagaaatgaccttaactagccatcggtagggaatcagttaagtatatgttgatgggcccacagaatggaacactgtgtgtcactataaatgaaggtggtttgttgggagcaagccccccaaagtctggccataaactggccccaaaa

SEQ ID NO: 174089 - DNA, 601 bp, Human
attttaaaatcagaatgcatcttggctgggcacggtggctcgagcctgtaatcccagcactttgggaggccgaggcgggtgaatcacgaggtcaggagatcgagaccatcctggctaacacggtgaaaccccgtctctactaaaaatacaaaaaaattagccgggcatggtggtgggcgcctatagtcccagctactcgggaggctgaggcaggagaatggcgtgaacccgggaggcggagcttgcagtgagccgagatggcgacactgcactccagcctgggcgacagagcgagactccrtctcaaaaaaaaaaaaaaaatcagaatgcatcttaaactataaaatgccatagtgtaagtgtggcatttttctttcttagtgatagacaaagtaaccattacctctaacggtcagtgtcatcttacagttgatggattacagtagtgaacacttgataactacttgtggaagcaaagaatgaaaacagaaatggcctcggctggaggtggtggctcacgcctgtcatcccagcactttgggaggccgaggcgggtggatcacctgaggtcaggagttcaagaccagcctggccaacatgg

SEQ ID NO: 174090 - DNA, 601 bp, Human
ctgcactccactggttctcagggacacagctctcatatgtaaagtgattttaaaatcagaatgcatcttggctgggcacggtggctcgagcctgtaatcccagcactttgggaggccgaggcgggtgaatcacgaggtcaggagatcgagaccatcctggctaacacggtgaaaccccgtctctactaaaaatacaaaaaaattagccgggcatggtggtgggcgcctatagtcccagctactcgggaggctgaggcaggagaatggcgtgaacccgggaggcggagcttgcagtgagccragatggcgacactgcactccagcctgggcgacagagcgagactccgtctcaaaaaaaaaaaaaaaatcagaatgcatcttaaactataaaatgccatagtgtaagtgtggcatttttctttcttagtgatagacaaagtaaccattacctctaacggtcagtgtcatcttacagttgatggattacagtagtgaacacttgataactacttgtggaagcaaagaatgaaaacagaaatggcctcggctggaggtggtggctcacgcctgtcatcccagcactttgggaggccgaggcggg

SEQ ID NO: 174091 - DNA, 601 bp, Human
cctcgaggacagcctggtgcctacatggaggcagtcgacacagtggtgcgggcagagcagcagggaaggtggaagcagtgccttggcaggatcagtgccagggcagctgcggggcggggactcgtttacccgcagctccacgcccagtgcacttccagcacctggaacggcatctggcacacactgcactccactggttctcagggacacagctctcatatgtaaagtgattttaaaatcagaatgcatcttggctgggcacggtggctcgagcctgtaatcccagcactttgggaggccraggcgggtgaatcacgaggtcaggagatcgagaccatcctggctaacacggtgaaaccccgtctctactaaaaatacaaaaaaattagccgggcatggtggtgggcgcctatagtcccagctactcgggaggctgaggcaggagaatggcgtgaacccgggaggcggagcttgcagtgagccgagatggcgacactgcactccagcctgggcgacagagcgagactccgtctcaaaaaaaaaaaaaaaatcagaatgcatcttaaactataaaatgccatagtgtaagtgtggcattttt

SEQ ID NO: 174092 - DNA, 601 bp, Human
cacacagccatgcagcctctgtcccaggacttcgaggcactgctgtggagaaggcgctactcagggagagccccagagagtcccaacttgtttcatccctgtgaaggctctaagcctcagtttcctaacctggtaagtgggtgtaatggttacatacaggcttgtgaagatgaactcagatccgatacagggcaaagggagtttgtcagctatgaaatttcatagacagaagttatctaacgctccagtccagagggatgttggagccaaaatggaaagaaagctgtgtccccatgccacycggctgtttctttgctcaagccccacatgagttcatgactgtaagcaagagaagccgaaggcgccacgcctccctctactatgaggaagcctcttcccatcttctctgtggccatcacagaaataactcagtgcatggggtaagaacacaggcacacacctcacacagtgccctcgaggacagcctggtgcctacatggaggcagtcgacacagtggtgcgggcagagcagcagggaaggtggaagcagtgccttggcaggatcagtgccagggcagctgcggggcggggactcgtttac

SEQ ID NO: 174093 - DNA, 601 bp, Human
atgtcctgggaaatttcatacccgctgatgtatgcccgtccactggtcgggggaaagagacctggggcccagcaggagaccccacattcagcatgaagatcctgctcgtcagcacccgcggtaatgaccccccaccccctctctgtctcccctaatttcctctgaggaccctgcccatgagagggcacggaaccccactcccactggggtgggctttggctgggccagtgggaaaaagaagcggcatggaaacagccctgccactgggacgcacagctggtcagggaggagaaacccacgrcacacacacacagagtcaccacaatcagcccccgccccgggtcccagcctgtgccactgccagacactttggtgcttggggaagacagagtgaaatgccagtggccggtgtggtgcacaggggagagctctcagagaggggtttggtgacagaattagcatggggttgagctgctcctgcgtggtggcctctgttttcactgaccctgtcaagcttgggtattcacagacagaggcggtgaggagggcaggggtccctgggggtccccctgcattcatggacagaggcggtgaggagggc

SEQ ID NO: 174094 - DNA, 601 bp, Human
acccctgcacacccctggcccccaactcacctgggcgtagaaataaaggtgctctgcgactgtcaagttgtcaaacaggatgtcgtgctgcgggcacaggcccaggctcttccggatctgaaccatgtcctgggaaatttcatacccgctgatgtatgcccgtccactggtcgggggaaagagacctggggcccagcaggagaccccacattcagcatgaagatcctgctcgtcagcacccgcggtaatgaccccccaccccctctctgtctcccctaatttcctctgaggaccctgcccrtgagagggcacggaaccccactcccactggggtgggctttggctgggccagtgggaaaaagaagcggcatggaaacagccctgccactgggacgcacagctggtcagggaggagaaacccacgacacacacacacagagtcaccacaatcagcccccgccccgggtcccagcctgtgccactgccagacactttggtgcttggggaagacagagtgaaatgccagtggccggtgtggtgcacaggggagagctctcagagaggggtttggtgacagaattagcatggggttgagctgctc

SEQ ID NO: 174095 - DNA, 601 bp, Human
gttctggtgagaggaacctctccttgacgtagctggactcagaaccctggctcctgccctcctggctcccttcctccagtttagctcctcggaagactgccccagaaactcgagcacatcagtggaaacacccctgcacacccctggcccccaactcacctgggcgtagaaataaaggtgctctgcgactgtcaagttgtcaaacaggatgtcgtgctgcgggcacaggcccaggctcttccggatctgaaccatgtcctgggaaatttcatacccgctgatgtatgcccgtccactggtsgggggaaagagacctggggcccagcaggagaccccacattcagcatgaagatcctgctcgtcagcacccgcggtaatgaccccccaccccctctctgtctcccctaatttcctctgaggaccctgcccatgagagggcacggaaccccactcccactggggtgggctttggctgggccagtgggaaaaagaagcggcatggaaacagccctgccactgggacgcacagctggtcagggaggagaaacccacgacacacacacacagagtcaccacaatcagcccccgccccgggtcccag

SEQ ID NO: 174096 - DNA, 601 bp, Human
tgacaggcccttcagctgcaacgacaggggacgcagggagatgcagggctcctggcgggaggccgaccctggccagcgaggttctggtgagaggaacctctccttgacgtagctggggagatgcagggctcctggcgggaggccgaccacggccagcaaggttctggtgagaggaacctctccttgacgtagctggggagatgcagggctcctggcgggaggccgaccacggccagcgagtttctggtaagaggaacctctccttgacgtagctggggagatgcagggctcctggcgggasgccgaccctggccagcgaggttctggtgagaggaacctctccttgacgtagctggactcagaaccctggctcctgccctcctggctcccttcctccagtttagctcctcggaagactgccccagaaactcgagcacatcagtggaaacacccctgcacacccctggcccccaactcacctgggcgtagaaataaaggtgctctgcgactgtcaagttgtcaaacaggatgtcgtgctgcgggcacaggcccaggctcttccggatctgaaccatgtcctgggaaatttcatacccgctga

SEQ ID NO: 174097 - DNA, 601 bp, Human
atcatcagcagcgacggaccacgtgtgagggcttctgtcttgtggggttaacactgatggttatggtgtggttctaggaagggactgtcagcaggagcaggagcaagagctaccggctgcaagaccgcactgcacggcactatcagagatgcatctcacctctttcccaacgtcaccgtgcaggagatggaattccatgtccttttttttttttttgagacaagtctcactctgtcacccaggctggagtgcagctgcacaatcttggctcactgtaacttctccctccttggttcaagtrcttattctcctgcctcagcctccccaagtagctgggattacaggcatgcaccaccatacctggttaagtttttgtattttagtagagacagagttttaccatgttggccaggctggtcttgaactcctgacctcaagtgatctgcctgccttggcctcccaaagtgctgggattataggcggtgagccaccacgcctggccccatgtcctctttagagacaaggatgccaggcccaggaagaacaatggctctgccaactgggcagtggggcaggaagtggctagtgaaactctcagagg

SEQ ID NO: 174098 - DNA, 601 bp, Human
ttatccagataatatccagactgatagatagtgtcatggaacactggcttccctccccttgctggttctgccgtgtgtgtgagacagtgatgagcaggtggtaacatctccagctctgacactgagaccaaattcaccacccacatacaaatacagactcggtttcacgagtagttctgagtgcagccgcagcacgtgttgagcctggtgtcagaagggggagtgtgagccctgcatcagcgctgagcacccttttggtgagtcagatacgtgcttctccttttcaggtcctaattatgtytctccttgctaggaggcctggcacctaggacccagccaagcagattcatctgggctgatggtgcccaggctgagggtctaagagtgccgactggccaggccagagaggggcagagcaggtgcctctgagcacaaagccctcatggcccatggggatcccatcttggatgtatacctgtgcgtgccctccctgggaggcgtacctgtgcgtgctctctctgggaaggatgaaagacagctcggccccagcgctgctctccagcgtggcgttgggcacgtggtggtggaccagctgggagat

SEQ ID NO: 174099 - DNA, 601 bp, Human
tagagatggggtctcactatgtcgcccaagctgatctccttctccttctgccttggcttctgaaagtgttgggattacaggcatgagcaaccatgcctggctaaaagtgaggttcatatggtttgattccctggttttttctttctttttttttttttgagatggagtctccctctgtcacccaggctggaatccaggggtgcaggggtgcaggggtgtgatttcggctcactgcaacctctgctcctgggttcagtgattctcctgcctcagcctcctgagtagctgggattacaggcamccaccaccacgcccggctaatttttgtatttttttttttttttagtagagacgaggtttcaccgtgttggccaggatggtctcgatctcctgacctcatggtccgcccgccttggcctcccaaagtgttgggattacaggcgtgcgccactatgcacagctgcgaaacactttctaagaataaaattaatagaagaagtcacaagagaaaggatgttgctacattaagtacaaaatctaggccgggtgcagtggctcacacctggaatcccagaactttgggaggctgaggcggaaggat

SEQ ID NO: 174100 - DNA, 601 bp, Human
ccacccgcttcggcctccaagtgctgggattacaggtgtgagccaccgtgcctggccatgtggctaatttttaatttttttgtagagatggggtctcactatgtcgcccaagctgatctccttctccttctgccttggcttctgaaagtgttgggattacaggcatgagcaaccatgcctggctaaaagtgaggttcatatggtttgattccctggttttttctttctttttttttttttgagatggagtctccctctgtcacccaggctggaatccaggggtgcaggggtgcaggggtgygatttcggctcactgcaacctctgctcctgggttcagtgattctcctgcctcagcctcctgagtagctgggattacaggcaaccaccaccacgcccggctaatttttgtatttttttttttttttagtagagacgaggtttcaccgtgttggccaggatggtctcgatctcctgacctcatggtccgcccgccttggcctcccaaagtgttgggattacaggcgtgcgccactatgcacagctgcgaaacactttctaagaataaaattaatagaagaagtcacaagagaaaggatgttg

SEQ ID NO: 174101 - DNA, 601 bp, Human
atcctctcacctcagcctcccaagtgtctggggctacaggtgtgcacaactacacgtggctaagttttttttttttttttgagactgagtcttgctctgtcacccaggctggagtgcggtggcgcgatcttggctcactgcaagatctgcctcccggcttcatgccattctcttgcctcagcctcccgagtagctgggactacaggtgcccgccaccacgcccggctaattttgtttttgtatttttagtagagatggggtttcaccatgttagccaggatggtctcgatctcctgacctygtgatccacccgcttcggcctccaagtgctgggattacaggtgtgagccaccgtgcctggccatgtggctaatttttaatttttttgtagagatggggtctcactatgtcgcccaagctgatctccttctccttctgccttggcttctgaaagtgttgggattacaggcatgagcaaccatgcctggctaaaagtgaggttcatatggtttgattccctggttttttctttctttttttttttttgagatggagtctccctctgtcacccaggctggaatccaggggtgcaggggtgcag

SEQ ID NO: 174102 - DNA, 601 bp, Human
aggctggagtgcagtggtataatctcggctcactgaagccttgacctcccgggctcaagcaatcctctcacctcagcctcccaagtgtctggggctacaggtgtgcacaactacacgtggctaagttttttttttttttttgagactgagtcttgctctgtcacccaggctggagtgcggtggcgcgatcttggctcactgcaagatctgcctcccggcttcatgccattctcttgcctcagcctcccgagtagctgggactacaggtgcccgccaccacgcccggctaattttgtttttstatttttagtagagatggggtttcaccatgttagccaggatggtctcgatctcctgacctcgtgatccacccgcttcggcctccaagtgctgggattacaggtgtgagccaccgtgcctggccatgtggctaatttttaatttttttgtagagatggggtctcactatgtcgcccaagctgatctccttctccttctgccttggcttctgaaagtgttgggattacaggcatgagcaaccatgcctggctaaaagtgaggttcatatggtttgattccctggttttttctttcttttttt

SEQ ID NO: 174103 - DNA, 601 bp, Human
gcccatggtctgagctccggtgggcgcttaccagcctggctagctctccccaggtcctagacaaaccaggaaaagcttctgattatttttctcttgagaccaggagctcagagaggccagggtcaggtgtggggcctggagctgagtcacaggtgggccgtgtggtgagtatgagatggggccagagaggcctgagaccttgagagacaagaggccctgtggctgctgagacgcagcaggatcaacccgggttctaccctcagagccggctgactccaggccagcccgtggtttctttctsttatgttcatgcttccttccttccttcaaccaggattcacagaatcagtcagtcagtgctcggtcctgtgtgggacacaggtcagcgggcagtccctccctccctccgccgccttgcctggcctttttccctgggtctgttcctggacacatggtcccctgcacaggtgtccccagagcatgcaccaccatgtcctgcatgtatgatcacctattctgtcgcctcctctaggctgtgggctccctaaggaggaaaacctatctcacgtttttttctttttcttttgacacagggttttgc

SEQ ID NO: 174104 - DNA, 601 bp, Human
cccacccacctgggcactcaccccagtgttgagcttgacagcggtgcgctcctcctcgatgagggctccaatgccgtcggaggggtccatggccccacagaggttgctgtccacagcccagtcgctggcgcgcctctcgtgctggtactgcagggcagggagctggatggcctggatgtccatactgctgtccaccagcttcccgaccctgtgccgatacacacagggaccggtcaggacccagctccccgggtgggtggagggagggactatggttagaggcactgaggggagcagtgtygccgcagtccttggcttgctcatgcatctgcttatgtgtttcctcactcatcagtgtctccggccaccatgcacagctaatttttgtatttttagtagacatagggtttcaccatgttggccaggctgatctggaactcctgacctcaagtgatccacccaccttggcctctcaaagtgctgggattacaggcatgaaccaccaaggctggcagaggaggtgattttttaatattatgtgaattacatcacacacacacacacacacacacacacacacacacacacacacacacccctt

SEQ ID NO: 174105 - DNA, 601 bp, Human
acacagtggtcttacggggctaaactagcatccaggagacataaactatctgaggaaaaagaactgtgcgggactcatggagaaaaatcataaatctgctggggaatataaaataagatttttagacaattttttttttttttttgagacagagtctcactctgttgtccaggctggagtgcagtggcgcaatctcagctcactgcaaactctgcctcccaggttcaactgattctcctgcttcagcctcccgagtagcgcgccaccacgcccagctaatttttgtatttttagtagagayggagtttcactgtgttggccaggctggtctagaactcctgacctttggtgatccgtccaccttggcctcccaaagtgttgggattacaggcattagccaccatggctggcctgaaagtaagatttttgttttcagatttagagatggggtcttgctctgtcacccaggctgggatgcaatggtgtaatcataggtcactgcagcccggacctcccaggcttaagcctcctgtctcagcttccctagtagctaggattacaggtgtgtgccatcatgcctagctaatttttaaaactgttt

SEQ ID NO: 174106 - DNA, 601 bp, Human
tccattgaagcccagcaggccgaagcactcccctttctgcaccgcgagggagagcctgtccacggccaggaggggcacccgctgctcgtacacctgcaggcacccaacagaaaacacggaatgcggaggcctggacgcaaagcagagcagtctgagcctcagcgccgaaagcttccagggatggggtcggaccctggggacagccaggtagtcagctggcaggaaggactccaccccaaattgcaagggtaccttggagagctccttgataatcagaggtgtgtggagcagggagtccggrctgggggccaggatgcgggtcctctcgtccgctacatcttggtcctcaggaagcacaggcatccgggtgtataattctgtctgattgaccaggacaaagaccgcatgcgtgaacccagccgcagggcggcttccgtggagaagggaggggcgggggtggatgtgggaggtctggtgggactaaggccttcaaggcttctcgtcccaatctcaggccccacaggtgcgactcagaccttttactagaagacacagtggtcttacggggctaaactagcatccaggagacataaactatctg

SEQ ID NO: 174107 - DNA, 601 bp, Human
gtctcaccccttcagagcctccctggctgcacccacctttccgacatcagagctgattctgtgacccccgacaaaggcatccccagaagtgaggctctcctccccggtcagcattttgaaagtcgtggtcttcccggctccattgaagcccagcaggccgaagcactcccctttctgcaccgcgagggagagcctgtccacggccaggaggggcacccgctgctcgtacacctgcaggcacccaacagaaaacacggaatgcggaggcctggacgcaaagcagagcagtctgagcctcagygccgaaagcttccagggatggggtcggaccctggggacagccaggtagtcagctggcaggaaggactccaccccaaattgcaagggtaccttggagagctccttgataatcagaggtgtgtggagcagggagtccgggctgggggccaggatgcgggtcctctcgtccgctacatcttggtcctcaggaagcacaggcatccgggtgtataattctgtctgattgaccaggacaaagaccgcatgcgtgaacccagccgcagggcggcttccgtggagaagggaggggcgggggtggatg

SEQ ID NO: 174108 - DNA, 601 bp, Human
tcccgagtagctaggattataggcacctgccaccatgccctgctaatttttgtatttttctttggtagagacagcattttgccatgttggccaggctggtctcgaactctagacctcaagtgatctgcctgccttggccttccaaagctgggattataggcgtgagccacgctcccagcccagaatctgtttttaatcagtttggggaaagtcttagccactacctttttggctactaccccctgccactctctctctctcttccttctggaactcagattacatgtactggggacttctsaccctctcctccattgctagatcacatacggttttctctcccctgcatagattttcaattgcataatttatttctgtagacacagtgagtttataatcttttataatctggcctgatgatgcagatctaacgcctatgtgcttgtccccccatggggcctgtgtctattgcttccagccatggtaccatctcctctgtttgtttgctgtgcattgcctgtaagccctggaaccctctatgggggagtctgcagcctaggatgaggctttcctcccgagagggcctgcatgtgctctggcc

SEQ ID NO: 174109 - DNA, 601 bp, Human
cttgttggcatgtggctccagcagcaggccccgcagagtgttctccacgcaggccccgatgtggcgctcagggatgccccggagccgagcgtacatgaccagcatctcccggcctgtcatgtggtccagcaaggcatcaaactgcgggcagtagccgatccgctgccgcacctggggtcggagcatagccggggagggaggcgggttggagggaagcctccttcctccagaggaccacggggactacccttgaggtgcccaccactgcgcctgtctgtggttcctgccagtgtgtgtacaygggggcgctggagctatgcacaggccgtggtggctgcccacagtggaagctcttggaacagggacacaggaaggatgtgcctggtgcagggaggcttccagagctgctctcagagcctggtccaggacaggcagccatggggttaggtggtgcaagaatggcctttacgtagaagcagactcagagctggctacccactcattcacacctgggacatctgatgtgctaggactctttcttctccctctaagaagaaagatttgtgggcaccacgtttggggtgagtactgcttggtcaga

SEQ ID NO: 174110 - DNA, 601 bp, Human
taaggctgagagttagcattggctcccatgtcccagtggaggcccgtgtcccagcagcggcccacacccagcaattgcagaacagccctagtgaagaggaaggagctgtgtgtgcacctggaaagcccaccgcatagggctggaggccccagagaaggcttttcccaggggcccggtgcacgcacctacatgggaagacatctgcctgcacctaaaggggacctgccgaccctgacatctctcactgctggctttgtccctaggtggcaggcactgtcagggcagtccctttcctacgtgragctacctgggtcacaccaccacatcccagctccatcctggagccacaagcaggagctctggctgctgacctgagcggtcactcccagctctatgctatggggaccttgattctgactccactctgggaagggccagggctcgggaggtgcacctgtacgtcctgaccagcttgttggcatgtggctccagcagcaggccccgcagagtgttctccacgcaggccccgatgtggcgctcagggatgccccggagccgagcgtacatgaccagcatctcccggcctgtcatgtggtccagc

SEQ ID NO: 174111 - DNA, 601 bp, Human
gcaggcgccgggccacggggtccatgccagtggacggctcgtccaggaagatgacagcaggctctccgatcagggcgatgccggtgctcagcttccgcttgttaccaccactagaggcaggagggtgccaggtgggggaataaggctgagagttagcattggctcccatgtcccagtggaggcccgtgtcccagcagcggcccacacccagcaattgcagaacagccctagtgaagaggaaggagctgtgtgtgcacctggaaagcccaccgcatagggctggaggccccagagaaggctkttcccaggggcccggtgcacgcacctacatgggaagacatctgcctgcacctaaaggggacctgccgaccctgacatctctcactgctggctttgtccctaggtggcaggcactgtcagggcagtccctttcctacgtgaagctacctgggtcacaccaccacatcccagctccatcctggagccacaagcaggagctctggctgctgacctgagcggtcactcccagctctatgctatggggaccttgattctgactccactctgggaagggccagggctcgggaggtgcacctgtacg

SEQ ID NO: 174112 - DNA, 601 bp, Human
ggctgagtgttaggggagaaatggaaagtgactcctctgtggaaagagcctgcagtcaccacagagggagagacccctggagggacctccccctgccccatgagtgcccagtggggccccagggactgcctcaccttcgcccagctgaggtcacggcccggcaggtggtaatggaccatgccttggtgctcatcttccaggacgctgcctgcacaaaggagagacggtgttgctgtgagcgccgggctggaggatcggggagggtgcctgggtgctcagcactggagtcctcgtcccaggsattggggagatgggacttggcggggcgaggcacagacgctccgcacagcagatgggagaggcctaggtaggggcccagggcccacccagtgggggctgccggggccggcacacacctggaaaggtcaggtccacgaaggccttgaactcctccagcgcctcctgttgcccttcactctgcaccttggcccgcagggagtagccgctgccgaacttgctcttgaggtgctgggggctgcccaggcacttgaactgcccctgcaccatgatggccagccgggtgcacagggcctcacactcc

SEQ ID NO: 174113 - DNA, 601 bp, Human
acttggagagagaggatgtaagatgggccctgcttgcccgtcctgtccctgcctgatggcgagacagccgccacccctcatcgcccctcctctgcggtgggcggctgcaggtgggcgaagctcaggaagacctgttccagcgagatctggctcacggagtagtcgtccacgccgtacttttccttggctttctccagaataccgaaaacctttggggagcagaaaagtcactggtaggagagaacagggcccaggctcctctgcgggacctgggagtcctctggcaataggggctgatgasgcccccacaatcctacccctgcccagcgccaccccagagccccagagaggtcagccctgcgacggcaccgtgctcccaggtagaggacgctggctaagcaggagccagcggggatggggcccagcctcctccctgtgctgttcccagctcagattacaaccttgagccagtgatgttccctttctgagccagttctttttttcccccatatttttttagagagagtcttgctctgtagcccaggctggagtgcagtggcacaatcatagctcactgcagtctcgaactcccaggctcaag

SEQ ID NO: 174114 - DNA, 601 bp, Human
acctcagacttggcccaggtccctcttcagatcgagatctgatcctaatggggcaaattcctcgagccttgctggggtcatgtccctactgggatgtggagaagcccccggcagaggcctccccaagtctcttaggaggtacccagctgccaccccacctgctcccctcccagatgctgtccaccgtgtgggggtatggacgttagggagggtccgggatgcaggtggctgccctcactccccgctgactgagacggccactgtgcagaaggacagagcagccccagcctttcagaggcakacgctgggtgtccagcccatcggggtccctggccccgctgagcctgcaggcctgggctgcctccctccactcctgctcctcacctgcagcccccttctgaccaggccagctcagggcagaccagactccccccaaccctcctgcttgtcctaggtcatgctggtgggggactcgggtgtggggaagacctgtctgctggtgcgattcaaggatggtgctttcctggcggggaccttcatctccaccgtaggcattgacttccgggtgagtggaggccctggcctggccccacatcagagt

SEQ ID NO: 174115 - DNA, 601 bp, Human
aaaaggggctccctccagtctggggagctgttctctaccccgtctgggggttccaagtcccctcaagtcctctgggatggagtgacgactgaagtgcccgaggggggcaggccagtcctgtctggtccccacttccccacctccctcttggctctcgggcaggtggtaagaggtgaggccatttggttcgcactctcgttcagggtgccagggaaggcggtgtcctccccagcccagcagatggccctgcctggttcccgggagacccagaagcactctgacagcaggagctcaggctgarggaggtggcacaggttccagctgcccagggcctcagactgcggctgaagccccccgcccccaccccaacagatgggactggggctagaccactccctgccttacgtctaatcgttaactgggagggcccggctggggacgctgccaggcagttctgggatctgcggttactgccttgggtcagacaggcccaggcccagccctgacaatcccagcaaggagtggctttaattttttattcttttgaagcagggtctcactctgtcgccctggctggagtgcagtggtgatcatggtggac

SEQ ID NO: 174116 - DNA, 601 bp, Human
tcaggctgaaggaggtggcacaggttccagctgcccagggcctcagactgcggctgaagccccccgcccccaccccaacagatgggactggggctagaccactccctgccttacgtctaatcgttaactgggagggcccggctggggacgctgccaggcagttctgggatctgcggttactgccttgggtcagacaggcccaggcccagccctgacaatcccagcaaggagtggctttaattttttattcttttgaagcagggtctcactctgtcgccctggctggagtgcagtggtgatmatggtggactgcaacctccaacttctgggttcaagccatcctgagtctttcaaattagcaaaaagagctactgggaaggctgaggcgttgcagctccttagttactgcacccatttgcagatgaggaaaccgaggcagtgtcagtaagaggcctggtggggtcatgagttcaaataagtcagcgtaagaggctctaagcaggaatagtgcagaggctgccgggagaggcctgcacttgcaggtgtgggtgaggtcaaattggcttaagggaagcctgcaggggctgggctggacctggga

SEQ ID NO: 174117 - DNA, 601 bp, Human
accactccctgccttacgtctaatcgttaactgggagggcccggctggggacgctgccaggcagttctgggatctgcggttactgccttgggtcagacaggcccaggcccagccctgacaatcccagcaaggagtggctttaattttttattcttttgaagcagggtctcactctgtcgccctggctggagtgcagtggtgatcatggtggactgcaacctccaacttctgggttcaagccatcctgagtctttcaaattagcaaaaagagctactgggaaggctgaggcgttgcagctcsttagttactgcacccatttgcagatgaggaaaccgaggcagtgtcagtaagaggcctggtggggtcatgagttcaaataagtcagcgtaagaggctctaagcaggaatagtgcagaggctgccgggagaggcctgcacttgcaggtgtgggtgaggtcaaattggcttaagggaagcctgcaggggctgggctggacctgggagctgggaggtctcaggggacaggaaggcagtgaagctagtgggaccagaggctgggctgggcccatgccagagctgcctggttctgtctgtttcaga

SEQ ID NO: 174118 - DNA, 601 bp, Human
aagtgctcgcgggttgctgagcccccgggcgcccggtgtagacattcgcagacgccggcgtcccggcccttctctgcctccgatgcctgagcctggccctcccctcctctgggccccttcctcctgcacctgatgggcgtctagggccctgttggtggttccaagagggtggggcctcggtttctccaggatctgggctctgggcctgtccgtagggaggcagcagagcctagtgcaagagggctggtgcactgcagccagcctgtggccccttccagtcccacacttgccgctttctagytctttgatcctgggtaggtgaccctacctctgtgaacctctatttcccctacagaatggggcggcggcttctgccagtaatgtaacaagcccttatcctgctttaggttttttcattctcaaaccagtcctgacaggtggatgttattgttattctcattttggggatgaggaaaatcgaaggttggagacctgaaagtgaccgggtgggctgggtgcggtggctcacgcctgtaatcccagcactttgggaggtcgagacgggcgggtcacgaggtcaggagatggagaccatcctggc

SEQ ID NO: 174119 - DNA, 601 bp, Human
ttgcatttttagtagagacggggtttcacggtgttagccaggatggtctcaatctcctgacctcatgatccgcccgcttcagcctcccaaagtgctgggattacaagcatgagccaccgccctaattttgtatttttagtagagatgggatttcaccatattggtcaggctggtctcgaactcctgacctcaggtgatacacctgtctcagcctcccaaagtgttgggattacaggtgtgagccaccacacccagcctaaatgtttaacaatgttttaaaaacttttttttttttttttttggtagagatgggtcttgctatgttgaccaggctcgtcttgaactcctgggctcaagctatcctcccaccttggccccttaaagtgctgagattacaagtgtgagccaccatgcccggccccagcagtcttaaatcctggtcctttactgtccccaaattagcatggaggagtccctctgcctcccagcccctctctgggcctctcgcctgtcagtcgctgaggtgggttttgagcatggcagccttagcaggtccctgcagcctaagcgtgctgtcagggccaccctctgctgggtgctg

SEQ ID NO: 174120 - DNA, 601 bp, Human
accttgttttgggcccgagtgtgttctcagcagcctggggaagtagctctgcttctgatggcctcctgggggaatctgttctagggctggaggaaaagccagacggagccctggctgcccagcctccgccttcccaggccctgctgacagcaggctcgttgcagatgaggacgatgtgcacagatgcggccgctgccaggcagagttcaccgccttggaggattttgttcagcacaagattcagaaggcctgccagcgggcccctccggaggccctgcctgccacccctgccaccacagcrttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggccgggatctcttctttcttggagctggagggtctcctttg

SEQ ID NO: 174121 - DNA, 601 bp, Human
caccagtgggccgtggcccagatgatgctggaccctggacaccccactctgagcctgtgctctttacctgctcctcccagaggtgccccctcctccaggaaggcctctggcccacacctccagggccctctcctcacaccgctctgccggatgtggcgggctgggactgtgccattgttcctgcagactggcccagcttcctgccagagttgctgctccctccctgcaggcgccctgtgctccaggtccagcccacgtggccagaggtgtgagagtgacggcgctgaccctggcccggggrtgaagggattggactgggaccggtggtcgtgttggggaagaggagagcccccaccccagccgtcccaaggacgtggacccaggcctgagcaccacaagtcacacctccacagctttacactggcagagcccaggcctcttctctgagaactaactctggagcatacagacgactcccctgttttcttccccctttggcaggtggtgccggcagcaccaggcccagaggagcccatcactgtggcccacatcgtggtggaggcggcctctctggcagcagacatcagccacgcatctgacc

SEQ ID NO: 174122 - DNA, 601 bp, Human
cccacttccctgccaccccctggttcctgctccctgcccgtaggcagcaacatccaccaggcacccaccagaatggcccactcgcccagcagcggctctggagggtgggtacagggtggacgggactctcccgcctctctagctgggctcggacttgctgctggccgtggcctgccctccccagtgctccctctggtgtgggagtggtgattgctacactggtcctcatggggcttttatgagcgtgcaatgccaggactctttgatggctactttttaagtgaagatgtctctctccctratgtgctgtgggaggggctgttgcgaggtctggatgggcaagctctcatcggggacagatgcttgtgcaggggggcattcagaggcagccagggcctgggcaggttgagggagctaggggctgctggggttgggggtgcggcaggggcgagtggctaggtgtgcagacgcgagggaaggagctgtctagggacctgatgctgtgggaggtggggcggggcatggctgctgcctggggagcctgctggaccggggctgaggcaggcggggagtgggcagctggacaggaagtaggtttggg

SEQ ID NO: 174123 - DNA, 601 bp, Human
aggcagcaacatccaccaggcacccaccagaatggcccactcgcccagcagcggctctggagggtgggtacagggtggacgggactctcccgcctctctagctgggctcggacttgctgctggccgtggcctgccctccccagtgctccctctggtgtgggagtggtgattgctacactggtcctcatggggcttttatgagcgtgcaatgccaggactctttgatggctactttttaagtgaagatgtctctctccctaatgtgctgtgggaggggctgttgcgaggtctggatgggcargctctcatcggggacagatgcttgtgcaggggggcattcagaggcagccagggcctgggcaggttgagggagctaggggctgctggggttgggggtgcggcaggggcgagtggctaggtgtgcagacgcgagggaaggagctgtctagggacctgatgctgtgggaggtggggcggggcatggctgctgcctggggagcctgctggaccggggctgaggcaggcggggagtgggcagctggacaggaagtaggtttgggcaccaggcggaacctggccttgggcagccctggggactggc

SEQ ID NO: 174124 - DNA, 601 bp, Human
cagggcacctgtctcacctccgtgctgcctttccctggcattcctgcgaccaagacactcatcaatgccactcagagctcggaatgttcatgtgggaggtggggcgggctctggccttgacctggcgtttggtttctgggatggtggcgtcacctgggagcatgaactccttaggttctggcggggtctctgggctgggtctctggccagccaggcccctttccacccacctaaactctagcagcctccagccctaggctcagcacccctccctgtgcttcagcagcccctcttggcaccyctgccactctggcacccctgggattttcccctttgcgggcatcctgggtactctgtgtgtgcccttggccagtcagcaggcccggtgggcttagtccagggctgctagctctcctgttggcctctagtggagatggcacagggtcctgcctgctggtggccaagggctggggcgtgccaggtcctgtctttgcgggtgcaggggtgcggtcagctgtgtgggcagttggaacccacctccaggccctcctgccgcttcgcggaaaaagttcgcgtctcctctggcctcgcagcagccatg

SEQ ID NO: 174125 - DNA, 601 bp, Human
gatggtggcgtcacctgggagcatgaactccttaggttctggcggggtctctgggctgggtctctggccagccaggcccctttccacccacctaaactctagcagcctccagccctaggctcagcacccctccctgtgcttcagcagcccctcttggcacccctgccactctggcacccctgggattttcccctttgcgggcatcctgggtactctgtgtgtgcccttggccagtcagcaggcccggtgggcttagtccagggctgctagctctcctgttggcctctagtggagatggcasagggtcctgcctgctggtggccaagggctggggcgtgccaggtcctgtctttgcgggtgcaggggtgcggtcagctgtgtgggcagttggaacccacctccaggccctcctgccgcttcgcggaaaaagttcgcgtctcctctggcctcgcagcagccatgttcccccaggtcctccccatcagaggcctctgtcctttggaagatcactcctggggcatcgagcgtgtaagggctcgggcaggagaggctcttaattgtttctgagtcaccacgcttttgtcgtgtttcaagagaacag

SEQ ID NO: 174126 - DNA, 601 bp, Human
gcacccctgggattttcccctttgcgggcatcctgggtactctgtgtgtgcccttggccagtcagcaggcccggtgggcttagtccagggctgctagctctcctgttggcctctagtggagatggcacagggtcctgcctgctggtggccaagggctggggcgtgccaggtcctgtctttgcgggtgcaggggtgcggtcagctgtgtgggcagttggaacccacctccaggccctcctgccgcttcgcggaaaaagttcgcgtctcctctggcctcgcagcagccatgttcccccaggtyctccccatcagaggcctctgtcctttggaagatcactcctggggcatcgagcgtgtaagggctcgggcaggagaggctcttaattgtttctgagtcaccacgcttttgtcgtgtttcaagagaacagcttgtcaaaacaagacgccagccggactgaggtggtttctaagcagtggcttcacagctgtttcccacttgtcatctttatgagcagaaaacctgaactgtgtttacaacctagctttgcacattgtcagatttttcccagcatcctccagaagtgcaaaagcccagcttcct

SEQ ID NO: 174127 - DNA, 601 bp, Human
cctttgcgggcatcctgggtactctgtgtgtgcccttggccagtcagcaggcccggtgggcttagtccagggctgctagctctcctgttggcctctagtggagatggcacagggtcctgcctgctggtggccaagggctggggcgtgccaggtcctgtctttgcgggtgcaggggtgcggtcagctgtgtgggcagttggaacccacctccaggccctcctgccgcttcgcggaaaaagttcgcgtctcctctggcctcgcagcagccatgttcccccaggtcctccccatcagaggcctytgtcctttggaagatcactcctggggcatcgagcgtgtaagggctcgggcaggagaggctcttaattgtttctgagtcaccacgcttttgtcgtgtttcaagagaacagcttgtcaaaacaagacgccagccggactgaggtggtttctaagcagtggcttcacagctgtttcccacttgtcatctttatgagcagaaaacctgaactgtgtttacaacctagctttgcacattgtcagatttttcccagcatcctccagaagtgcaaaagcccagcttcctcgcctcaggctgtcccgg

SEQ ID NO: 174128 - DNA, 601 bp, Human
gtctgccccatggggtgggtgctggatgccaggctgcctggccagcctcctctctctgcctcccctgcagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacagtaggtgccagcaccacctgygggctcctcccagggctggatcccaggggctgtccccacgctggccttcgcctccctgaagtggctttctgcagtgactttgtccattgatctgtttactgccttccctggggccacaagggagcctgccagggtggggcccatggttgtgttcttggtactgccagggcacagcctgccccgggtgctggagaccttcctgtggttccccagcaggtggccagcgaggcctcagcggtgcccaggacccacccatgtcctcagtgcagtgagaccttcccgacagcagccaccctggag

SEQ ID NO: 174129 - DNA, 601 bp, Human
attgtggcctgtggcgcccgcctgcgccggagcctgaagccccagtcggccaccgtgcacgacttccaggaggaattcggcctggaccagactcaggcgagtgggccgtggggcggtgctggtcttgggtccccaccgcccgggcgcacgcaggcagcagggagggtccagcgcccaaggcagggccacctcagcttcctccctgcaccagggctcgtttccaaggaccctggagagcccggcccaccccatgtggagctctgggcaggcagggtaccttgcctttccctcaaagggccartggtgacaccctctgccccggcccctgcccctgccccaccgcaggcagcagcaggggtgggcacccaggcctcaccggcccctcccatccctgtgggtggggtgcacttttcccctgaggctcactctgtccccacaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggc

SEQ ID NO: 174130 - DNA, 601 bp, Human
agtcctgaagctgtgcaaagttgggcacagccctgagtctggggggttggggagggcaggggctgtgacttacttgcggagggggagggcctcctctcaggagccacagcagggactgctgcaccgggaggtccaggtcagcatgtcctggaagcagaactgctggcgcctaggcgtgccctctcggtgccctcagctcggcctcctgtctggagggagcgcacaggcttctcttccaaaagtactttttctatcctttccagtgggttttaccaagggttctgacgggcgggtaggtacraggttctgtgccacatgggagtgttaacaaacgtaattttattccaaaagattccaattcttttccacttccaattgaataacttagataacagctcatatccccgccaactttatttttatttatttatttattttgagacggaatcttgctctgtggcccaagctggagtgcagtggcacaatctcggctcactgcagcctccacctcccagattccagcgattcttctgcctcagcctcccaggcataggcacgcaccaccacgcccagctaatttttttcttttgtatttttcagt

SEQ ID NO: 174131 - DNA, 601 bp, Human
tgtgaacccgggaggcggagcttgcagtgagcggagatcgtgccactgcactccagcctggcgacagagcaagactccgtctcaaaaaaaaaaaaaaaaaaaaaaaaaaaaaaaaagacaaagtagagtttggagtcagaaagtcaggcctgactgagattgcagtgagccggaaccgcgccattgcacgccagcctgggtgacagagggagcctctgtctcaaaaaaaaaaaaataataatttttttttttgcattttgttgagatatattcaaatatgctacagaaatgatcccttcaraaactcagtttttacaaaaattagtgggcatagtggtgggtccctgtaatcccagctatttgggaggctgaggagggagaatcgcttgaacccaggaggcacaggttgcagtgatcggagattgcgccactgcactccagtctggcgactggagagcaagactacatctccaaaaaaaaaaaaaaaaaaaaaaaaagtcagtttgaagttggtcttagtttgtccctctcaagtttgtagagagagcccaggcagctccctcagcccagacagagaggacggaaccaagttcagaggcac

SEQ ID NO: 174132 - DNA, 601 bp, Human
gccaaattaaccattttctatctttattttttttttgagacaagagcctcgctctgttgcccaggctggagtgcagcagcgctatctcggctcactgcaacctctgcctcctgggttcaagccattcttctgcctcagcctcctgagaagctgggattacaggacacaccaccatgcctggctaatttttgcatttttagtagagacggggtttcaccaggttggccaggctggtcatgaacttctgacctcaggtgatcctcctgcctcggcctcccaaagtgatgtgattataggtatragccactgtgcccagcctaaattagccatttttaagtaaacaagtcaggcacttacacaattcagtatactgactgtgttgtgcaactatcgccgctgcctagttccagaaccttttcattgtcccaaaaggaatccctgtccccatgagcagttgctcctcatcccacccctagcccctggaagccgccagtctgcgttctgtgtctgcggttttcctgctccagccatattccatatcactgggataccgccgggctttgttgtcggctttgtccacttagtatcatgtgttcaaggt

SEQ ID NO: 174133 - DNA, 601 bp, Human
aaattaacaattttatttattctatataaactgcatgctttttaaatcaaccattctctctttctctctctatcatttttttctgagacagagtctcgctcgtcgcccaggctggagtgcagtggcgcgatctcagctcactacaacgtccacctcccgggttcaagcgattctcctgcctcagcctcctgagtagctgggactacaggtatgcgccactatgcccagctaatttttgtatttttagtagagatggggtttcaccatgttggttggccaggatggtctcgatctcttgacytcgtgaacacctcgcctcggcctcccaaagtgctgggattacaggtgtgagccaccatgcccggccaaattaaccattttctatctttattttttttttgagacaagagcctcgctctgttgcccaggctggagtgcagcagcgctatctcggctcactgcaacctctgcctcctgggttcaagccattcttctgcctcagcctcctgagaagctgggattacaggacacaccaccatgcctggctaatttttgcatttttagtagagacggggtttcaccaggttggccaggctggtca

SEQ ID NO: 174134 - DNA, 601 bp, Human
gggtgggcaacgcagctccgctgttcccaaacaggtgtgagctggtgccgcacagaatgggtaggccggtcctttgtttctacaaaacgcgttctacttccgttactcaaaacccaggcctggcgtggtggctcatgcctgtaatcccagagctttgggaggccaagattggagaactgcttgaggccaggagttcaagaccagcctgggcaacatagcaagaccccgcctgtacaaaaaagtaaaaattaagcaaaaaaattaaccaggtgcaatggctcgcacctgtaatcctagcacactggggagccgaggtgggaggagtgcttgagcccaggagttcaagaccaacgtgggcaataaaggcactgtctctcccaaaaattttaaaaattttcaagattcaagaatcgcttgaacccaggaggcggaggttgtagtaagccaagatcacgtcactgtactccagcctgggcaagagagggagattctgtctcaataaatatataaggctggacgtggccagcactttgggaggccgaggtgggcagatcacttgaggtcaggagttctaggccaggccctgtaaagccacgccagc

SEQ ID NO: 174135 - DNA, 601 bp, Human
ccttctggtctccccagcatcatcgggcgcccgccatgccccgtgcctcacctggaatggccatccactgggctatcgctgacagcgcagtgctctgcacctgctcctccgggaccacctggtccactatgcccacctgcagggcctccgccggcgggaagagcagccccagctgcagggcacgctccgccgcccggtgcccgatggtgttctccagggtgtctttcaacctggaaatgcagacacccactcaccacatggccccaggcgggtctgttccctccacaacaagcatggagcktggctgcagcccagggccttaccagaaaggggcgatgatgcccagctgggtctcattgagtcctatgcagtacctggggttgtccgccaggatgcggtagtcacaggtcagggccaccaggcagcctccagcggggcaggctccctgcagggagaggccggacagggctcttaggtgctgctggtcccaaccacattccagagggccaggtccaaggaaggagggcctgtgcccttggcgcaccccgacccccgcagggttcaacacccacaatggtctgggctgggctgggtgtgcact

SEQ ID NO: 174136 - DNA, 601 bp, Human
gctgaggcaggagaatggcacgaacccaggaggtggaggttgcagtgagctgagatcgcaccactgcactccagcctgagcaagagggagactccatctcaaaaaaaataaataaataaaataaaaataaaaaaatttccatggcactatattaaatactgtcttacagcacaggaaatggcagcacagccttcagtcatttgtatcagggttggcaaatctggcttctcaaggccctgaagctatgaatagtttttactttttttgagaggagtctcactctgtcgtcctggctggagcrcagtagcatgatcttggctcactgcaacctccgcctcccaggttcaagtgattctccggcctcagccttcccaagtagctgggattacaggtacctgcccccacacccggctaatttttgtatttttagtagagacggggttttgccatgttggccaggctggtctaaaactcctgacctcaggtgatccgcccaccttggcctctcaaagtgctgggattacaggcttcagccactgtgccgggctggtttttacatttttgaatagttgaaaatcaaaagaaggttagtattttgtga

SEQ ID NO: 174137 - DNA, 601 bp, Human
acctcaggtgatccaccctccttggcctcccaaagtgccgggattgcaggtgtgagccaccgcgcccagcgacttaacgtgtcattttcactcaactatattatgaagaatatttccacgacgcaggaggctgaggcaggagaatggcacgaacccaggaggtggaggttgcagtgagctgagatcgcaccactgcactccagcctgagcaagagggagactccatctcaaaaaaaataaataaataaaataaaaataaaaaaatttccatggcactatattaaatactgtcttacagcayaggaaatggcagcacagccttcagtcatttgtatcagggttggcaaatctggcttctcaaggccctgaagctatgaatagtttttactttttttgagaggagtctcactctgtcgtcctggctggagcgcagtagcatgatcttggctcactgcaacctccgcctcccaggttcaagtgattctccggcctcagccttcccaagtagctgggattacaggtacctgcccccacacccggctaatttttgtatttttagtagagacggggttttgccatgttggccaggctggtctaaaac

SEQ ID NO: 174138 - DNA, 601 bp, Human
caacctccgcctcccgagttcaagtgattctcctgcctcagcctcttgagtagctgggattacaaccgtgtgccaccacacccggctaattttgtatttttagtagagatgggatttcctcatgttggccaggctggtcccgaactcctgacctcaggtgatccacccatctcggcctccccaagtgctgggattccaggcatgagccaccacgcccggccctaatttttttttgttttgttttgtttttaaagagacaggatattctctgtcgcccatactggagtgcactagtgatcaygactcactgcagccttgaatccctgggctcaggtgatcctctcacctcagcctcctgagtagctgggactacaggcgtgcacacacatcctggctaattttgtattatttatttatttatttttgagatggagtctgtctctgccacccaggctggactacagtggcgtgaccttggctcactgcaacctccgcctcccaagttcaagcacttctcctgcctcagcctcctgagtagctgggattacaggagcattaccatgcccggctaatttttgtatttttagtagagaaggggttt

SEQ ID NO: 174139 - DNA, 601 bp, Human
attcccaacttattttttatttttattttttgagacggagtcttgctctgtcgcccaggctggagtgcaatggtgggatcttggctcactgcaacctccgcctcccgagttcaagtgattctcctgcctcagcctcttgagtagctgggattacaaccgtgtgccaccacacccggctaattttgtatttttagtagagatgggatttcctcatgttggccaggctggtcccgaactcctgacctcaggtgatccacccatctcggcctccccaagtgctgggattccaggcatgagccascacgcccggccctaatttttttttgttttgttttgtttttaaagagacaggatattctctgtcgcccatactggagtgcactagtgatcacgactcactgcagccttgaatccctgggctcaggtgatcctctcacctcagcctcctgagtagctgggactacaggcgtgcacacacatcctggctaattttgtattatttatttatttatttttgagatggagtctgtctctgccacccaggctggactacagtggcgtgaccttggctcactgcaacctccgcctcccaagttcaagc

SEQ ID NO: 174140 - DNA, 601 bp, Human
acctccctgggacccacaggggcacgtgtggccgtaagcctgtggcagcccaatcgttagcctttttcttctttgagcctctctaagtacatctgcagggacttctggatggagtctttggagatgaagctgacgaagttctgcacgtccgcatcgcgctgcgtgaccaggcggctggccgtggcctttcgcatcatggccttggtcagctgtcgagcatggtctaaagagaatgggacgtgccactgaaatcccactttcaggggcagtggggtgattcccaacttattttttatttttwttttttgagacggagtcttgctctgtcgcccaggctggagtgcaatggtgggatcttggctcactgcaacctccgcctcccgagttcaagtgattctcctgcctcagcctcttgagtagctgggattacaaccgtgtgccaccacacccggctaattttgtatttttagtagagatgggatttcctcatgttggccaggctggtcccgaactcctgacctcaggtgatccacccatctcggcctccccaagtgctgggattccaggcatgagccaccacgcccggccctaattttttttt

SEQ ID NO: 174141 - DNA, 601 bp, Human
gaggcaaccagctgtgcagcctcatctcagggatcatccgggcctcttcagaggtgaggggggcttcagagtgactctttgctgtctttgaaatggaagcctttaaaagcaaaactgttttctgacttaaaaagtaatacctgctatctgcttattgggggaaataccaaacattacttgttatctccatatctctttacctagaagtaaccactgttaacattttattttgtttcttttatttatttctttatttttatacctgcttattctggagtcttttttttttttttttttttgkgatggggttcccctttgtcacccaggctggagtgcagtaacacagtctcagctcatgcaacctctgcctcccgggctcaagtgatcctcccacctcagtctcctgagtagctgggactacaggcgcataccaccatgccctgctaatttttgtatttttttgtagagacagggttttgccatgttgctcaggctggtctctaactcctgggctgaagtgatccccctacttcggcctcccaaactgctgagattacaggtgtgagccacggtgccaaactttttttgtttcgttttgttt

SEQ ID NO: 174142 - DNA, 601 bp, Human
gaaccaatgtactgaaacatttaaatacagaaggctgggcgaggtagattcatgcctgtaatcccagccctttaggaagccgagacaggtgggtcatttgactccaggagtttgagaccagcctgggcaacaaggtgaaaccatgtctctaaataaaatacaaaaaaattagctgagcacggtggcatgtgcatgcctgtagtcccagctacttgggagactgaagtggaagaatcacttgagcccaggaggtgaaggctgcagtgatccatgatcgcactatagcactccaacctggacracaaagtgagaccctgtctcaaaaaaataaaagaaaaacagaatttgtttagtttgtgttatttctgccctgtggcaggtgctagggctggatgatctggggttcatttccacttggtaatggctggatgatacactgggagtttagatttctaaacaaaatgagatcaatgataaccaagcttctctactcccagattcaccctcatggcttaaatcatggatggcgctggttggcacagatcttaaacatggagcccttgtcagatgtgacagccaccctcctctttgacttcctgga

SEQ ID NO: 174143 - DNA, 601 bp, Human
gaagccgagacaggtgggtcatttgactccaggagtttgagaccagcctgggcaacaaggtgaaaccatgtctctaaataaaatacaaaaaaattagctgagcacggtggcatgtgcatgcctgtagtcccagctacttgggagactgaagtggaagaatcacttgagcccaggaggtgaaggctgcagtgatccatgatcgcactatagcactccaacctggacaacaaagtgagaccctgtctcaaaaaaataaaagaaaaacagaatttgtttagtttgtgttatttctgccctgtgrcaggtgctagggctggatgatctggggttcatttccacttggtaatggctggatgatacactgggagtttagatttctaaacaaaatgagatcaatgataaccaagcttctctactcccagattcaccctcatggcttaaatcatggatggcgctggttggcacagatcttaaacatggagcccttgtcagatgtgacagccaccctcctctttgacttcctggaggtacgtaactcagttatcacacaagagaaggccagtggttgaggtagccttgatccactgggtgacatgaatgg

SEQ ID NO: 174144 - DNA, 601 bp, Human
gtttaattaaaagtaaaaactatcaggcctgaaagaaactgcaaaaggcagaaaacacatagcaatctacaaagctgaaagatggttagggttattttctctttttgagattgacatagcagagaatatctatatgcctccccacaattactccttgagccaattagaagttaaataaactatggttctggatctgactgtatttatttttcttgcattcttgaaccagttgtaaataaatgaaatcgatgtcacatacactcagcaaactttcccaattcaccacagttgattaacattkatttaaaaacagtaatagaatgatcagctcaggctctatgctcttgttcaggcttaggctgagtctatgcgatgcacaagaatgagcttaaaagagaacatttatttaacaagagtatctattgaagccatgtgagagaaagcaatcctttccattgtagattcccacttgctacttgtatccttactaatctgggcttcctctttagatacacatataaatgtacatagagaccttatacaatttctgtcagttatgtttaacaccaatatacatttatatattaccatcggtatatgc

SEQ ID NO: 174145 - DNA, 601 bp, Human
tgtaaacttattttccaacataaacttctgtacctcttgatagaataatacagtataaagtaattacctttcttttcttagtttgaagataagtagtttaattaaaagtaaaaactatcaggcctgaaagaaactgcaaaaggcagaaaacacatagcaatctacaaagctgaaagatggttagggttattttctctttttgagattgacatagcagagaatatctatatgcctccccacaattactccttgagccaattagaagttaaataaactatggttctggatctgactgtatttrtttttcttgcattcttgaaccagttgtaaataaatgaaatcgatgtcacatacactcagcaaactttcccaattcaccacagttgattaacattgatttaaaaacagtaatagaatgatcagctcaggctctatgctcttgttcaggcttaggctgagtctatgcgatgcacaagaatgagcttaaaagagaacatttatttaacaagagtatctattgaagccatgtgagagaaagcaatcctttccattgtagattcccacttgctacttgtatccttactaatctgggcttcctctt

SEQ ID NO: 174146 - DNA, 601 bp, Human
taagtagttattggttttttttctcagtaacagatcttcttttattacatctaaatgatgttaaaatatcttgccaattccttatcaaaatgaaacactgtgtggcacaagtgtggtgagacaactgttgaatgttaggtttccgtcacttgcattcttgcatagacattgctgatgtgatgaatttttatctatcttattcgtacagtgccacctgtctcagtagagcatttaatctgtatttcaccctcattagctcgtcaacaaatgacaaatctatacctattttgactttctaaaygattattactaagaagctatgtataatttatttatgtttctaagaatctccacataaggataactctcttcaacacctttatcataaaatctaagtacatcaaaatttctaaatagacaagcacataaaaaggtagaagacaaacagaatggtatataaatgtaaaactgcttaccttcgcagaagtagcaaagtgaaattttttccaatcaaaatattttccgtggcacaacaccttatggtatgacaagggatttgtgatgaaatggacatattttcccattagtttgcaggtaaaaa

SEQ ID NO: 174147 - DNA, 601 bp, Human
tccatcgggtcaatgcttctgtgcccaaatgcctgatagcaaataaaacatgcagaaaaagaagttaaacctgacctagtcatagtaaatgactgaaaaacggattagatactttcatagttccttacttggtaaacacgggaaattggctttcccttgtacaagttcatagcactttacaaataaatgaccaaactgtacctttcctttaaagccaacttcagtggcactcccctggatcactcaagtcatctatgtcttatttcttatgctactgcacttatttacagctattgcacayaaactaattgataatgttttaaaatcattagttatcttttatattatttgtagatttctttttctttttcttttagagatggggtctcacattgtcacccaggctggagtgcagtgacacaatgatagctcactgcagcctcaaactcctggactcaagcgatcctcctgcctcagcctctcaaatagcagggactacaggtgtgttccattgtgtccagctgtagatgtattttaaccaaactttaagctacttagtcacaaagaccaaagctaatatttatttgcagtaagtaagtag

SEQ ID NO: 174148 - DNA, 601 bp, Human
acccaggaggcagaggttgcagtaagccaagatcgcaccattgcactccagcctgggcaacagaacaagactttgtcaaaaataaataaataaataaaaataaaaatatcatattgttatagttccataaaatatagaaaagcagaacaaagaaaaatcaaagcactttcaaatccatcactcaatccatgcaggtaactgtggtttcttaatggttcttttccctcctttattttatgaaaatgactaatatgcttccattaaccatcagattagtggtaagaggaatatgagaaacatrgtgtggcagtgcagggtggtagttgagagaataggatgccacataatgatgtatttgattctaccctggctgcagcttaacctctaggtgtcagtttcctcacttggtacaaataaatagtaacagtcccaagtcacaggacagttgtgaggattaaccgagaaaactcatatgaaatatttagtttaatgcctagaattcggtaagtatataatttatgttggtcattattgttaaagtagtaggacatagaaaatgaaactcaacataacaagtatacccacctaatactggcaggtc

SEQ ID NO: 174149 - DNA, 601 bp, Human
cctccttaaagaaaataaccaaaaaaagaaaactttattactataaacatatcatattgttggccgggtgcggtggctcatgcctgtaatcccagcactttgggaggccgaggcgggcggatcacttgaggtcaggagttcgagaccagtctggacaacatggtgaaaccccgtctctactaaaaatacaaaaattagccaggggtggtggcgtgcacctgtaatcctagctacttgggaggctgaggcaggagaatggcttgaacccaggaggcagaggttgcagtaagccaagatcgcrccattgcactccagcctgggcaacagaacaagactttgtcaaaaataaataaataaataaaaataaaaatatcatattgttatagttccataaaatatagaaaagcagaacaaagaaaaatcaaagcactttcaaatccatcactcaatccatgcaggtaactgtggtttcttaatggttcttttccctcctttattttatgaaaatgactaatatgcttccattaaccatcagattagtggtaagaggaatatgagaaacatggtgtggcagtgcagggtggtagttgagagaatagga

SEQ ID NO: 174150 - DNA, 601 bp, Human
agcctgaccttttagccgtatcctttaactgtcatgttttagggtgctcatcacatgattgtgtataaaattccagaatgttagcattttattttacagataagaaaagtaaggcccccaaaagagtactgacatgtccaaagtctcccaagtcagccccagcatggaacctaagcttcttgcctccttaaagaaaataaccaaaaaaagaaaactttattactataaacatatcatattgttggccgggtgcggtggctcatgcctgtaatcccagcactttgggaggccgaggcgggcrgatcacttgaggtcaggagttcgagaccagtctggacaacatggtgaaaccccgtctctactaaaaatacaaaaattagccaggggtggtggcgtgcacctgtaatcctagctacttgggaggctgaggcaggagaatggcttgaacccaggaggcagaggttgcagtaagccaagatcgcaccattgcactccagcctgggcaacagaacaagactttgtcaaaaataaataaataaataaaaataaaaatatcatattgttatagttccataaaatatagaaaagcagaacaaagaaa

SEQ ID NO: 174151 - DNA, 601 bp, Human
tttaaatctgatcctgagttaataataatcttttgattaagagataatcatcttggtcataattgggaaacaaaattccatcattttatagaagagtaatgtaataaaactggaaaaatcagtaatacatttttatagaaattattcaaagtttatcacttctgagatttaatatactgaggacttctgagattgaatatactgatagcactgacacatacatatgttttttctaggtgtttaatgcagcttcagttcaacatttacaagaacctatttttatccatatactatctgatgytgcgtggcgatcaccgctgcccggtaaaggcataaagggacaaaaagaaccaacctgaaaatggctgaaatatagagagctcgcgagaggtccagcctgaccttttagccgtatcctttaactgtcatgttttagggtgctcatcacatgattgtgtataaaattccagaatgttagcattttattttacagataagaaaagtaaggcccccaaaagagtactgacatgtccaaagtctcccaagtcagccccagcatggaacctaagcttcttgcctccttaaagaaaataaccaaaaa

SEQ ID NO: 174152 - DNA, 601 bp, Human
taagctccaattcaaaataagaaagcatcagaatcaaaaattgcttgatttcgtggatagcgaacaatcttccaggacatattgtagctcccgatccaaagggcatgtagtaatactttaacttgagtccattacaatagaaggtagtctttgtcttcccgttttcatcaagatacctatcatatttaaaagtctgcaataaaaatacaaagaaaaccgcctttaagctagttttaaagaaatttatctctttctaaacctggaagctccaaagagtaattttctttttaattctaccccrttagtgatttagcaaatactccacattgaatcagaaagtaataaggaacaggagcttaatgagctaaggaagccttgtgatacctcctatcctgcttgaacgattagttccttagtcaggcagagctagagagagaagggttcccagaagaaactagaataatcaatatattagcctccaatttcctggatttgggaggaggtgctttttaagaaaaaaaaagtggcaggtttattatcatgactgcaaatataatctagcaaagactgtgtgatggcaaatatcaggactaaaatgaaa

SEQ ID NO: 174153 - DNA, 601 bp, Human
tgagaattccaccatgagagcatctgcaagtggtcaggggagaagttttatcctgcttctggggtgggctgggcggggagcaggtgggccagtggggccacactcagtgtgtgcgtgggccgtggacaccatgagctgttgtcacagcacagtgaccatgctccagtgatggccagctccagtaccacaccaagtctcttaagctcttccaaagtgctataaaaaactcttacccaaaaggatgccaaaaatacaggaatggtgggaaccccacataagggtaagtgtcttgagtctgctyagcactcaggaaacatttgttaacaggaagcgtgtcacaatttcattctggttctggatgcatttggagaatgttaactcatctgtctgagagggagatcactgctaaacaggatcccagagtggctctggttattagactgagtcaaatgaaagtgtcctcattcaaccatttttgatatttaaaaagtccatttcatccttatacaccaagttcccacatccttctgtttagagaaaatgatttccaacactgaaatgagcatctatgaaacgtaatgatggtccatccagcggagat

SEQ ID NO: 174154 - DNA, 601 bp, Human
agaacagatagtaaaagcagaacatgcatccgatctaaatttagcacgtcactattcattactgagagaacgagcctcttgtcaggagaaggctgaagtgtttgacgtcaagttactaaaaaagacggccataaaccaaaatattaagtctagcacaacaggaatgggatgcttttaaaattaggacatgctaaagaaaatactaagagggcaaaaacgatgtataaatggctctagggcctcacggattcaccattacctctgatggtgtcacgtgattttcatctacctccttcttctstgcccacattttaaaagatgtgtctagaccagagatctcaacaggtgggctctggttgaaatccatacgtggtccttactttggttacaatcccacatgacctccttgtgttgctgcatgtagacagcaggcagagctggatacaactccctgggcatggtgacgttccacagagcagaaagggtctgagagcaaacacacgccttctggggccatgtgagaattccaccatgagagcatctgcaagtggtcaggggagaagttttatcctgcttctggggtgggctgggcggggagcag

SEQ ID NO: 174155 - DNA, 601 bp, Human
caaaaccacagctgcaactattctaccaccattttacgtaatataataaaagttaagggatttgatttgcattccccctcatttatgagcatttaaccaaaaacactttttctgtgacacttttgttaaaaaaagataattgggtactgctgcaaatattaatgcttaacaacaaaatagtactaaaaaaccatgacccaactgaagtgatggagaacgaagtctttttccaggagaagccagcaaagccatctggcacgttgagctttcattctgacaaatagcaacatacagaacagakagtaaaagcagaacatgcatccgatctaaatttagcacgtcactattcattactgagagaacgagcctcttgtcaggagaaggctgaagtgtttgacgtcaagttactaaaaaagacggccataaaccaaaatattaagtctagcacaacaggaatgggatgcttttaaaattaggacatgctaaagaaaatactaagagggcaaaaacgatgtataaatggctctagggcctcacggattcaccattacctctgatggtgtcacgtgattttcatctacctccttcttctctgcccaca

SEQ ID NO: 174156 - DNA, 601 bp, Human
taatacagcatgcatggcagccggaaacagtcctatctttgcaaaaccacagctgcaactattctaccaccattttacgtaatataataaaagttaagggatttgatttgcattccccctcatttatgagcatttaaccaaaaacactttttctgtgacacttttgttaaaaaaagataattgggtactgctgcaaatattaatgcttaacaacaaaatagtactaaaaaaccatgacccaactgaagtgatggagaacgaagtctttttccaggagaagccagcaaagccatctggcacrttgagctttcattctgacaaatagcaacatacagaacagatagtaaaagcagaacatgcatccgatctaaatttagcacgtcactattcattactgagagaacgagcctcttgtcaggagaaggctgaagtgtttgacgtcaagttactaaaaaagacggccataaaccaaaatattaagtctagcacaacaggaatgggatgcttttaaaattaggacatgctaaagaaaatactaagagggcaaaaacgatgtataaatggctctagggcctcacggattcaccattacctctgatgg

SEQ ID NO: 174157 - DNA, 601 bp, Human
cctgcagatgccctgctcggaggtacccctccagcgaaggagcaactcagcaggaacccacccaggccggccacacagtgttgacacatgggtcacagtgggaaaattcaggccttctgcctggtctcttcctccctactttgcaaatccactctgatgagaaccagcagccagggtggcgcaggaagcggaaaacaacagtaacagcagaaagccagactcaccaggagaatggagggcgtgacccctgtgtgaccctggacccatgtagatgctaaagcaaaaagaaggggaatggactgggtgatctctccatccctacttgggaggccacactaggttgctgagatgctcaggagagaagaacaaacactgaatcaatgcctcccatttatccttggggggtggagggaggctgggattccgaagcataactcacatccagaaggcacaggaataaaatccaagcaagaaccaagagcttcagcgggggcccctcctcccctactccgaaggctggctaaagcttcgctggcatcttccccactgccccatctcagcctcctgactgtttctcacctagagaaccccagagatgaaa

SEQ ID NO: 174158 - DNA, 601 bp, Human
tgctggcaggtggatctgggcgtcaagttcttcactaacaaaatgggggtcttgggaagggtatgaggatcacggaaagagaagcggacaccacgcctccatttcccagcataacgtcactcagtggcaacagagactcctggccccgccaagagtgagaggcaagtgtgcccaccatcctgcagatgccctgctcggaggtacccctccagcgaaggagcaactcagcaggaacccacccaggccggccacacagtgttgacacatgggtcacagtgggaaaattcaggccttctgcctsgtctcttcctccctactttgcaaatccactctgatgagaaccagcagccagggtggcgcaggaagcggaaaacaacagtaacagcagaaagccagactcaccaggagaatggagggcgtgacccctgtgtgaccctggacccatgtagatgctaaagcaaaaagaaggggaatggacggggtgatctctccatccctacttgggaggccacactaggttgctgagatgctcaggagagaagaacaaacactgaatcaatgcctcccatttatccttggggggtggagggaggctgggatt

SEQ ID NO: 174159 - DNA, 601 bp, Human
ggccacacatgctggcaggtggatctgggcgtcaagttcttcactaacaaaatgggggtcttgggaagggtatgaggatcacggaaagagaagcggacaccacgcctccatttcccagcataacgtcactcagtggcaacagagactcctggccccgccaagagtgagaggcaagtgtgcccaccatcctgcagatgccctgctcggaggtacccctccagcgaaggagcaactcagcaggaacccacccaggccggccacacagtgttgacacatgggtcacagtgggaaaattcaggcmttctgcctggtctcttcctccctactttgcaaatccactctgatgagaaccagcagccagggtggcgcaggaagcggaaaacaacagtaacagcagaaagccagactcaccaggagaatggagggcgtgacccctgtgtgaccctggacccatgtagatgctaaagcaaaaagaaggggaatggacggggtgatctctccatccctacttgggaggccacactaggttgctgagatgctcaggagagaagaacaaacactgaatcaatgcctcccatttatccttggggggtggagggag

SEQ ID NO: 174160 - DNA, 601 bp, Human
gcagaggcccattctctgcacactgccacactctcagcggaaagatgcaccccatgtgcggccccacttcacatggaccaagtgctcttcctcccacaaccctgggtgtggggacggtaccatgacaaacctgagaaagcttccaggaatatcaaagcccccgggaagccatcttcactgtaaagggaccctgcagtgtatgggaagccaggctcactaccacagtgtttccggaaaggcttccaccagcaagggacgcggggcgacctgagtttggggttgcttcatcggctcctgaatrccagatatacctaaggccacacatgctggcaggtggatctgggcgtcaagttcttcactaacaaaatgggggtcttgggaagggtatgaggatcacggaaagagaagcggacaccacgcctccatttcccagcataacgtcactcagtggcaacagagactcctggccccgccaagagtgagaggcaagtgtgcccaccatcctgcagatgccctgctcggaggtacccctccagcgaaggagcaactcagcaggaacccacccaggccggccacacagtgttgacacatgggtcacagt

SEQ ID NO: 174161 - DNA, 601 bp, Human
cattttaataagagaaagctcacttccctgcctactcatttgcacatcggcatctacgccccagcctgaaacttgacagtaaacacaatgcaccaccactcccttcaacaagtgaggctctggccctgccgctcactccatccactccttcccactcttcttgcctttaacaaacacacgctccaagcctcagagaaatcagccgctgacccgtgtctctggctgtcccacacaacagggctgccatccctcagttcagtggccaggcctgtctagggcacaagggggtctccaccagggytggctgatgaggggtagcagaggcccattctctgcacactgccacactctcagcggaaagatgcaccccatgtgcggccccacttcacatggaccaagtgctcttcctcccacaaccctgggtgtggggacggtaccatgacaaacctgagaaagcttccaggaatatcaaagcccccgggaagccatcttcactgtaaagggaccctgcagtgtatgggaagccaggctcactaccacagtgtttccggaaaggcttccaccagcaagggacgcggggcgacctgagtttggggttgct

SEQ ID NO: 174162 - DNA, 601 bp, Human
tgattagtaagccaacattttaataagagaaagctcacttccctgcctactcatttgcacatcggcatctacgccccagcctgaaacttgacagtaaacacaatgcaccaccactcccttcaacaagtgaggctctggccctgccgctcactccatccactccttcccactcttcttgcctttaacaaacacacgctccaagcctcagagaaatcagccgctgacccgtgtctctggctgtcccacacaacagggctgccatccctcagttcagtggccaggcctgtctagggcacaaggrggtctccaccagggttggctgatgaggggtagcagaggcccattctctgcacactgccacactctcagcggaaagatgcaccccatgtgcggccccacttcacatggaccaagtgctcttcctcccacaaccctgggtgtggggacggtaccatgacaaacctgagaaagcttccaggaatatcaaagcccccgggaagccatcttcactgtaaagggaccctgcagtgtatgggaagccaggctcactaccacagtgtttccggaaaggcttccaccagcaagggacgcggggcgacct

SEQ ID NO: 174163 - DNA, 601 bp, Human
ccagcaacacttgattagtaagccaacattttaataagagaaagctcacttccctgcctactcatttgcacatcggcatctacgccccagcctgaaacttgacagtaaacacaatgcaccaccactcccttcaacaagtgaggctctggccctgccgctcactccatccactccttcccactcttcttgcctttaacaaacacacgctccaagcctcagagaaatcagccgctgacccgtgtctctggctgtcccacacaacagggctgccatccctcagttcagtggccaggcctgtctrgggcacaagggggtctccaccagggttggctgatgaggggtagcagaggcccattctctgcacactgccacactctcagcggaaagatgcaccccatgtgcggccccacttcacatggaccaagtgctcttcctcccacaaccctgggtgtggggacggtaccatgacaaacctgagaaagcttccaggaatatcaaagcccccgggaagccatcttcactgtaaagggaccctgcagtgtatgggaagccaggctcactaccacagtgtttccggaaaggcttccaccagcaagggacg

SEQ ID NO: 174164 - DNA, 601 bp, Human
gctgtgtgtccttccataaagaccaactgaaactgcttaaaaccaagacatttttttaaaaaaaaacaagttattggtctaatgcattctaagagtattaatacaatcagcaatggtaacgcataaatgttaagcaaaaatatttacagaaagaaataaccttttcctctgccactaatcacacccagcaacacttgattagtaagccaacattttaataagagaaagctcacttccctgcctactcatttgcacatcggcatctacgccccagcctgaaacttgacagtaaacacaatgyaccaccactcccttcaacaagtgaggctctggccctgccgctcactccatccactccttcccactcttcttgcctttaacaaacacacgctccaagcctcagagaaatcagccgctgacccgtgtctctggctgtcccacacaacagggctgccatccctcagttcagtggccaggcctgtctagggcacaagggggtctccaccagggttggctgatgaggggtagcagaggcccattctctgcacactgccacactctcagcggaaagatgcaccccatgtgcggccccacttcacat

SEQ ID NO: 174165 - DNA, 601 bp, Human
ggctcaaaggatctgccctccttggcctaaatcattactttagaaaatgcatccaattatctgctccttcaacaatggtcaaaattcagatccagatactaaatcctaaaattactgaaagtaaccaggctcttgcacttctgagctattttatcagcatttgtagctgggggagctgctctaagttgaaactaatgcccctttacacttgaacctggcagatccctcaagcttcagtgaaatgctgtgtgtccttccataaagaccaactgaaactgcttaaaaccaagacatttttttwaaaaaaaacaagttattggtctaatgcattctaagagtattaatacaatcagcaatggtaacgcataaatgttaagcaaaaatatttacagaaagaaataaccttttcctctgccactaatcacacccagcaacacttgattagtaagccaacattttaataagagaaagctcacttccctgcctactcatttgcacatcggcatctacgccccagcctgaaacttgacagtaaacacaatgcaccaccactcccttcaacaagtgaggctctggccctgccgctcactccatccactcc

SEQ ID NO: 174166 - DNA, 601 bp, Human
ttgagacagggtctgcctctgtcactcaggctaagtagaggggtgtgatcacagtgcactgcagacgtgagctcccaggctcacacaatctggccacccaggcataggcaggcgccgccacctggccgagttttaaaaacattttctggagatggggtctccctctgtcacccaaggctgagtgcagtggtgcaatcatggcttactgcagccttgacctcccaggctcacacaatcctcccacccagctactctggaacctgaggaccacagatacacaccaccacctggctgatttttwaaaaaaatttttttatagagatggggtcttgctatgttgcccaggctggtctcaaactcctgggctcaaaggatctgccctccttggcctaaatcattactttagaaaatgcatccaattatctgctccttcaacaatggtcaaaattcagatccagatactaaatcctaaaattactgaaagtaaccaggctcttgcacttctgagctattttatcagcatttgtagctgggggagctgctctaagttgaaactaatgcccctttacacttgaacctggcagatccctcaagcttcagt

SEQ ID NO: 174167 - DNA, 601 bp, Human
gaggaccctgtgcgggcgccattgttgttcatcagtatacatttataaagaaacggaaattaaacactgtcatcagatgctctgcactgctgctcatccacggctgtgttttttcatcctcccacattaacatttccccctaatgttctatctttttgccatatataattaattttaacagcttctgcaacttccccacaggttgttgctgtttcttttaaacagtatactgctgagaaattgatttgtttgctccgcgtgcctgaagaaaccacattatgaaatatgtataaatgtcacygttcgggctgcttctcaggataagtgcagaaaaacgttccattttacctccttacacaggagtccactcacggaggctactcgcatgtattacccgtgtgctcacacacaaatgccgatgaattacgcagcattttctttgaaaacctcctatttatccttaactggtacaaggctaggggaatcatcttaattgctacatggaaagaatgaattgcaaaagcattcagtcgaccaagaagactttatttttaacagcatggggccaggtggaagttgccaagtttgccaaaaataaatg

SEQ ID NO: 174168 - DNA, 601 bp, Human
ctgaatttttcaaggagttgcaggttacaccctacccacgacaacaaaggtttcctttgagttaaacaacgtatagctgaaccggaagagggaaggtgaccacgggaaaggtgttgcattacaaggctcaggaattcgataccttcaccaccaattctcgttttccacaaatccctattaaaagacagcacggtaccgttcccagaaatcaaggctcacaccacgtggagctgactggatgctcacggggacattcgatcccagcggcctggagaaaggacggaacaggaggaccctgtgygggcgccattgttgttcatcagtatacatttataaagaaacggaaattaaacactgtcatcagatgctctgcactgctgctcatccacggctgtgttttttcatcctcccacattaacatttccccctaatgttctatctttttgccatatataattaattttaacagcttctgcaacttccccacaggttgttgctgtttcttttaaacagtatactgctgagaaattgatttgtttgctccgcgtgcctgaagaaaccacattatgaaatatgtataaatgtcactgttcgggctgct

SEQ ID NO: 174169 - DNA, 601 bp, Human
tgagaagagacacccttggctgctgcactaagagggactgaagactccctccagacaacaggccacccaggcagagggagcccaaatgctcacaggaaagccaaccccaggaggtacagacgcttctgcgacatgcagaagagacaaagtggcctcgagcagctggagccaaggtctcctaggacgcaggccccatccatgccccccaggcgtcccaccaccgcggaagtgggtgatagggaggactcacttgccatgaccagctgaaccaaggggtatatcctacaaacctgcagtgtcygggaaagaggcgagcttcccccaggaaagggggcaagcctgtcccacagctctgggaccctcctgtaagcaccctcccacccctgctgaagagcctctccccctacatccctgaggaaactgatcacccaagctgaatttttcaaggagttgcaggttacaccctacccacgacaacaaaggtttcctttgagttaaacaacgtatagctgaaccggaagagggaaggtgaccacgggaaaggtgttgcattacaaggctcaggaattcgataccttcaccaccaattctcgttttccac

SEQ ID NO: 174170 - DNA, 601 bp, Human
ctgcggctgggatcagcacaccctcacaactaaaaccccaatgcgtgacatttgggaaaggcttcatggaaaccccaaacctttcactgcttgataggaaaacattattaccaggtcgatgggcaaggagtgagcaacccacatcccaagtgccaggtggaagacagaaccttcaggaacacagcagaccttcacgaccaagaaaggtttgagttccgttcgtcttgcatcgaaatgttcattgcaacatagaccacaggtaccggcttggagagatgcaacctgtactaccttcccctcyagcccagccaggcgagcagggcatctcccacatgctaagcctttggctgtgtgcatttactgctgctactgcagcaatcatctttgtgtgtgtacatatattcatggggtacaagtgcaattttctacatccatacattgcattgtggtgaagtcagggccttcagtgcctcgatcgctgaaacaatgcacattgtacccaccaagccacctctcatcagcctccctcgtcagtccccataatgtcattccagactcagcagtcattcttgactaagctcttaacatgtaccaggtatct

SEQ ID NO: 174171 - DNA, 601 bp, Human
tgtgcagcgtctggcatgcatgccacatgaggcttcctttccggggcaactggctggaccattctgggccctccagattaaaagggcccttttcaactctgctttcctgaccagagaaggcctgggacatgagccccaagctccaccactcagccctccccccaagttcactgaaagatacccccatcctgaactccaactggagccatctctctccactcccttttcagggggcagctttcaaagggtacaattcctcactctcaataaagcaatgcttcctgccttagaaaaccatcarcaagtttgtatggaaaataagctcttgagttgtcaaaaacccatggctaaaggagaacccaaatggtgccaagctaccaggggaggtggcacctccaagagtggcagaagggtcccaaggactgttcaggtccacggtctctttctctggacccatcactccagccagtctggtccaggctaggacggagtagggatgggggtgatagataagaccaggtctggccagccaggctcttcccagaaccaacacaatcccagcacactgtggccagaagcatcctcaaaacaggactttgcg

SEQ ID NO: 174172 - DNA, 601 bp, Human
ggagtctagggagacactgtagaaaagccatcatactagcacacggtcaggcacgttcagtacgcacaggtttataccaacatctaaactattttaggaaaaggctgtggagcagaacatgctgggtgtgcaactgaaacctagacctaggttcaaatctgacctctgttcttgccaagtgccaagagaaatcaattaaccccccttatccatcaatttataggaataaaggtaaatacctcaaccttgtaaggctgtgccacacacataggaccaactcaagctgtgcagcgtctggcaygcatgccacatgaggcttcctttccggggcaactggctggaccattctgggccctccagattaaaagggcccttttcaactctgctttcctgaccagagaaggcctgggacatgagccccaagctccaccactcagccctccccccaagttcactgaaagatacccccatcctgaactccaactggagccatctctctccactcccttttcagggggcagctttcaaagggtacaattcctcactctcaataaagcaatgcttcctgccttagaaaaccatcagcaagtttgtatggaaa

SEQ ID NO: 174173 - DNA, 601 bp, Human
tgtgtttaacagcccttaggaaggccaggacctggggatgagcgggccatgcttccgaggatgggggtttatgtccaaagatggccagaagacccccctatttgtacctgtgccctgcaccttcacagtgccaatgacgcagcctggggctgctgcgggtgaacagagagagaaatgggggagggagagagagagagagagagagagagagagagagagagagagagagacagagagagagagagacagagagagagagagagagagagagagagagagagagagagagagagagagagasagagagagagagagacagagagagagacagagagacacccaggcctcggagctgcccaccctgtgctactttagcctggagtcctggctacagcaaagaccaaggggctcaatctgctctggggccacctcctccctgcgccccctccatccccaccactgggtgtgtggggaatggaactgcaaagcttacaataaactcagcaagctcacctgactgagcatttaccaagccagaaagcctcctttccacgcgctgtcggtctgcaagcatggagtctagggagacactgtagaaaag

SEQ ID NO: 174174 - DNA, 601 bp, Human
ggcatcacttggttgatgtgtgtttaacagcccttaggaaggccaggacctggggatgagcgggccatgcttccgaggatgggggtttatgtccaaagatggccagaagacccccctatttgtacctgtgccctgcaccttcacagtgccaatgacgcagcctggggctgctgcgggtgaacagagagagaaatgggggagggagagagagagagagagagagagagagagagagagagagagagagacagagagagagagagacagagagagagagagagagagagagagagagagagasagagagagagagagagacagagagagagagagacagagagagagacagagagacacccaggcctcggagctgcccaccctgtgctactttagcctggagtcctggctacagcaaagaccaaggggctcaatctgctctggggccacctcctccctgcgccccctccatccccaccactgggtgtgtggggaatggaactgcaaagcttacaataaactcagcaagctcacctgactgagcatttaccaagccagaaagcctcctttccacgcgctgtcggtctgcaagcatggagtctag

SEQ ID NO: 174175 - DNA, 601 bp, Human
cgtggggtccataccattcacaatttgtacacgtgtgcatatcagtgtgtccatgtcagatgtatgtgtgcacacgtgtgagcatgcacacgtgtgagcatgtacatgtgcctgagttcagatgaataggtgaggggcattggcaacttgaagtctcaatgacaggccctctgtagttcctactttttgccaaagggttgaggtacaagcagaaggcaaaaaaggccgacgaggctgggagcagtggctcacgcctgtaatcccagcacagcaccttgggaggccaaggcaggtggatcaygcaggtggatcacttgaggtcaggagtttgagatcagcctggccaacatggtgaaaccccatctctactaaaagtagctgggtgtggcggcgggcgcctgtagtcccagctactagggaggctgaggcaggagaactgcttgaacccaggaggcggagatcgcagtgaaccgagatcgcaccactgcactccagtctgggcgacagagcgagactctgtctcaaaaaccaaacgaacaaaaaatgccaacaataccagtaacagcagcagcagtcagtaatcaatgttcaaaaagtgcct

SEQ ID NO: 174176 - DNA, 601 bp, Human
tggttaaaatgatcgtatgatacacctcccacccacgacactttgtttaattcaaactcaaataccaaagcaggagagtcgactgtttaccacacttgaatttataaatggccttcctgcccatcacccaggctgccccaccccctcccttctttcgacacagctgggtgggaatgcagtgacctaatatcactggacagataattccttgccttggggaaagactggcaaagcccacggcatctgccatttccaatctactcctcggaatggtaagtaggggcttgtgccaggacgctcrgggggcagcacagaacgcgcgcaaccgtggctggaagtgaaaatgtaaaaaccctcccacggcctcgctgggagtcactgctctgcattggaaaacccgggtgtttgattcaactaaatcatctcaaagcctgcactggagaaaataattgaattaaagagttgctataactcattcaagtgagataaaaaccatccagtgggaggcgagacggcaaggcaaagacactgctgctagaatgtgccgtcttcttgagattgcgaggagaaacgcaatataatgtggttcaaaggacagatg

SEQ ID NO: 174177 - DNA, 601 bp, Human
agcgacacccagtgagatgttcacacaaagcatggcacacacagcgccaggaaaacagcccgccttctagagtgggggggggcagcacgtgcttcctgagtttaacggtggcccatggcccatctcaggacccaacaccagccccaaccgttacgtggtgcttgaatggcactcagaacgcgcactcagtgcccagcgactccagaccccaagctgaccgttctctttactgcctcagtatctcagcccccttcatctgcactgtccaaagcctgctcaagtatcagaagctgtttccttygtcagatccatcctgcgtgctttctacatgagcatctttaacctctaatgctgggctgaaaacaactcagtgttttggaaagttaagttttctactccagcaatctgagggtggggacatccacaggaaccctggggcccacaaggagaacagaagacaggcttaatcactgaattctcactgaagaactccagcggccaaatgtcctttctaatcccgtgtgctgttctgagagaacattctagccacttctttgtatatgtgaaaaccactgcagcaggtcctattttgggcagattt

SEQ ID NO: 174178 - DNA, 601 bp, Human
cgtttaggagcaacgacttctacaacatgcccagttaccacatgagagcgacacccagtgagatgttcacacaaagcatggcacacacagcgccaggaaaacagcccgccttctagagtgggggggggcagcacgtgcttcctgagtttaacggtggcccatggcccatctcaggacccaacaccagccccaaccgttacgtggtgcttgaatggcactcagaacgcgcactcagtgcccagcgactccagaccccaagctgaccgttctctttactgcctcagtatctcagcccccttcrtctgcactgtccaaagcctgctcaagtatcagaagctgtttccttcgtcagatccatcctgcgtgctttctacatgagcatctttaacctctaatgctgggctgaaaacaactcagtgttttggaaagttaagttttctactccagcaatctgagggtggggacatccacaggaaccctggggcccacaaggagaacagaagacaggcttaatcactgaattctcactgaagaactccagcggccaaatgtcctttctaatcccgtgtgctgttctgagagaacattctagccacttctt

SEQ ID NO: 174179 - DNA, 601 bp, Human
gaaacatgaaacagtgaaatgcaaagaatgtatcataactgaatatgtatcataaactgaattacagacttaagatattttatgtttataaatgatttcatagaaaaaatatggaataataatggttatttaaaaaaaaaaaaaaaagctgaggagggccagcgtggtggctcacacctgtaatcccagcactttgggaggccaaggtggaaggatcacttgaggccaggagtttgacaccagcttgggcaacatagtgagacccgacctctaccaaaagtttaaagattagctgggcatkgtggcatatgcctgcagtctcagctatttgggaggctgaggtgggaggactgcttgagcccaggacgtcgaggctgtagtaagctgtgctggcactcaccctggacgacagagcaagatcttgtctcaaaaaaaaaaataaataaataacaaaacaaaacaaaacaaaactggggagatgggggaaaataaccaaccacactgacagcaagttggcaaagtgcttacgtctccaagcactggtccatgtaatttgcaggtactaagtcatttatcctttacaagcttataaaacaggtac

SEQ ID NO: 174180 - DNA, 601 bp, Human
ggggccaaggggccccagcagtcagcaccaatgcaatagtccttgaagatcacggccaaagctatacttgctctggacaggtaactccccctttcatgggcaggggtggtaaaaggagcaagcagaagcaaaaaggaattttcctctaaaaacagaattgctgaaaggcacttaatagagggataggggccagacacggtggctcacacctataatcccagtactttaataggaagaggctgcggtgagccgagatcatgccactgtactacagtctgggcgacagagagtccctggctcaaaaaaaaaaaaaaaaaaggttggggggatgggatttggctgaaacatgaaacagtgaaatgcaaagaatgtatcataactgaatatgtatcataaactgaattacagacttaagatattttatgtttataaatgatttcatagaaaaaatatggaataataatggttatttaaaaaaaaaaaaaaaagctgaggagggccagcgtggtggctcacacctgtaatcccagcactttgggaggccaaggtggaaggatcacttgaggccaggagtttgacaccagcttgggcaacatagtga

SEQ ID NO: 174181 - DNA, 601 bp, Human
atgagccacctgcttatggaattttgttatagtagccaaagcagactaagacaacatgctctccacttgacactgagaaagccaggccctcagggagggggctccgcctctagaacacaagttcagtgggagcgcggccactgcacctgcggatcctgaggaacagtccacgacacacacgtgcgcccacacacacgatctctgaatggatggatgactgagtctgaagagatcatgagccagccctgattcttcagccctaacttcaaccttgaaaggaaaatttgggcaatttctttctttttttttttttttttgagacagagtctcgttctgtcacccaggctagagtgcagtggtgtgatctcagctccctgcaacttccaactcctgggttcaagcgagtctcccgcctcagcctcccgagtacctgggattatagcctgccaccatgcccggttaatttttgtatttttagtagagacggggtttcgccatgttgcccaggctggtcttgaactcctgacctcaggtgattcgcccacctccagctcccaaagtgctgggattacaagcatgagccaccgcgcccggccaaggg

SEQ ID NO: 174182 - DNA, 601 bp, Human
aggatgccttgaggggcttggggaacatctcagggaagaagctgcacggagaacggtccagtcatccttctatttcgagccaacagcagccccgtggaaggaaaggtgactaaatgagaaggaatgtgactcagagggaggcgctctggaggcctctgtgcctaccccaggaggggctggcctctaggtggagtccctaccagtccggaggctcccgcccaaaccttccccatcctctctgggaagggagggcgtgaggaggtggtcccctggaagccacctccccagccctgaggttcayaccacctcagtctcaggggtccgggggtggccccagttaaaacatgggtttccagaccagtgaagcactcagaagcacagcccttctccttgcccgttctgtgtcccctggcagagggtgggtctggtatctgtgtagcaggtcctgaccccacccaagcagcagcagtgtcccagcacccccgccttcctgacccaccggcactctttcccaccaagacgccttgagatccccaaaacacgtctccactgctgccccaagtctgcccccaaaggtttggccttcgccacctgttactgc

SEQ ID NO: 174183 - DNA, 601 bp, Human
gagagcccactatgttattttattttttgtagagatgttatgtatgttgcccatgctggtcttgaacttctgagctcaagcaatcctcctgccttggcctcccaaagtcgtgggattacaggtgtgagccactgtgagcccagccggctgctgtttagaagtgcatcacaaaggatgccttgaggggcttggggaacatctcagggaagaagctgcacggagaacggtccagtcatccttctatttcgagccaacagcagccccgtggaaggaaaggtgactaaatgagaaggaatgtgaytcagagggaggcgctctggaggcctctgtgcctaccccaggaggggctggcctctaggtggagtccctaccagtccggaggctcccgcccaaaccttccccatcctctctgggaagggagggcgtgaggaggtggtcccctggaagccacctccccagccctgaggttcacaccacctcagtctcaggggtccgggggtggccccagttaaaacatgggtttccagaccagtgaagcactcagaagcacagcccttctccttgcccgttctgtgtcccctggcagagggtgggtctggta

SEQ ID NO: 174184 - DNA, 601 bp, Human
gaccataacgcaaagccctctgtttgcaccttagtccgaacaagcacccaggatacactcgctgttgtttgtttgtttgttttaaggcaggatctcactctgcctcccaggctggagtgcagtcttgacctcctggactccagccgtcctgccacgtcagcttctcaagtagctgtgactgtaggcacgcaccatcacacccagctaaagttttttttgttttgtttttttgagacggagtcttgctctgtcatccagctggagtgcagtggtgcgatctgggctcactgcaacctccgtyccctggtttaagcatttttcctgcctcagcttcccgagtagctgggattagaggcatgcgccaccacgcccagctgatttttgtattctttagtagatatggggtttcactatgttggccaggctggtctagaactcctaatctcaaatgatctgcccgccttggcctcccaaagtgctaggattacaggtgtgagccacggcgcctggccccagctacgttttttgattttttgtagagaagagagcccactatgttattttattttttgtagagatgttatgtatgttgcccatgctg

SEQ ID NO: 174185 - DNA, 601 bp, Human
gcctcggcattaccttctactccagaaaattcagctcagaagccaatgctccaggagagggtttcccagagcacaccaagcaagatttaagtgccctctctctctgagccagcacagggtccatctctctggggggttggtccccaccagactgcaagtactgggaggggatggttatccccttggctctgcagccagcggctgctgcagaacacgtgttggactaaataaagctagacttaaattctgccttcacgtcgcaagtttacatctgacaccaacaacgtaagaccaccagggycagcacgcattctcaacatactttccaaagctggaaaaaagcacagccaagtcactcagaaaagcctctcttgatttggcttctggataaaaaagagtctccctgtcgtgccagatggggtcaactactcggtgaaaacagaggcccattccacaggcaccactgctgagcctctgagttcccaggacagggctgtccgaggacacaacactgacagccatgtgcagacccccgacctgggcgaggataccgccctctgagactcagtcgcctgtctacaaaaaaggaaaagataccaca

SEQ ID NO: 174186 - DNA, 601 bp, Human
acatatgtccagcaggcctcggcattaccttctactccagaaaattcagctcagaagccaatgctccaggagagggtttcccagagcacaccaagcaagatttaagtgccctctctctctgagccagcacagggtccatctctctggggggttggtccccaccagactgcaagtactgggaggggatggttatccccttggctctgcagccagcggctgctgcagaacacgtgttggactaaataaagctagacttaaattctgccttcacgtcgcaagtttacatctgacaccaacaacrtaagaccaccagggccagcacgcattctcaacatactttccaaagctggaaaaaagcacagccaagtcactcagaaaagcctctcttgatttggcttctggataaaaaagagtctccctgtcgtgccagatggggtcaactactcggtgaaaacagaggcccattccacaggcaccactgctgagcctctgagttcccaggacagggctgtccgaggacacaacactgacagccatgtgcagacccccgacctgggcgaggataccgccctctgagactcagtcgcctgtctacaaaaaa

SEQ ID NO: 174187 - DNA, 601 bp, Human
gggctgcctcttaagtcctcgtccatgctccttacagccaatgggcagattcaccttggagatgctgcccttctggcctctctctggagaagacaaaaaactcagtaacttccccaaaaagctcctgctttatgtactgaacttgtacttcccactaaaatcaattattaataagatttaataggcctcttgcctcaggtatcatttccagctaatttttactcccccatgaggagagtatggtggctgcacaagtcacgtttgcacactgtatccatgatcattctgccagctttcctcttttttttttttttttttgaaacagtcttgctctgtcgcccaggctagagtgaagtggcatgatctcagctcactgcaacctccgcctcgtgggatcaagtgattttcgtgccttagcctcctgagtagctgcgaccacaggtgcacgccaccacacctggctaactttttgtatttttggtagagacggggtttcaccatgttggccagggtggtctcgaatgccagacctcaaatgatccgctcgcctcggcctcctgaagtgctgggattataggcgtgagcccctgcacccagcctt

SEQ ID NO: 174188 - DNA, 601 bp, Human
taggtaaagggtaattagaaattctttgttccattcttacaactcttctgtaagtctgtaattatgtcaaaagaaaaagttaaagggaaaaaaaaaatagacatgaatggccacagtgattgtgttcaagttttagaatcaagattgactgatattttcccagagaacccaaatttttgcaatgtgatttcattactctttaaggtaaactaccaaaaataaagtaagagtcacagcatgtcaggggcgcttcagatggaaagacaggcgggtcaggcagggcaaggtcccaggcctcctyctgtctctgctgttggctgctgcagaggaagtggccaccgagaacccaccctgtctctacccaggctcaagtatccaaaccccaggccagcatggtcagcgctgcccaggggcaggctctgtacctgctgctgtgtgccagagaattccacacggccacagtacagtccagaaaccagccagaaccagcccgtgggcaagggaacagacctgaaagtcacaaagcttggcgtgccctccctgatggcccaaggtcagggctggccacgccggagctgggggctgccctcctccccccagg

SEQ ID NO: 174189 - DNA, 601 bp, Human
aatccatgcatacagcagctgaagtcatcaattatttattgaatgagggaaccttagccatggcccatctggaagggccagacttaggtctcaagctgtgccctgcaggtcaacagcaggagctcttctgacctgataggagtctctgaactcaactcagggtcacaggagtgcacttttaacgttcagtggaggcaactgcacatgcgtcacctccacaaattaagggcacagcgctgcctcccacatcccatacccagacctggtatgttacgatgcacaaaatcatgtacaggacttaaaaaaaaaaaaaaggagattgagataatagctttacagtggagaaagacggactcgatcttagccaagtgatcaaagttaaccccaccaataataagataaattcacatgatgtgccctcctaatccgctgtgctgacaacaacagtgggtcctgagcattcccgcccaaagtgcccaactccaatcaggaaaaaacacaggacaaactgaactgagggccattctacaaaatgactcatctgctctcttcaaaaacatcaatgtcatggtacaaaggaggacaagaaacggttccagat

SEQ ID NO: 174190 - DNA, 601 bp, Human
ttcgatactgtacctgagcatttaagtgatcctgtcaaataaaacgttcctccaagttaactccgctgtatatttatgcacttaatatcacagcttactgcaaagtgcacaaatcattttaacagagtataaatttaactaccatgaaggcattttatactctgtttaacttcactgaggggcccatattttttggagaagataaatcatgcttccatataacttgacttaggggaacagcagtcaaaactcacaaagagaaatacacccagtttccttggattaggggtaaaaaaaaaacacacacccacaccgtcaaccaagacatctgtcacccgtacctcttaccaagcagtggtagccaccagtgcacccagcccagggcaggtgggctaagtgaggggctgggccatgagagtgcactctcctctgcccctggtcactgtcctctggccgttctggaacaatggggattgagcgctgtcgacctgacaacacccctagcatgggagggctgccacctgtgccatcttggctgtcatcattggaaacacaatctcctgtggatcttttctaaaaggagctccaggccccactgcca

SEQ ID NO: 174191 - DNA, 601 bp, Human
tttatttacaaggcattttctcacatgatgcagggagactgatttagaaattgcaatcctctctcctgtgatgaaaaccacttccacgattaagcactccatggagaagtacttacttacaagctttcctttggattctgaatgttttctgcagattttaaacagagtcggctcaccctccattcctggtaaccatgctaaatggtttcgatactgtacctgagcatttaagtgatcctgtcaaataaaacgttcctccaagttaactccgctgtatatttatgcacttaatatcacagcttactgcaaagtgcacaaatcattttaacagagtataaatttaactaccatgaaggcattttatactctgtttaacttcactgaggggcccatattttttggagaagataaatcatgcttccatataacttgacttaggggaacagcagtcaaaactcacaaagagaaatacacccagtttccttggattaggggtaaaaaaaaaacacacacccacaccgtcaaccaagacatctgtcacccgtacctcttaccaagcagtggtagccaccagtgcacccagcccagggcaggtgggcta

SEQ ID NO: 174192 - DNA, 601 bp, Human
cttaggacaagtgactattccaatggagagtttatttacaaggcattttctcacatgatgcagggagactgatttagaaattgcaatcctctctcctgtgatgaaaaccacttccacgattaagcactccatggagaagtacttacttacaagctttcctttggattctgaatgttttctgcagattttaaacagagtcggctcaccctccattcctggtaaccatgctaaatggtttcgatactgtacctgagcatttaagtgatcctgtcaaataaaacgttcctccaagttaactccrctgtatatttatgcacttaatatcacagcttactgcaaagtgcacaaatcattttaacagagtataaatttaactaccatgaaggcattttatactctgtttaacttcactgaggggcccatattttttggagaagataaatcatgcttccatataacttgacttaggggaacagcagtcaaaactcacaaagagaaatacacccagtttccttggattaggggtaaaaaaaaaacacacacccacaccgtcaaccaagacatctgtcacccgtacctcttaccaagcagtggtagccac

SEQ ID NO: 174193 - DNA, 601 bp, Human
gaatagaatcagttccacgcttaggacaagtgactattccaatggagagtttatttacaaggcattttctcacatgatgcagggagactgatttagaaattgcaatcctctctcctgtgatgaaaaccacttccacgattaagcactccatggagaagtacttacttacaagctttcctttggattctgaatgttttctgcagattttaaacagagtcggctcaccctccattcctggtaaccatgctaaatggtttcgatactgtacctgagcatttaagtgatcctgtcaaataaaacrttcctccaagttaactccgctgtatatttatgcacttaatatcacagcttactgcaaagtgcacaaatcattttaacagagtataaatttaactaccatgaaggcattttatactctgtttaacttcactgaggggcccatattttttggagaagataaatcatgcttccatataacttgacttaggggaacagcagtcaaaactcacaaagagaaatacacccagtttccttggattaggggtaaaaaaaaaacacacacccacaccgtcaaccaagacatctgtcacccgtacctctt

SEQ ID NO: 174194 - DNA, 601 bp, Human
attctcctgtaatgtcccaatatggactaaataacctattcccacaggaaaatgtattgtcattgacaatagaagaccaaaatatctataatggttgctaatttgaatagaatcagttccacgcttaggacaagtgactattccaatggagagtttatttacaaggcattttctcacatgatgcagggagactgatttagaaattgcaatcctctctcctgtgatgaaaaccacttccacgattaagcactccatggagaagtacttacttacaagctttcctttggattctgaatgtttyctgcagattttaaacagagtcggctcaccctccattcctggtaaccatgctaaatggtttcgatactgtacctgagcatttaagtgatcctgtcaaataaaacgttcctccaagttaactccgctgtatatttatgcacttaatatcacagcttactgcaaagtgcacaaatcattttaacagagtataaatttaactaccatgaaggcattttatactctgtttaacttcactgaggggcccatattttttggagaagataaatcatgcttccatataacttgacttaggggaacagca

SEQ ID NO: 174195 - DNA, 601 bp, Human
actaaaaatacaaaaaaaaaaaaacgagccgggcatggtgacgagtgcctgtaatgccagctactcgggaggctaaggcacgagaattgcttgaacccaggaggcaaaggttgcagtgagtcaagatcatgccactgcactcctgcctgggtgacagagtgagaccttgtctcgaggaaaaaaaaaaaaaaaaaaaaggtggaaaaaccagcccctgatgggccaccaggagctttcgggagcctgcccgggatatcacccggctccaccatgtgtgacgctcctgctctaaagtacacgraggacacagggcacagcgcctttcacagccactggctcacatgccagtccacggttcccagcggtggcggcattcctctccagggaggaaaatgctacagaatattcaccaccggtcaattcatctgcccggttggatctccttccaaacttaaaatctagggattcagtcctgcgaatgccatactccgcattctccttacacagattgagatcaacagtgggttggtttcaataagatatgaagaaacaatgaggcaagaccattttgaaacagcccattatacatacagaaaatcca

SEQ ID NO: 174196 - DNA, 601 bp, Human
gttctttctttttcctgctgtgttttcctaccattcattacaaattttagaccaatcaaaaaatttggaataaccaggcctggcacggtggctcgtgcttgtaatcccagcattctgggaggctgaggcgggcagatcattttggggtcaggagttcaagaccagcctggccaacatggtgaaaccctgtctctactaaaaatacaaaaaaaaaaaaacgagccgggcatggtgacgagtgcctgtaatgccagctactcgggaggctaaggcacgagaattgcttgaacccaggaggcaraggttgcagtgagtcaagatcatgccactgcactcctgcctgggtgacagagtgagaccttgtctcgaggaaaaaaaaaaaaaaaaaaaaggtggaaaaaccagcccctgatgggccaccaggagctttcgggagcctgcccgggatatcacccggctccaccatgtgtgacgctcctgctctaaagtacacggaggacacagggcacagcgcctttcacagccactggctcacatgccagtccacggttcccagcggtggcggcattcctctccagggaggaaaatgctacagaatatt

SEQ ID NO: 174197 - DNA, 601 bp, Human
gcttaatctgacccttaccaataataatgttctttctttttcctgctgtgttttcctaccattcattacaaattttagaccaatcaaaaaatttggaataaccaggcctggcacggtggctcgtgcttgtaatcccagcattctgggaggctgaggcgggcagatcattttggggtcaggagttcaagaccagcctggccaacatggtgaaaccctgtctctactaaaaatacaaaaaaaaaaaaacgagccgggcatggtgacgagtgcctgtaatgccagctactcgggaggctaaggmacgagaattgcttgaacccaggaggcaaaggttgcagtgagtcaagatcatgccactgcactcctgcctgggtgacagagtgagaccttgtctcgaggaaaaaaaaaaaaaaaaaaaaggtggaaaaaccagcccctgatgggccaccaggagctttcgggagcctgcccgggatatcacccggctccaccatgtgtgacgctcctgctctaaagtacacggaggacacagggcacagcgcctttcacagccactggctcacatgccagtccacggttcccagcggtggcggcattcctc

SEQ ID NO: 174198 - DNA, 601 bp, Human
gcggagcaatcaccggatcctgtagagatggccaaagccaggaggacttcttcagatacctctagggactcatgactctcacccagggcttaatctgacccttaccaataataatgttctttctttttcctgctgtgttttcctaccattcattacaaattttagaccaatcaaaaaatttggaataaccaggcctggcacggtggctcgtgcttgtaatcccagcattctgggaggctgaggcgggcagatcattttggggtcaggagttcaagaccagcctggccaacatggtgaaacmctgtctctactaaaaatacaaaaaaaaaaaaacgagccgggcatggtgacgagtgcctgtaatgccagctactcgggaggctaaggcacgagaattgcttgaacccaggaggcaaaggttgcagtgagtcaagatcatgccactgcactcctgcctgggtgacagagtgagaccttgtctcgaggaaaaaaaaaaaaaaaaaaaaggtggaaaaaccagcccctgatgggccaccaggagctttcgggagcctgcccgggatatcacccggctccaccatgtgtgacgctcctgctctaa

SEQ ID NO: 174199 - DNA, 601 bp, Human
gaggttctaggacatatttcctaggcgaagataggtccaagaagattatttttgtctacagcctgctagaaacaaggtcttatcaattattattgattacaaagccacttcgtcacctcaaactgcctgttctgtggcaaccccaagattgttctacttccacagcctttttttttttttaaacccaacacacactggccatttcctcacaaattctaccagggttgacttcaaagtgtcggggggaaagtgctgttttgagttgacacgaggtcacagacaagccaagctgcgatggttrgggacagctctggaggcggagcaatcaccggatcctgtagagatggccaaagccaggaggacttcttcagatacctctagggactcatgactctcacccagggcttaatctgacccttaccaataataatgttctttctttttcctgctgtgttttcctaccattcattacaaattttagaccaatcaaaaaatttggaataaccaggcctggcacggtggctcgtgcttgtaatcccagcattctgggaggctgaggcgggcagatcattttggggtcaggagttcaagaccagcctgg

SEQ ID NO: 174200 - DNA, 601 bp, Human
gccgagatcgcgcctctgcactccagcctgggcgacagagcgagactccgtctcaaaaaaaaaaaaaaaaaaacctttctcatgggaggatgggcttgggcgttgagatcaacagaggagggaggttctaggacatatttcctaggcgaagataggtccaagaagattatttttgtctacagcctgctagaaacaaggtcttatcaattattattgattacaaagccacttcgtcacctcaaactgcctgttctgtggcaaccccaagattgttctacttccacagccttttttttttttwaaacccaacacacactggccatttcctcacaaattctaccagggttgacttcaaagtgtcggggggaaagtgctgttttgagttgacacgaggtcacagacaagccaagctgcgatggttggggacagctctggaggcggagcaatcaccggatcctgtagagatggccaaagccaggaggacttcttcagatacctctagggactcatgactctcacccagggcttaatctgacccttaccaataataatgttctttctttttcctgctgtgttttcctaccattcattacaaatttta

SEQ ID NO: 174201 - DNA, 601 bp, Human
agccgagatcgcgcctctgcactccagcctgggcgacagagcgagactccgtctcaaaaaaaaaaaaaaaaaaacctttctcatgggaggatgggcttgggcgttgagatcaacagaggagggaggttctaggacatatttcctaggcgaagataggtccaagaagattatttttgtctacagcctgctagaaacaaggtcttatcaattattattgattacaaagccacttcgtcacctcaaactgcctgttctgtggcaaccccaagattgttctacttccacagcctttttttttttwtaaacccaacacacactggccatttcctcacaaattctaccagggttgacttcaaagtgtcggggggaaagtgctgttttgagttgacacgaggtcacagacaagccaagctgcgatggttggggacagctctggaggcggagcaatcaccggatcctgtagagatggccaaagccaggaggacttcttcagatacctctagggactcatgactctcacccagggcttaatctgacccttaccaataataatgttctttctttttcctgctgtgttttcctaccattcattacaaatttt

SEQ ID NO: 174202 - DNA, 601 bp, Human
agcttgtagtgagccgagatcgcgcctctgcactccagcctgggcgacagagcgagactccgtctcaaaaaaaaaaaaaaaaaaacctttctcatgggaggatgggcttgggcgttgagatcaacagaggagggaggttctaggacatatttcctaggcgaagataggtccaagaagattatttttgtctacagcctgctagaaacaaggtcttatcaattattattgattacaaagccacttcgtcacctcaaactgcctgttctgtggcaaccccaagattgttctacttccacagcctttttttttttttaaacccaacacacactggccatttcctcacaaattctaccagggttgacttcaaagtgtcggggggaaagtgctgttttgagttgacacgaggtcacagacaagccaagctgcgatggttggggacagctctggaggcggagcaatcaccggatcctgtagagatggccaaagccaggaggacttcttcagatacctctagggactcatgactctcacccagggcttaatctgacccttaccaataataatgttctttctttttcctgctgtgttttcctaccattca

SEQ ID NO: 174203 - DNA, 601 bp, Human
gatttcagcacctggtattcaaagttatcttaggttgtggcttaagcagccaagtctgacttcagattcagccctgggtggtgctgatggggggaggtgggggctgctctgaccccttcatcacaattcccataagaacctttctcaggccgggcgcggtggctcacgcctgtaatcccagcactttgggaggccaagacgggcagatcacgaggtcaggagatcgacaccatcctggctaacacggtgaaaccccgtctctactaaaaatacaaaaaattagccaggcatggtggcaggsgcctgtagtcccagttactctggaggctgaggcaggagaatggcatgaacctggcaggcggagcttgtagtgagccgagatcgcgcctctgcactccagcctgggcgacagagcgagactccgtctcaaaaaaaaaaaaaaaaaaacctttctcatgggaggatgggcttgggcgttgagatcaacagaggagggaggttctaggacatatttcctaggcgaagataggtccaagaagattatttttgtctacagcctgctagaaacaaggtcttatcaattattattgattacaaagcc

SEQ ID NO: 174204 - DNA, 601 bp, Human
tataaattactcattctgtggtattctgttacagcagcacaaaatggactaagacacggtaagaaaaaaatccagacaaagcaatttttagaacaggcaaaagacttgacaggaacttaagagaatacccaaatagccaatgaaaaggtatctaatatgcaccaggaaaatatagattaaaacgtgctgaggttctactacaaatgcaccagaattgccaaatgcagaggataatgctaagaattgccaaagctgtggaacacaactcccatgcgcagctggcaggagtggaaattggtayaactcttctagaaaaccaccaggcggtttctaccaaagctgagcatgtgtatcccaatgggccagcaatcttcttctaggtatgtgctcaacagacatgcgtgtagcacatgtgcaccaaatgacatgatcatggcagcagcatccctaacagctcaaagctacaaatcccaaatgaccacgcacagaatgggtgtataatctgtgctatcatcacacaatggaaccgtacacagaaatgaactactccctccctccctcccatgaggagcctcctctattcctttcttttcccaagctc

SEQ ID NO: 174205 - DNA, 601 bp, Human
ttcattataaattactcattctgtggtattctgttacagcagcacaaaatggactaagacacggtaagaaaaaaatccagacaaagcaatttttagaacaggcaaaagacttgacaggaacttaagagaatacccaaatagccaatgaaaaggtatctaatatgcaccaggaaaatatagattaaaacgtgctgaggttctactacaaatgcaccagaattgccaaatgcagaggataatgctaagaattgccaaagctgtggaacacaactcccatgcgcagctggcaggagtggaaatyggtacaactcttctagaaaaccaccaggcggtttctaccaaagctgagcatgtgtatcccaatgggccagcaatcttcttctaggtatgtgctcaacagacatgcgtgtagcacatgtgcaccaaatgacatgatcatggcagcagcatccctaacagctcaaagctacaaatcccaaatgaccacgcacagaatgggtgtataatctgtgctatcatcacacaatggaaccgtacacagaaatgaactactccctccctccctcccatgaggagcctcctctattcctttcttttccca

SEQ ID NO: 174206 - DNA, 601 bp, Human
gaatgtcctaaggatcttgggtagacaacggtgatctaagacacaaatgcatcaaccataaaatctaagactagccatcataaaaagcttctgctcatcaaaaagattatagagtgacaatacaaagtaagaacatatttcagtaaaaatatgcaacaatggtcttccatctagaatatatcaagaatttctacagttccagtataccacagttcgcatatggcccccaagaagagtatgctggaaacttaatcccccatcattctgggaggtggggcgttaatgaggtgattaggccatkaggctctacccccattaatgaatcaatgctgttatcgtgcgagtgggttccttataaaaaggtgaattttattcccttttctctttctcctctctctttgccccttggtcagggaatgacacaccaagaagaccctcgccagatgccaaccttgtgatcttggacttcccaacctcaaaaactgcaagccaatttctattcattataaattactcattctgtggtattctgttacagcagcacaaaatggactaagacacggtaagaaaaaaatccagacaaagcaatttttagaacagg

SEQ ID NO: 174207 - DNA, 601 bp, Human
tacgacttccacaggcggagccgagaaaacaataataggtgggaacctggactcctaactgacgccaggcagactcaataaagtaaaccaaacttttaaaagaaaacaaaggagaatgtcctaaggatcttgggtagacaacggtgatctaagacacaaatgcatcaaccataaaatctaagactagccatcataaaaagcttctgctcatcaaaaagattatagagtgacaatacaaagtaagaacatatttcagtaaaaatatgcaacaatggtcttccatctagaatatatcaagaayttctacagttccagtataccacagttcgcatatggcccccaagaagagtatgctggaaacttaatcccccatcattctgggaggtggggcgttaatgaggtgattaggccatgaggctctacccccattaatgaatcaatgctgttatcgtgcgagtgggttccttataaaaaggtgaattttattcccttttctctttctcctctctctttgccccttggtcagggaatgacacaccaagaagaccctcgccagatgccaaccttgtgatcttggacttcccaacctcaaaaactgcaa

SEQ ID NO: 174208 - DNA, 601 bp, Human
tttcttcaatggcttctgcatctctcttttttttgagatggagtctccctctgtcgccaggctggagtgcagtgacgccatcttggctcaccgcagcctcccgagttcaattgaccaggttcaagcgattctcctgcctcaggctcctgagtaactggaattacaagcgtgcaccaccacacccagctatattttgtatttttagtagagacagggcttcaccatgttggccaggctggtcaactcttgacctcaagtgatccgcccgccttggccccccaaagtgctgggattacaggcrtgagccatcatgcatggctggtttctgcacctctttcaaatgggatttattttttaaagtaagataaacatgttaataaaattggaaaccgatttgtacgtggcaaacaatttttaggtggaaagtcaactgccttgattcatataggcatttatacaaattgttatggctatagcagctaagtttcaccaaaaagaaagatacaagtaaatttctcttagaacatagtgaagttcaccaggactggacacataaaatggccagcatctctgcgtgctgccccccggaaagggtccggac

SEQ ID NO: 174209 - DNA, 601 bp, Human
gaagctcaaaaacacgatgagatttcttcaatggcttctgcatctctcttttttttgagatggagtctccctctgtcgccaggctggagtgcagtgacgccatcttggctcaccgcagcctcccgagttcaattgaccaggttcaagcgattctcctgcctcaggctcctgagtaactggaattacaagcgtgcaccaccacacccagctatattttgtatttttagtagagacagggcttcaccatgttggccaggctggtcaactcttgacctcaagtgatccgcccgccttggccccmcaaagtgctgggattacaggcgtgagccatcatgcatggctggtttctgcacctctttcaaatgggatttattttttaaagtaagataaacatgttaataaaattggaaaccgatttgtacgtggcaaacaatttttaggtggaaagtcaactgccttgattcatataggcatttatacaaattgttatggctatagcagctaagtttcaccaaaaagaaagatacaagtaaatttctcttagaacatagtgaagttcaccaggactggacacataaaatggccagcatctctgcgtgct

SEQ ID NO: 174210 - DNA, 601 bp, Human
ccactcacccatgcaaccaccgcctgctgagaggggaaacagaggcagcgaggggcaggctccctgctctgggaagggaaggagcatttgcgggaaggcccaagaacatgagagcctggttgaaggccactggacggcccttggcactggactagggggccagccagggattcagggatgatggaaaaaccaggaaatattaataaaatgcagaacacttgctgtgtgctcctgatggaggaagcagcaaagccggctaacaaattggtcattggtacagtgagcctgagcccaagtgggwcaggaaattaatccaacatgctgaagacctgagttccaactgctggaacaaggcgaaggggtcccaccccaaaagtgaagtaagacctgaaagatggcagtaaaaacttacaagatgcaaattaaaacagagctaatggtgatgacagctggccaaggaacaggagaatggaccagtccgccaggttttgaagagcttttttagaaagcaaggctgactagagccagtgaagaataaaacgcttagaagaaagacagtaactctctaaaaccatagttaatggtccaatggttcttcctt

SEQ ID NO: 174211 - DNA, 601 bp, Human
aaaatttttctaaaataaaaactttttaaccaaagaaaaaaagaaaatcacccacttccctcacactgcattcctgcaaagacaaaatgccccgtatgcggtgattgcttccctccccaattctgagcagatgctgctctctgttgcatggaagcatattccaggcacatccagatgctcccgagccgtgtgccagggctgccacgacctcgtatctgtgccccactcacccatgcaaccaccgcctgctgagaggggaaacagaggcagcgaggggcaggctccctgctctgggaagggraggagcatttgcgggaaggcccaagaacatgagagcctggttgaaggccactggacggcccttggcactggactagggggccagccagggattcagggatgatggaaaaaccaggaaatattaataaaatgcagaacacttgctgtgtgctcctgatggaggaagcagcaaagccggctaacaaattggtcattggtacagtgagcctgagcccaagtgggacaggaaattaatccaacatgctgaagacctgagttccaactgctggaacaaggcgaaggggtcccaccccaaaagtga

SEQ ID NO: 174212 - DNA, 601 bp, Human
cagtgagactcaatttctaaaaaatgataatgataataataataataatgattaccaattttaatacggaaaactgggtgtgaggtatatgaaatctgtattatcatcacaatttttatgtaaatctaaaattttttctattttttgagagggagtctcgttctgttgcccaggctggagtgcagtggtgtgatctcagctcactgcagcctccgcttctggagttcaagtgattctcctgcctcagcctcccaagttgctgggattacaggcatctgccgccacgcccggctaattttgtatttttagtagaggcaggatttcacgttggccaggctgctctcagtctcccaaagtgccaggattacgggtgcgagccaccatgcttggcctaaaatttttctaaaataaaaactttttaaccaaagaaaaaaagaaaatcacccacttccctcacactgcattcctgcaaagacaaaatgccccgtatgcggtgattgcttccctccccaattctgagcagatgctgctctctgttgcatggaagcatattccaggcacatccagatgctcccgagccgtgtgccagggctgccacgac

SEQ ID NO: 174213 - DNA, 601 bp, Human
atcgtgccactgcactccagcctgagtgacagagagactctgtctcaaacaaacaaacaaaaaacaaatgtatcgtactaatgtaagatgttaattatagggaaaggccaggtggggtggctcatgcctgtaatcccagagctttgggaggctgagccggcaggatagcttgagtccagaaactacagacttcagcgagctatgatggggccactacattccagcctgggtgacagtgagactcaatttctaaaaaatgataatgataataataataataatgattaccaattttaatacrgaaaactgggtgtgaggtatatgaaatctgtattatcatcacaatttttatgtaaatctaaaattttttctattttttgagagggagtctcgttctgttgcccaggctggagtgcagtggtgtgatctcagctcactgcagcctccgcttctggagttcaagtgattctcctgcctcagcctcccaagttgctgggattacaggcatctgccgccacgcccggctaattttgtatttttagtagaggcaggatttcacgttggccaggctgctctcagtctcccaaagtgccaggattac

SEQ ID NO: 174214 - DNA, 601 bp, Human
cacacataaccccatcccctttctctcaaaatagcaagttataaaaatctagaaagtagagaacattttatttgcagtttggataacctaaggtttactgagcaatgaaactgagaatgtttccactaacacacaggccacaggtttcagggcagcaggaaggccaggaaggagcaagtgtcctggaggtggcagctttgtctctataccacaccacagatgctggctgtcccggaacaagatggccagggtgcaaaggtcttagtgccatggccgagacaactactgggtttcccagtgyggtcccttgggtgagggagctgcagaggactcatcagcaccctatgcagaggggtttctgagcacaggaccaggccctggaaggtgggagtcttgagaccagcagggctgcaggaggtactccctgagtcacctattcccttgcaacttggaggtcagggttgctttgccctgctgggggaatctgcccctgctgtctccgaggccccactctcccctcagccagctggagcaccgggttctcctttggatcctgacacgcgaccttagacaacttattttactgctgatcctcccatcg

SEQ ID NO: 174215 - DNA, 601 bp, Human
caaactacgtagacagggagttatataaaccaaaagaaaatgttaatttgcacacataaccccatcccctttctctcaaaatagcaagttataaaaatctagaaagtagagaacattttatttgcagtttggataacctaaggtttactgagcaatgaaactgagaatgtttccactaacacacaggccacaggtttcagggcagcaggaaggccaggaaggagcaagtgtcctggaggtggcagctttgtctctataccacaccacagatgctggctgtcccggaacaagatggccaggstgcaaaggtcttagtgccatggccgagacaactactgggtttcccagtgtggtcccttgggtgagggagctgcagaggactcatcagcaccctatgcagaggggtttctgagcacaggaccaggccctggaaggtgggagtcttgagaccagcagggctgcaggaggtactccctgagtcacctattcccttgcaacttggaggtcagggttgctttgccctgctgggggaatctgcccctgctgtctccgaggccccactctcccctcagccagctggagcaccgggttctcctttgga

SEQ ID NO: 174216 - DNA, 601 bp, Human
caatttcaccatgcggcccaggcccacagactccagaggattttgggaagcttcacagctgcaccagagttctgccccacgaccatcctgatctgcgaaggacacgtccattctgaccacagatgttcactgagcctctgctaggcacagggtgaacaccatacaatgaccattcccaaattcaggagtgtgaaacttcatctacattaaagaattcaaactacgtagacagggagttatataaaccaaaagaaaatgttaatttgcacacataaccccatcccctttctctcaaaatagyaagttataaaaatctagaaagtagagaacattttatttgcagtttggataacctaaggtttactgagcaatgaaactgagaatgtttccactaacacacaggccacaggtttcagggcagcaggaaggccaggaaggagcaagtgtcctggaggtggcagctttgtctctataccacaccacagatgctggctgtcccggaacaagatggccagggtgcaaaggtcttagtgccatggccgagacaactactgggtttcccagtgtggtcccttgggtgagggagctgcagaggactcat

SEQ ID NO: 174217 - DNA, 601 bp, Human
ctctggtgccaagcaacaacggatgaatacccactacctccagacagtcagatgggcctcaactcagccccaacaagcagccagaaagcaaagcgaggaagatgacagccaatttcaccatgcggcccaggcccacagactccagaggattttgggaagcttcacagctgcaccagagttctgccccacgaccatcctgatctgcgaaggacacgtccattctgaccacagatgttcactgagcctctgctaggcacagggtgaacaccatacaatgaccattcccaaattcaggagtgtkaaacttcatctacattaaagaattcaaactacgtagacagggagttatataaaccaaaagaaaatgttaatttgcacacataaccccatcccctttctctcaaaatagcaagttataaaaatctagaaagtagagaacattttatttgcagtttggataacctaaggtttactgagcaatgaaactgagaatgtttccactaacacacaggccacaggtttcagggcagcaggaaggccaggaaggagcaagtgtcctggaggtggcagctttgtctctataccacaccacagatgctgg

SEQ ID NO: 174218 - DNA, 601 bp, Human
ccacaggatctacctgccctctggtgccaagcaacaacggatgaatacccactacctccagacagtcagatgggcctcaactcagccccaacaagcagccagaaagcaaagcgaggaagatgacagccaatttcaccatgcggcccaggcccacagactccagaggattttgggaagcttcacagctgcaccagagttctgccccacgaccatcctgatctgcgaaggacacgtccattctgaccacagatgttcactgagcctctgctaggcacagggtgaacaccatacaatgaccatycccaaattcaggagtgtgaaacttcatctacattaaagaattcaaactacgtagacagggagttatataaaccaaaagaaaatgttaatttgcacacataaccccatcccctttctctcaaaatagcaagttataaaaatctagaaagtagagaacattttatttgcagtttggataacctaaggtttactgagcaatgaaactgagaatgtttccactaacacacaggccacaggtttcagggcagcaggaaggccaggaaggagcaagtgtcctggaggtggcagctttgtctctata

SEQ ID NO: 174219 - DNA, 601 bp, Human
aaccctcattctctttctctcaaagcagtaagttatagcaagtgtcagctgtcagtctgtgcacgtagcctttagttcaaggaaggccctgacctgtacactgacccaagcatcaagtcccatgggcagggcccatggtgggactccctgacccgcgtcattctgtgccctcacctctgaagccgccaagtgcagtgtctgcccaagaagccaccgggctgcagacccagggcgggtccgatgtataccctaggaggcacccccaatttcacctctccttggtgggcctctcacctgtccrcttgccacaggatctacctgccctctggtgccaagcaacaacggatgaatacccactacctccagacagtcagatgggcctcaactcagccccaacaagcagccagaaagcaaagcgaggaagatgacagccaatttcaccatgcggcccaggcccacagactccagaggattttgggaagcttcacagctgcaccagagttctgccccacgaccatcctgatctgcgaaggacacgtccattctgaccacagatgttcactgagcctctgctaggcacagggtgaacaccatacaatga

SEQ ID NO: 174220 - DNA, 601 bp, Human
aaaatatactatcataatcaaaactgtcaaggtcatcaaaaataaggaaagactgtgaaactgccaccgccatgtggggcctaaggagaaagacagtgacatacaaggtgaaaaactggacaggattctgggatggaaaaaggatattagatcatcagaatacaatgtagacttcagttaatattaatgtattgataattggttcattaattttaataaatgtctcatactaatgtaatgtcaaatgataataaggaaactaggtgaggagatacggaactctccatgtaaccttctagaygtttctgtaaatcaaactgttcttaaaaatatccatttagaagggaaaaaactgcttttatatatgccatttatcaaacttcttatcttaccatctcaaaacccaggcaaaggatataatgtaaaccaaaatatgagagaaatcaaaggaaaatattaatggcacgcataaccctcattctctttctctcaaagcagtaagttatagcaagtgtcagctgtcagtctgtgcacgtagcctttagttcaaggaaggccctgacctgtacactgacccaagcatcaagtcccatgggcaggg

SEQ ID NO: 174221 - DNA, 601 bp, Human
ggcgattcattattggccggcaaaggcttacacttttttctttcaagaatttttttatttagagattacacaaaaaaagtcttctgtgaaacccataacccagtccaggaatgagaaaaacatcacacaaactgcagtagagggacaatccacaaaatatactatcataatcaaaactgtcaaggtcatcaaaaataaggaaagactgtgaaactgccaccgccatgtggggcctaaggagaaagacagtgacatacaaggtgaaaaactggacaggattctgggatggaaaaaggatatyagatcatcagaatacaatgtagacttcagttaatattaatgtattgataattggttcattaattttaataaatgtctcatactaatgtaatgtcaaatgataataaggaaactaggtgaggagatacggaactctccatgtaaccttctagacgtttctgtaaatcaaactgttcttaaaaatatccatttagaagggaaaaaactgcttttatatatgccatttatcaaacttcttatcttaccatctcaaaacccaggcaaaggatataatgtaaaccaaaatatgagagaaatcaaa

SEQ ID NO: 174222 - DNA, 601 bp, Human
ctgatggacaaccagacaccccccacgtccacctgctatgtggggcgattcattattggccggcaaaggcttacacttttttctttcaagaatttttttatttagagattacacaaaaaaagtcttctgtgaaacccataacccagtccaggaatgagaaaaacatcacacaaactgcagtagagggacaatccacaaaatatactatcataatcaaaactgtcaaggtcatcaaaaataaggaaagactgtgaaactgccaccgccatgtggggcctaaggagaaagacagtgacatacraggtgaaaaactggacaggattctgggatggaaaaaggatattagatcatcagaatacaatgtagacttcagttaatattaatgtattgataattggttcattaattttaataaatgtctcatactaatgtaatgtcaaatgataataaggaaactaggtgaggagatacggaactctccatgtaaccttctagacgtttctgtaaatcaaactgttcttaaaaatatccatttagaagggaaaaaactgcttttatatatgccatttatcaaacttcttatcttaccatctcaaaaccc

SEQ ID NO: 174223 - DNA, 601 bp, Human
ccagtgtgtgcgacgtgcctcttcctatctcccctgggcagtcttcccagctccatggaaaagtctttggtcagctgaacgcaggcaaggctgctgaattcctaaagtccccgcctgaccaccaggcccaggtataagggaagggcgactcctactgatggacaaccagacaccccccacgtccacctgctatgtggggcgattcattattggccggcaaaggcttacacttttttctttcaagaatttttttatttagagattacacaaaaaaagtcttctgtgaaacccataacccagyccaggaatgagaaaaacatcacacaaactgcagtagagggacaatccacaaaatatactatcataatcaaaactgtcaaggtcatcaaaaataaggaaagactgtgaaactgccaccgccatgtggggcctaaggagaaagacagtgacatacaaggtgaaaaactggacaggattctgggatggaaaaaggatattagatcatcagaatacaatgtagacttcagttaatattaatgtattgataattggttcattaattttaataaatgtctcatactaatgtaatgtcaaatgataa

SEQ ID NO: 174224 - DNA, 601 bp, Human
gcccagtgtgtgcgacgtgcctcttcctatctcccctgggcagtcttcccagctccatggaaaagtctttggtcagctgaacgcaggcaaggctgctgaattcctaaagtccccgcctgaccaccaggcccaggtataagggaagggcgactcctactgatggacaaccagacaccccccacgtccacctgctatgtggggcgattcattattggccggcaaaggcttacacttttttctttcaagaatttttttatttagagattacacaaaaaaagtcttctgtgaaacccataacccwgtccaggaatgagaaaaacatcacacaaactgcagtagagggacaatccacaaaatatactatcataatcaaaactgtcaaggtcatcaaaaataaggaaagactgtgaaactgccaccgccatgtggggcctaaggagaaagacagtgacatacaaggtgaaaaactggacaggattctgggatggaaaaaggatattagatcatcagaatacaatgtagacttcagttaatattaatgtattgataattggttcattaattttaataaatgtctcatactaatgtaatgtcaaatgat

SEQ ID NO: 174225 - DNA, 601 bp, Human
taggagcacactgccagctcttgtggccagccccagtggaaaagaaatcccactaaatttacatccattcgtgctccatatgaagaagctgagggtcactgtcctcttctagctatttcattcagctggctttccagtctatcagaaaaatgccatcatcggctgggtgtggtgactctcacctataatcccaacactttgggaggctgaggtgggcggatagcttgagcctaggatagcttgagaccagcctgggcaacatggcgaaaccctgtcctaagaaaaatacaaaatttagccyggcttggtggcatgcgcctgtaatcccagctacccaggtggctgaggtgggaggatcgcttgagcccagaaggcagaggttacagtgagccctgattgtgccatggcactctagccaaaaaaaaaaaaagccgtcatcttcttgatggtgaactccctctaatgctcaggctgatgtcctaacacccaggacaacgtctgagtgaccagtggctcttggctgagggatgtgagctatgagcccctacatcacagcttctgttaacatggcgatggctaggcacaggcagccacccctcta

SEQ ID NO: 174226 - DNA, 601 bp, Human
ctcactgtaggagcacactgccagctcttgtggccagccccagtggaaaagaaatcccactaaatttacatccattcgtgctccatatgaagaagctgagggtcactgtcctcttctagctatttcattcagctggctttccagtctatcagaaaaatgccatcatcggctgggtgtggtgactctcacctataatcccaacactttgggaggctgaggtgggcggatagcttgagcctaggatagcttgagaccagcctgggcaacatggcgaaaccctgtcctaagaaaaatacaaaawttagcccggcttggtggcatgcgcctgtaatcccagctacccaggtggctgaggtgggaggatcgcttgagcccagaaggcagaggttacagtgagccctgattgtgccatggcactctagccaaaaaaaaaaaaagccgtcatcttcttgatggtgaactccctctaatgctcaggctgatgtcctaacacccaggacaacgtctgagtgaccagtggctcttggctgagggatgtgagctatgagcccctacatcacagcttctgttaacatggcgatggctaggcacaggcagccac

SEQ ID NO: 174227 - DNA, 601 bp, Human
tgaaggctgcggggaggttctgggacagcagacacccgctggcagcacgcagcagaactcagcgcgaggggttagagttagggttagggtcgctgccatcagtaataaaaaatacggagggaccgggtgcggtagctcacacctataatcccagcactttgggaagccaaggcagctggatcacctgaggtcagtttaagaccagcctggtcaacatgatgaaacctcctctctactaaaaatacaaaaaattagccgggtgcggtggcacacgcctgtaatcccagctactcaggagggytgaggcaggataatctcttgaacctgggagatggaggttgcactgagctgagattgcgccactgggcgcctgggcaacaaagcgagactctatctcaaaaaaataaaataaaataaaaaataaaccactgagggcacccaaggaacaacatctgctgtgcacccgttttcctaatggccccaagagaggctggctgaacagacaactatgctcagatgatctttctggcgttccagtgagcaggctgggcctccacaggaagagagctcagccaaagaaaggacagctccccagcagcga

SEQ ID NO: 174228 - DNA, 601 bp, Human
tcaattgctaaaccgagagggcccttagcgactgctcccaccagggctggagaagcagaacccagcggactcaaaacggtgcctacaggggaaaacggggtgagcaggggacgactgagtccagcctcggttctggactactagaaagaggtgcccctgaatggggggacacaggggtgctctcaaaactcagcaaatgttagtccttttattttaggaaaatacactgaactatttgttgatgtaatagaagctagggtttactgtataatggcctagtagggtgtgtctgtaagagaaygcacgtgaaatgagggtgatgaggacatctgcttttttaagtctgtcctgtttaaagctctaacactgtaacgtggggacagtgccacccactctgaaggctgcggggaggttctgggacagcagacacccgctggcagcacgcagcagaactcagcgcgaggggttagagttagggttagggtcgctgccatcagtaataaaaaatacggagggaccgggtgcggtagctcacacctataatcccagcactttgggaagccaaggcagctggatcacctgaggtcagtttaagaccagc

SEQ ID NO: 174229 - DNA, 601 bp, Human
gccaaagacacagctggggtggaggtgggaccaaagccgggtagcccagggatcgtccacgccctgagtttgtgatggacctaaactcctgtgtgtttcacttcctgtttcaattgctaaaccgagagggcccttagcgactgctcccaccagggctggagaagcagaacccagcggactcaaaacggtgcctacaggggaaaacggggtgagcaggggacgactgagtccagcctcggttctggactactagaaagaggtgcccctgaatggggggacacaggggtgctctcaaaactcwgcaaatgttagtccttttattttaggaaaatacactgaactatttgttgatgtaatagaagctagggtttactgtataatggcctagtagggtgtgtctgtaagagaacgcacgtgaaatgagggtgatgaggacatctgcttttttaagtctgtcctgtttaaagctctaacactgtaacgtggggacagtgccacccactctgaaggctgcggggaggttctgggacagcagacacccgctggcagcacgcagcagaactcagcgcgaggggttagagttagggttagggtcgctgcc

SEQ ID NO: 174230 - DNA, 601 bp, Human
cagcatcctggacctgtgagctggcctgcattcctgggttctcagatgcacctcggtgaggtgccacctcctcacggtcactgcaactgtcacacccttactgagaggagcagctgtagcaataagcaggctccccggctcacggcatcctggacactgttcccgtcactttgcatgaattcactcattcctcccaacagtcttaggaaccaggtatgctttcctcatctaaaatgactaaacagaggcccagggtagaaaacaactggccaaagacacagctggggtggaggtgggaccraagccgggtagcccagggatcgtccacgccctgagtttgtgatggacctaaactcctgtgtgtttcacttcctgtttcaattgctaaaccgagagggcccttagcgactgctcccaccagggctggagaagcagaacccagcggactcaaaacggtgcctacaggggaaaacggggtgagcaggggacgactgagtccagcctcggttctggactactagaaagaggtgcccctgaatggggggacacaggggtgctctcaaaactcagcaaatgttagtccttttattttaggaaaata

SEQ ID NO: 174231 - DNA, 601 bp, Human
gagctggtaccacaggccagacggagcccccgtgcagcatcctggacctgtgagctggcctgcattcctgggttctcagatgcacctcggtgaggtgccacctcctcacggtcactgcaactgtcacacccttactgagaggagcagctgtagcaataagcaggctccccggctcacggcatcctggacactgttcccgtcactttgcatgaattcactcattcctcccaacagtcttaggaaccaggtatgctttcctcatctaaaatgactaaacagaggcccagggtagaaaacaackggccaaagacacagctggggtggaggtgggaccaaagccgggtagcccagggatcgtccacgccctgagtttgtgatggacctaaactcctgtgtgtttcacttcctgtttcaattgctaaaccgagagggcccttagcgactgctcccaccagggctggagaagcagaacccagcggactcaaaacggtgcctacaggggaaaacggggtgagcaggggacgactgagtccagcctcggttctggactactagaaagaggtgcccctgaatggggggacacaggggtgctctcaaaact

SEQ ID NO: 174232 - DNA, 601 bp, Human
gcaggcaggatacacacactccccctccaccccagatgccttcagaagagtgtgccattggctctaaggagcccaggaggcccagagcctgtaagataacatcacaacacagcggcccaggagtcagggtcatctgctgaaaactcactccctctagtcacccgccagccccacagctgctctttgtgcctcagcttcatggaaaggttaaatgaccaacgccatcctcctgcctctagaacggccacagagtcaggtcagatgacagtctgcactcttagtcgagggatgttggctacaraaacttccgtggccttaggacctccaactccatcgctcccaaccccatcacgggcagcaatgcggacaggtcacacaagtgccatggggacccacctcccagtccgtgtctgtggccccagtgcttgatgagctgtgtgatcagagcatgtatccacaggcagagctctggaaggttctctccgagggacctgttgagcccctcattgctttctccatcacaccttcccgaggaagacacaagggtccctctgtccccggggtacacagggcagcccccagccggggaagcatgcctctc

SEQ ID NO: 174233 - DNA, 601 bp, Human
ctgggatttcattgtttggaccgtcctgcctttgtgttgtctgtgttaacaacacccagaagattccatcagcctcatgccagggttgggagatcaaagaaaggtgatccccacacggcccacagaggagggaagaacctatcaagaacgcccttggggtccagcagcaaacggatggtgattgtgcctttgaatgcctcagtccgggctttgtgtatcatagtgtgggctccagcaggaatctggggtccacaatcacaggcaccatcggttcctgcttggcggcagccccaacacattcccatgggagcccagacggagcgcccactggatctcaggctggaattgggcgcttggatcaactccattcatatggctttgggacagccacgtgcatctccacacttcccaagttcatgggaaattttgagaaaaacttttctgactgtcaaagcattctctccggtccattctcaaattcttcccccagaatgaagtttatgaatacgcatcacgcagcatgcagccgctgaccccaagtgtacttatttcttcaaaacacagaactttaggagtacaaaaggcttattcgaagagagag

SEQ ID NO: 174234 - DNA, 601 bp, Human
atctaaaagctacggagacagggcttctctcaaatccttggaaggaagcacccctgcggatgccttatctcagacttccagcctctagaactctgagaaaacacatctctgtcctggcctgtctgtggaaccttctttcagcaacccgagcacgccaacacatgccaacagacgggaggctcgcacctatcggtgggggtctgcgctgctgagacctgcaagctcaggaccccccggcaggaagcctggttgtgatgcaggggcagcaatctgtgcagaatcctggctttattaaaaagckccaagtcaacccaagcctgctttatggggagaggcaaccttcaccctccaatctcgccccagacagctcaacacgcacggcctgaggtgtgcccgtggccatttcccagcagtggtcagaggggctgcaggtcccagagctgacccccacaacacgcagggagcagcctcctgagaggctcagacctgtgttcgccaggggagagacccaggagggaatgttctaaccttatttcccttaagctgttttctgtgctccatgtctgggatttcattgtttggaccgtcctgcctttgtgtt

SEQ ID NO: 174235 - DNA, 601 bp, Human
cccaaagggagagcgggcgtctcgcagagtctgatggggaggaggagggtgggacactcccgtgtcacacaaattcatctttgcctatcaaatgccgggaaaaggaagggtgggggtgcggctcacaagagttcttttgtttctgttatggggtgtcgctggggttcagctgtcttcttgaatcatttcacctgtttcacagtggcttccagtcccggtctccaggtctctgacgagtacaccaccccattttaacactcatcatagctcagaatgttccaggctatagctaaaatataarttagtggaaagaggttgctggggaggagtagacaaggctcctgatgagaatcttctagagaactgcaaccttgtcataatgaactggggtcctcacaggcctcctgcaccaaagtcctctggagagggagacatctggatgaggagggtggatggtgcccatgaatacagtcacctatgtggagaattacagctcatcgtgagctaccatcagggatcctaattttacatgaaatcccactggagaattcttgacaaggtaatggccatttaaagatctgctctgagacattttatgggg

SEQ ID NO: 174236 - DNA, 601 bp, Human
ccagagggatgaaggctttgtttggtatccatgactgcacccaaagggagagcgggcgtctcgcagagtctgatggggaggaggagggtgggacactcccgtgtcacacaaattcatctttgcctatcaaatgccgggaaaaggaagggtgggggtgcggctcacaagagttcttttgtttctgttatggggtgtcgctggggttcagctgtcttcttgaatcatttcacctgtttcacagtggcttccagtcccggtctccaggtctctgacgagtacaccaccccattttaacactcaycatagctcagaatgttccaggctatagctaaaatataagttagtggaaagaggttgctggggaggagtagacaaggctcctgatgagaatcttctagagaactgcaaccttgtcataatgaactggggtcctcacaggcctcctgcaccaaagtcctctggagagggagacatctggatgaggagggtggatggtgcccatgaatacagtcacctatgtggagaattacagctcatcgtgagctaccatcagggatcctaattttacatgaaatcccactggagaattcttgacaaggta

SEQ ID NO: 174237 - DNA, 601 bp, Human
gacatccctaactccagaaaatctctagattcaaagacaccgcttcccagaccttatcttttcaacctgagtcataaagagaaaaatcttagtcttatccacagttatttaacatgaaataaaatagcttgcagctattcattttgcttaacacggttttcacgtggaagacggctacgtaacggaaacccagagggatgaaggctttgtttggtatccatgactgcacccaaagggagagcgggcgtctcgcagagtctgatggggaggaggagggtgggacactcccgtgtcacacaarttcatctttgcctatcaaatgccgggaaaaggaagggtgggggtgcggctcacaagagttcttttgtttctgttatggggtgtcgctggggttcagctgtcttcttgaatcatttcacctgtttcacagtggcttccagtcccggtctccaggtctctgacgagtacaccaccccattttaacactcatcatagctcagaatgttccaggctatagctaaaatataagttagtggaaagaggttgctggggaggagtagacaaggctcctgatgagaatcttctagagaactgcaacctt

SEQ ID NO: 174238 - DNA, 601 bp, Human
gtccttacaagtatacacattccataatgcgtctctatcaccaaaagccgctctgcagcatcatggggcaccggtaccctgtctcctgcgacaggtcgtggaaatgatatgtagaaatcagacatccctaactccagaaaatctctagattcaaagacaccgcttcccagaccttatcttttcaacctgagtcataaagagaaaaatcttagtcttatccacagttatttaacatgaaataaaatagcttgcagctattcattttgcttaacacggttttcacgtggaagacggctacgtracggaaacccagagggatgaaggctttgtttggtatccatgactgcacccaaagggagagcgggcgtctcgcagagtctgatggggaggaggagggtgggacactcccgtgtcacacaaattcatctttgcctatcaaatgccgggaaaaggaagggtgggggtgcggctcacaagagttcttttgtttctgttatggggtgtcgctggggttcagctgtcttcttgaatcatttcacctgtttcacagtggcttccagtcccggtctccaggtctctgacgagtacaccaccccatttt

SEQ ID NO: 174239 - DNA, 601 bp, Human
cggctccctccaaaggggcccacctgctgaaggagtggggacccagccttccaagttccatgccagccaagttatagagtcaaaccaaatcaagactcttgagccaccctgctccaactcttctgcccagcctgacgtgaccaggccagtgtagccaccgccccagtgcacagctcagctccccaaaccccacgtctgaggggccaactgtttaggacaccagtagtttgggcatgcactgggataaaagtgctccaggcacctggggtggcccatccttcatttcaactaaggcatcacacatgcaaaggctggcatccaggagagccaactcagacctcaggagtggaggattatgtttgctttatgagggcagatactctatgcctgggtccttacaagtatacacattccataatgcgtctctatcaccaaaagccgctctgcagcatcatggggcaccggtaccctgtctcctgcgacaggtcgtggaaatgatatgtagaaatcagacatccctaactccagaaaatctctagattcaaagacaccgcttcccagaccttatcttttcaacctgagtcataaagagaaaaatctt

SEQ ID NO: 174240 - DNA, 601 bp, Human
ggaaaggggagttcaagctggacgggcagagataagctatcaaagcaaacgctggctgggctgccaagtgtccggagagattatctcaaaaacaagcaggaacggctccctccaaaggggcccacctgctgaaggagtggggacccagccttccaagttccatgccagccaagttatagagtcaaaccaaatcaagactcttgagccaccctgctccaactcttctgcccagcctgacgtgaccaggccagtgtagccaccgccccagtgcacagctcagctccccaaaccccacgtctgwggggccaactgtttaggacaccagtagtttgggcatgcactgggataaaagtgctccaggcacctggggtggcccatccttcatttcaactaaggcatcactcatgcaaaggctggcatccaggagagccaactcagacctcaggagtggaggattatgtttgctttatgagggcagatactctatgcctgggtccttacaagtatacacattccataatgcgtctctatcaccaaaagccgctctgcagcatcatggggcaccggtaccctgtctcctgcgacaggtcgtggaaatgat

SEQ ID NO: 174241 - DNA, 601 bp, Human
ccacttcagtgtggaaccttcagcaaggaatgagggctacatggtggccagggagaggtggagacccgcaggcatggtcgaagatggtgggaaaggggagttcaagctggacgggcagagataagctatcaaagcaaacgctggctgggctgccaagtgtccggagagattatctcaaaaacaagcaggaacggctccctccaaaggggcccacctgctgaaggagtggggacccagccttccaagttccatgccagccaagttatagagtcaaaccaaatcaagactcttgagccacccygctccaactcttctgcccagcctgacgtgaccaggccagtgtagccaccgccccagtgcacagctcagctccccaaaccccacgtctgaggggccaactgtttaggacaccagtagtttgggcatgcactgggataaaagtgctccaggcacctggggtggcccatccttcatttcaactaaggcatcactcatgcaaaggctggcatccaggagagccaactcagacctcaggagtggaggattatgtttgctttatgagggcagatactctatgcctgggtccttacaagtatacaca

SEQ ID NO: 174242 - DNA, 601 bp, Human
ctttcaccaagttctaagatgctggccacctcttctccacactggcagggtacctgacagtttctggttggagaagaatgggaggggctggtgtagcccactaatgccccactacgggagacagatgtgcctaattcagtccccaccgtcacaggacactctttcttaccatcatttcaaagtcgccacagttgtcacagcagcaggataccactgagtgatacagcacatgcttggcctgatttggcagaggatgcctttggatagaccccacacacgtgcggatcctggggagcccccmcctgagctccggtgccacctcccccaggcagcgcctctccaccttctcttcatggctctgatgccacgaatacctcacaagcttgctccaagtcacattcagtgggacttgctttcactttccaggacgaggttcctctgtacaacccacttcagtgtggaaccttcagcaaggaatgagggctacatggtggccagggagaggtggagacccgcaggcatggtcgaagatggtgggaaaggggagttcaagctggacgggcagagataagctatcaaagcaaacgctggctgggctgcc

SEQ ID NO: 174243 - DNA, 601 bp, Human
tgaaaattggaaacaacttggcagagacggaacacacacagagaggacggtgctggggaggggccggctgggctgctccgcaaatgccccttaggctttccattacaaatgacagcctctggagcactatgcacacctgatcaacaggctcaatttgactcaacaccaggatcagtttgctgtgagacaagtatgatcttaagatatacaactttttttcctggtagacactaatttagaaaggaaaggagatttttccaactttccccaggaattgattctggccagaatgcacattaaygtgctctctggcctcaatttgcccgcctgaccacacacacacacacacacacacacacacacgtccacctgaccacacacatacacacacacccctttcaccaagttctaagatgctggccacctcttctccacactggcagggtacctgacagtttctggttggagaagaatgggaggggctggtgtagcccactaatgccccactacgggagacagatgtgcctaattcagtccccaccgtcacaggacactctttcttaccatcatttcaaagtcgccacagttgtcacagcagcag

SEQ ID NO: 174244 - DNA, 601 bp, Human
aaccagttagtgttgaaaattggaaacaacttggcagagacggaacacacacagagaggacggtgctggggaggggccggctgggctgctccgcaaatgccccttaggctttccattacaaatgacagcctctggagcactatgcacacctgatcaacaggctcaatttgactcaacaccaggatcagtttgctgtgagacaagtatgatcttaagatatacaactttttttcctggtagacactaatttagaaaggaaaggagatttttccaactttccccaggaattgattctggccasaatgcacattaacgtgctctctggcctcaatttgcccgcctgaccacacacacacacacacacacacacacacacgtccacctgaccacacacatacacacacacccctttcaccaagttctaagatgctggccacctcttctccacactggcagggtacctgacagtttctggttggagaagaatgggaggggctggtgtagcccactaatgccccactacgggagacagatgtgcctaattcagtccccaccgtcacaggacactctttcttaccatcatttcaaagtcgccacagtt

SEQ ID NO: 174245 - DNA, 601 bp, Human
cagctactcctagaagggaaggcctgggcccatggatgagatgctgcatttccccgaaagttccagatgtgaaagaggcagaaggtctcaccgttccagcagcagatgcttcgtttctaggagcatgatatgccaggggaaaggggatgcagcgccagcgcctacttgtttatctcccgagacgctagctgggggtcccactttcacagcggagtgactggaggtacaggccaagaaggagggaggctccctgcccagggtgtggagtccccgaccccagggagccaggggccaccctgasaaatgatttttccattacgtctgctgacagcaaccagttagtgttgaaaattggaaacaacttggcagagacggaacacacacagagaggacggtgctggggaggggccggctgggctgctccgcaaatgccccttaggctttccattacaaatgacagcctctggagcactatgcacacctgatcaacaggctcaatttgactcaacaccaggatcagtttgctgtgagacaagtatgatcttaagatatacaactttttttcctggtagacactaatttagaaaggaaaggagatttt

SEQ ID NO: 174246 - DNA, 601 bp, Human
attttatggggcctctactgtccttaggggaacccaactggccttctgagatcccagcccactcatctcttgacaccgtagggtccagaatgcttgtataaggacatgctctctgcagtctctgcttgctctcaaaaccaatggaaacccccacgtgggctgaccttttcctgttgcagcccttcctgggagctggcccagcccaagggaggcctggtgtccagcgatggggccctttggccagcagagggcactgcacaccctgcatggccttccagaggctgcagagacagccatgagycaccatcctcatttctatcccaacttaagctctacaagcacctggagaaaataagatcagctactcctagaagggaaggcctgggcccatggatgagatgctgcatttccccgaaagttccagatgtgaaagaggcagaaggtctcaccgttccagcagcagatgcttcgtttctaggagcatgatatgccaggggaaaggggatgcagcgccagcgcctacttgtttatctcccgagacgctagctgggggtcccactttcacagcggagtgactggaggtacaggccaagaaggaggg

SEQ ID NO: 174247 - DNA, 601 bp, Human
cattgaagtttcactctggttccaccatcaaagaaaggctagggagctcatatttccccagggagcacccagcagcccaaccccagagtgacatggtcacaccctggtcacatgccctcgatcagttccaagggccccaccctctaattccctagggctgatgcaatgcaggaaacccagctgtagccaacacagggctacaatccacttcccacaccccaaggctaggtatgctacagaattcacaagtgcttgggtttaaaaaaaaaatacatggcttccacaatctattacggtgtaccccccaaatcatctaaatgcctgtgccagaacagataatcatactgacccaactgcattaagaaagaatataaaaaatagactcaacaatttagggcaggtcaaattctgccgctatcagagtattttagaatttggatatgagggccaggcgtagtggctcatacctgtaatcctagcacactgggaggccaaggagggtggatcacatgaggtcagaagttcgagaccagcctggccaacatggtgaaaccccatctctactaaaaatacaaaaaattagccaggcatggtggtgcac

SEQ ID NO: 174248 - DNA, 601 bp, Human
tgttgcccagggaatctcagctgactgcaacctccacttctcgagttcaagtgattctcctgctgtagcctcccaagtagctgggcacaagccaccaagcccagcaaatttttgtatttttagtagacacagggtttcaccacgttggccaggctggtctcaaactcctgacttcaggtgtcctgacccctcggcctcccaaagtgctgggattacaggcgtgagccaccaagcccagtcgtgaccctttctaatatacacattgaagtttcactctggttccaccatcaaagaaaggctrgggagctcatatttccccagggagcacccagcagcccaaccccagagtgacatggtcacaccctggtcacatgccctcgatcagttccaagggccccaccctctaattccctagggctgatgcaatgcaggaaacccagctgtagccaacacagggctacaatccacttcccacaccccaaggctaggtatgctacagaattcacaagtgcttgggtttaaaaaaaaaatacatggcttccacaatctattacggtgtaccccccaaatcatctaaatgcctgtgccagaacagataatc

SEQ ID NO: 174249 - DNA, 601 bp, Human
tcatgaggctctgccctcaggaacaggattattacccagtccgtagtacccaatagatgatcttgctgccccacgcgaggatacagccaggaggtctacagccagcaagcaggccctcccagatcctggatctgccagatcattagttttacatttcctaggctccagagctgtgagaaataaagccactcagtcgatggtatttttcttacagcagcccgaactaagacaatggccaaaagtgaatattgcttcctgattatttattaatttttgcaaatttagttttatgtttttgggrattaagagggtgtctgacttcctatacactaccaataaagaggcgtacaggaaaatctccctctccaagggcccccataccatgccctaaaggtaactagcaggaccctttctttcttttttggagacagattctcgctttgttgcccagggaatctcagctgactgcaacctccacttctcgagttcaagtgattctcctgctgtagcctcccaagtagctgggcacaagccaccaagcccagcaaatttttgtatttttagtagacacagggtttcaccacgttggccaggctggtct

SEQ ID NO: 174250 - DNA, 601 bp, Human
caccacaattaataacaaaattactaaaactgtactttaaaggaaggaaatgaagctttttgagaaaatcaggataggaaatgagcttaatggagccaattttcagaacggcagctatggaccgaatgcttgtgtaccctaaaattcttccatgctgaatgttggattcgtgaatgtgcaaaccctaatgcccacagtgattgtatctgggtgctgggcctctggaggtgattcatgaggctctgccctcaggaacaggattattacccagtccgtagtacccaatagatgatcttgctgycccacgcgaggatacagccaggaggtctacagccagcaagcaggccctcccagatcctggatctgccagatcattagttttacatttcctaggctccagagctgtgagaaataaagccactcagtcgatggtatttttcttacagcagcccgaactaagacaatggccaaaagtgaatattgcttcctgattatttattaatttttgcaaatttagttttatgtttttggggattaagagggtgtctgacttcctatacactaccaataaagaggcgtacaggaaaatctccctctccaa

SEQ ID NO: 174251 - DNA, 601 bp, Human
cctttgattaaatggcaaccgcaacaccacaattaataacaaaattactaaaactgtactttaaaggaaggaaatgaagctttttgagaaaatcaggataggaaatgagcttaatggagccaattttcagaacggcagctatggaccgaatgcttgtgtaccctaaaattcttccatgctgaatgttggattcgtgaatgtgcaaaccctaatgcccacagtgattgtatctgggtgctgggcctctggaggtgattcatgaggctctgccctcaggaacaggattattacccagtccgtrgtacccaatagatgatcttgctgccccacgcgaggatacagccaggaggtctacagccagcaagcaggccctcccagatcctggatctgccagatcattagttttacatttcctaggctccagagctgtgagaaataaagccactcagtcgatggtatttttcttacagcagcccgaactaagacaatggccaaaagtgaatattgcttcctgattatttattaatttttgcaaatttagttttatgtttttggggattaagagggtgtctgacttcctatacactaccaataaagaggc

SEQ ID NO: 174252 - DNA, 601 bp, Human
cctgggccacccagtgagagcctgtctcaaacttaaagcaacagcaaagccagatataacaaaataaacgtcctaaaggagtcagggatcagtgggtcaaaaagcactggcccagcctttgattaaatggcaaccgcaacaccacaattaataacaaaattactaaaactgtactttaaaggaaggaaatgaagctttttgagaaaatcaggataggaaatgagcttaatggagccaattttcagaacggcagctatggaccgaatgcttgtgtaccctaaaattcttccatgctgaatgytggattcgtgaatgtgcaaaccctaatgcccacagtgattgtatctgggtgctgggcctctggaggtgattcatgaggctctgccctcaggaacaggattattacccagtccgtagtacccaatagatgatcttgctgccccacgcgaggatacagccaggaggtctacagccagcaagcaggccctcccagatcctggatctgccagatcattagttttacatttcctaggctccagagctgtgagaaataaagccactcagtcgatggtatttttcttacagcagcccgaactaagac

SEQ ID NO: 174253 - DNA, 601 bp, Human
cacatgtgctcaggccacctcaaaagagcacattccataggcttcagaagccaaacttgtgcaacagatgtctttcttaggaagagagctgggtagaatcttctgaacgggtgatgagcattttattttgtaaactacacttggaaaaaactactaaaaaccagatataagcagggcacagtggcgtgtgcctctagtctccctcctcagaaggctgagacgggcagctctcttgaggctgtgatgtgccacgatcgcacctgtgaataaagccactgcactccagcctgggccacccagygagagcctgtctcaaacttaaagcaacagcaaagccagatataacaaaataaacgtcctaaaggagtcagggatcagtgggtcaaaaagcactggcccagcctttgattaaatggcaaccgcaacaccacaattaataacaaaattactaaaactgtactttaaaggaaggaaatgaagctttttgagaaaatcaggataggaaatgagcttaatggagccaattttcagaacggcagctatggaccgaatgcttgtgtaccctaaaattcttccatgctgaatgttggattcgtgaatg

SEQ ID NO: 174254 - DNA, 601 bp, Human
tctgcccagaaaacactctgacttttcatccggagttaacagagccacatgtgctcaggccacctcaaaagagcacattccataggcttcagaagccaaacttgtgcaacagatgtctttcttaggaagagagctgggtagaatcttctgaacgggtgatgagcattttattttgtaaactacacttggaaaaaactactaaaaaccagatataagcagggcacagtggcgtgtgcctctagtctccctcctcagaaggctgagacgggcagctctcttgaggctgtgatgtgccacgatygcacctgtgaataaagccactgcactccagcctgggccacccagtgagagcctgtctcaaacttaaagcaacagcaaagccagatataacaaaataaacgtcctaaaggagtcagggatcagtgggtcaaaaagcactggcccagcctttgattaaatggcaaccgcaacaccacaattaataacaaaattactaaaactgtactttaaaggaaggaaatgaagctttttgagaaaatcaggataggaaatgagcttaatggagccaattttcagaacggcagctatggaccgaatgctt

SEQ ID NO: 174255 - DNA, 601 bp, Human
tccaatgcaggaagaaaagattccctgcaacccagatggccgcatcaatgcacaaggtccaccacccttctgagcctgggatcccaaacgacaggactcactcctggaaagcttccttcaccgcagcctacagggcctctcagtgcacccacaggctcatccaggagcctgtgcgaccactgtgccaagatgaggagacagcaacagtccaggcggtggtgacacccagctcttgcacacatagccgaggatcctgctggtgtggtgccggctggtgtgctggcggcacatctgcagatayggtgccagttaacagggccttgagaacgccagcccaccaatgacttctgcccagaaaacactctgacttttcatccggagttaacagagccacatgtgctcaggccacctcaaaagagcacattccataggcttcagaagccaaacttgtgcaacagatgtctttcttaggaagagagctgggtagaatcttctgaacgggtgatgagcattttattttgtaaactacacttggaaaaaactactaaaaaccagatataagcagggcacagtggcgtgtgcctctagtctccctcctcag

SEQ ID NO: 174256 - DNA, 601 bp, Human
cttgactctgttgtaaaaacagatttccacatcagctgcgtcatccaaggggggaagagaattaatcagttaatttttgtgaagacctcggagatgaaaaatgacagcattataatctgaggcaaggcgggtttcacaccctcctcccccaacccccgagtgaggcgtaatcattccttttgctttcctttgaattttaatttgtataattagatggcttcctgaaaaattgataagtagaatctcaatcatgcaatcaaaggaaagatcagccatcagcttccacaaacgccaatattcyactattaaaaaaaaaaaaagaggctgactcccatgtctggcttttttgggggtgggggtgggggaggggggtcactctgttctggaccttctgtgggttcctttctgcacaccccaggccagtggcaccgacccatgtttagggctggccatcttggctcccaaggccaccagcctctgggtctggtctgggcagtgaccattgacttgtgtagcctcaatcctctcccctgatatctcttgtgcaaaaagaatgtatgaaatgtgacattttcctccttagccctcccaaggagcaagc

SEQ ID NO: 174257 - DNA, 601 bp, Human
ggaggctcgggccagcaattgtcatttgctcaggcgcaagctctgatggtcaaactgcagtctggcccctccttgactctgttgtaaaaacagatttccacatcagctgcgtcatccaaggggggaagagaattaatcagttaatttttgtgaagacctcggagatgaaaaatgacagcattataatctgaggcaaggcgggtttcacaccctcctcccccaacccccgagtgaggcgtaatcattccttttgctttcctttgaattttaatttgtataattagatggcttcctgaaaaaytgataagtagaatctcaatcatgcaatcaaaggaaagatcagccatcagcttccacaaacgccaatattctactattaaaaaaaaaaaaagaggctgactcccatgtctggcttttttgggggtgggggtgggggaggggggtcactctgttctggaccttctgtgggttcctttctgcacaccccaggccagtggcaccgacccatgtttagggctggccatcttggctcccaaggccaccagcctctgggtctggtctgggcagtgaccattgacttgtgtagcctcaatcctctccc

SEQ ID NO: 174258 - DNA, 601 bp, Human
cactcacactgagatgcagacgcacaccgtggcgactcgaggggctctgcgaaggcctgctgccaggtgagttacaacaatgctttccaaaacagccgcgcaggggtcaggggtcaaagccacagctcagcacaacacaaaaccctgactctaccacgtgagaacgcgggtgggaagccccagcagctcctaaccaacgttcctccgatgccgccttcctgaaccttccttgcagctggaggggaccgcagtcagcaccagcaagggcagggtcccaggctgctggccttgacacttggtyccagctatatgggctgaagtatttcttagtgtgagagtgtaaccatccccatgacgtttcaggtagaggtgaggctgatggaggaggcaagaaaggtctcccatgtggtttggggtatgtgggattctctagagggagacctgactgcggcctggggaagaggaggtgctgcccatcctccttctcaggaggatctgagcactttggaagcctctgactgtcaccaatgtgcccggtgaggtccagatcattaacagctgtccccaatatcccagcttttaagtcactgctctggaactg

SEQ ID NO: 174259 - DNA, 601 bp, Human
cattgtaaatatcttaatccaaaacaggtaaagtcctgagatttcaggaagtgaaaaaagatggtcctaatcaacaccatcttttatatgcaaaataaccttaggtacatggaagacatagacctcagggcccaccagccctgaaactgtcctcctagtccccaaccccgccccagaagccaggccttgtcctaagccaaggccaggcccacggccaaggacacccagcagagggtgccaatggtatgcagtgttggaatcggaggagggactctggcttggggagtggcacagccaactsaagggagcagccagcgaagatttgagtgagggactacgtatgtttggtaaaaaccgccaaacacgctcttaccttcacaaattctgtccaatcgctgtctcttgactttgtgcttatccacaagggccattctttatggaactttgcaactctcagatcaaaaggcaaagcagtcctctaagaacttaggggaacttgcaggagtctgcgtgcatgacgccactatgaaccctgaaacaaggagaaaagaatccttactctctggagaccctctgggcacaggacaacagctcactgggg

SEQ ID NO: 174260 - DNA, 601 bp, Human
tccattagattttaattatgtttatttttcctttcatgaacagaacacttccagacatttccaaagataccagggacatgaacacaccacgaggggcaatgctgggctcttcaggaatctcatagtatcagggaattcagcattgtaaatatcttaatccaaaacaggtaaagtcctgagatttcaggaagtgaaaaaagatggtcctaatcaacaccatcttttatatgcaaaataaccttaggtacatggaagacatagacctcagggcccaccagccctgaaactgtcctcctagtcmccaaccccgccccagaagccaggccttgtcctaagccaaggccaggcccacggccaaggacacccagcagagggtgccaatggtatgcagtgttggaatcggaggagggactctggcttggggagtggcacagccaactcaagggagcagccagcgaagatttgagtgagggactacgtatgtttggtaaaaaccgccaaacacgctcttaccttcacaaattctgtccaatcgctgtctcttgactttgtgcttatccacaagggccattctttatggaactttgcaactctcagatca

SEQ ID NO: 174261 - DNA, 601 bp, Human
aatgtctatgatgtccccaccccgtgtggcatgagccacatctacttataggacagacaattccatatgggcagctgcaggggaagccctgtgggttgcatattcctgtccacaaactggtgggtcagctactaaacttcagcgtgtgcgtgaagggtgcagagggggctgcggagccatcttcgcttccctccgagagccaccctgtagggcagtaccagcaatcaccctgagcaaagagcagccctgtagcactgaccccatctggcaggtgcactcacccctaaacccgaacccacaygctggtttcttaccacccgctagctggaagagcgcagtgcttaatcaacacttcagagttttgtccccaggtttccattagattttaattatgtttatttttcctttcatgaacagaacacttccagacatttccaaagataccagggacatgaacacaccacgaggggcaatgctgggctcttcaggaatctcatagtatcagggaattcagcattgtaaatatcttaatccaaaacaggtaaagtcctgagatttcaggaagtgaaaaaagatggtcctaatcaacaccatcttttat

SEQ ID NO: 174262 - DNA, 601 bp, Human
taacgccaaactccttatactgaaccccaggaatgtcagtgcttttgtgttcttgcagcgcagagttctgtgaggccatggagtcactcagcagaatgtctatgatgtccccaccccgtgtggcatgagccacatctacttataggacagacaattccatatgggcagctgcaggggaagccctgtgggttgcatattcctgtccacaaactggtgggtcagctactaaacttcagcgtgtgcgtgaagggtgcagagggggctgcggagccatcttcgcttccctccgagagccaccctrtagggcagtaccagcaatcaccctgagcaaagagcagccctgtagcactgaccccatctggcaggtgcactcacccctaaacccgaacccacacgctggtttcttaccacccgctagctggaagagcgcagtgcttaatcaacacttcagagttttgtccccaggtttccattagattttaattatgtttatttttcctttcatgaacagaacacttccagacatttccaaagataccagggacatgaacacaccacgaggggcaatgctgggctcttcaggaatctcatagtatcaggg

SEQ ID NO: 174263 - DNA, 601 bp, Human
cgaatatgcagcctatactagacaatactgtccctgaggttagattcctggggttcattccggtactgggagcagtaggaaattggataaaaggtgccatgccataggtagtccagagtaaagtgctgcccctgaattttttcagatggttctggaagaaaatccatcatctactcacacagtgtctatttatatgtatatctctatctttatctcccctcaaaagaatctggaaaactgaatggaatattggtgttcactgtaccatcctaccaacctctctgtaggtttttataatttstgaatgtttactttaaaaaaaccctttaacgccaaactccttatactgaaccccaggaatgtcagtgcttttgtgttcttgcagcgcagagttctgtgaggccatggagtcactcagcagaatgtctatgatgtccccaccccgtgtggcatgagccacatctacttataggacagacaattccatatgggcagctgcaggggaagccctgtgggttgcatattcctgtccacaaactggtgggtcagctactaaacttcagcgtgtgcgtgaagggtgcagagggggctgcggagccat

SEQ ID NO: 174264 - DNA, 601 bp, Human
aagtcaagagtaaattttacaactccccatacaatctggtgaacccatactgtggaatagtctacaaatcaatggggcctgggctcttcagtaagtccaatgtctctgaaagtcaaaaaagcccaggggataattttagactaaggagactagagagatgtaacaactaaacacaatgcgtgacccttatctattgcacaggcaaagagacgtggaggaaatgcgaatatgcagcctatactagacaatactgtccctgaggttagattcctggggttcattccggtactgggagcagtasgaaattggataaaaggtgccatgccataggtagtccagagtaaagtgctgcccctgaattttttcagatggttctggaagaaaatccatcatctactcacacagtgtctatttatatgtatatctctatctttatctcccctcaaaagaatctggaaaactgaatggaatattggtgttcactgtaccatcctaccaacctctctgtaggtttttataatttctgaatgtttactttaaaaaaaccctttaacgccaaactccttatactgaaccccaggaatgtcagtgcttttgtgtt

SEQ ID NO: 174265 - DNA, 601 bp, Human
gatgggacagagggtctgcaagcagacaatggttttgcccaagtcaggtttatacagccatggaaacacacagaggaaacgctgctagctcttcaatcccattctagtttctgatgcaacatccctggagaatcctgggtgcagggggtggagtcagccccagaggcattcctgctagtaaccttggaaagctgagtcacgagcgtgttccagaagcaagtactcagtaacctcaatcaagcacctttacagtggaagtcaagagtaaattttacaactccccatacaatctggtgaaccyatactgtggaatagtctacaaatcaatggggcctgggctcttcagtaagtccaatgtctctgaaagtcaaaaaagcccaggggataattttagactaaggagactagagagatgtaacaactaaacacaatgcgtgacccttatctattgcacaggcaaagagacgtggaggaaatgcgaatatgcagcctatactagacaatactgtccctgaggttagattcctggggttcattccggtactgggagcagtaggaaattggataaaaggtgccatgccataggtagtccagagtaaag

SEQ ID NO: 174266 - DNA, 601 bp, Human
gagctggtgtatccagacaccaagagcaggaagacaaagttcctacaagcctgggagcagaccgggtaagcacagcagaacatggcagcttcatgcttttaatcatttagaaagaaaaaaaaaacaaacctaagggacgcagaagtccctgtgtcaggtgtaggcagtggggagggagaaaaaaacagtttgacaggctctctgcatatcaatacagaacattctacaagtagttgatagaatagaaacatggtgagaattcaaagctagagggtgtgtgtgtgtgtgtgtgtgtgtgtgtgtgtgtgttagatgttcaaggccttcaggtggaagaaagagctgaatccaacaagctggtatgagagaaggccaaacagaaaaaaacagactgcccgggttcctgggtgcaaactgcctactgctcaacgcctctctggcagcacctgtgagatgggtgccacctgtcctgacccataacaggtgccacaaggactaagtcagcttatacataggaggagcaccaacaaagcacttgggaccaactgtgagtacttaatgagatgcctagggagctgacatatagatggtgacccacact

SEQ ID NO: 174267 - DNA, 601 bp, Human
ggggacgaattttaaggagctggtgtatccagacaccaagagcaggaagacaaagttcctacaagcctgggagcagaccgggtaagcacagcagaacatggcagcttcatgcttttaatcatttagaaagaaaaaaaaaacaaacctaagggacgcagaagtccctgtgtcaggtgtaggcagtggggagggagaaaaaaacagtttgacaggctctctgcatatcaatacagaacattctacaagtagttgatagaatagaaacatggtgagaattcaaagctagagggtgtgtgtgtgtgtgtgtgtgtgtgtgtgtgtgtgttagatgttcaaggccttcaggtggaagaaagagctgaatccaacaagctggtatgagagaaggccaaacagaaaaaaacagactgcccgggttcctgggtgcaaactgcctactgctcaacgcctctctggcagcacctgtgagatgggtgccacctgtcctgacccataacaggtgccacaaggactaagtcagcttatacataggaggagcaccaacaaagcacttgggaccaactgtgagtacttaatgagatgcctagggagctgacatata

SEQ ID NO: 174268 - DNA, 601 bp, Human
gaggggacgaattttaaggagctggtgtatccagacaccaagagcaggaagacaaagttcctacaagcctgggagcagaccgggtaagcacagcagaacatggcagcttcatgcttttaatcatttagaaagaaaaaaaaaacaaacctaagggacgcagaagtccctgtgtcaggtgtaggcagtggggagggagaaaaaaacagtttgacaggctctctgcatatcaatacagaacattctacaagtagttgatagaatagaaacatggtgagaattcaaagctagagggtgtgtgtgtgtgtgtgtgtgtgtgtgtgtgtgtgttagatgttcaaggccttcaggtggaagaaagagctgaatccaacaagctggtatgagagaaggccaaacagaaaaaaacagactgcccgggttcctgggtgcaaactgcctactgctcaacgcctctctggcagcacctgtgagatgggtgccacctgtcctgacccataacaggtgccacaaggactaagtcagcttatacataggaggagcaccaacaaagcacttgggaccaactgtgagtacttaatgagatgcctagggagctgacata

SEQ ID NO: 174269 - DNA, 601 bp, Human
aggggctggacaggccttagaaaacagggaaaggttgtacaagtatctgtgcaggggtgatgctcagattccagcggagtacctggagtgggaccctggagaggcctgcctgattccagcctagggacccacgaccagggcttgatgttggcattgtgtagcaggcgggaggggacgaattttaaggagctggtgtatccagacaccaagagcaggaagacaaagttcctacaagcctgggagcagaccgggtaagcacagcagaacatggcagcttcatgcttttaatcatttagaaagaaaaaaaaaacaaacctaagggacgcagaagtccctgtgtcaggtgtaggcagtggggagggagaaaaaaacagtttgacaggctctctgcatatcaatacagaacattctacaagtagttgatagaatagaaacatggtgagaattcaaagctagagggtgtgtgtgtgtgtgtgtgtgtgtgtgtgtgtgtgttagatgttcaaggccttcaggtggaagaaagagctgaatccaacaagctggtatgagagaaggccaaacagaaaaaaacagactgcccgggttcctgggtgcaaac

SEQ ID NO: 174270 - DNA, 601 bp, Human
caatgtcaattatgtcagcagactaaacagataggaagatctccattatacttgagaatgaggagaccacaatcttgttctgatcagcctgtgttacgagagggctccttcgtaataattcttacatggtattataggattgcttgatagcaggcatcagaaaaaaaaggaacaattataaatagcaaactcaaagagttacattaaaaaaattaaaatgtggcttttacattggctagaaagaccattattccagctcatttggctggagtcccaaagactgtctgtgtcctgctctccragtagagacacagcctggcggagtgaatccccacggcagattctgggcacacagaaggatcaagctccatgccactttttcttgctttgaaaagtttcaaagaggaaggggctggacaggccttagaaaacagggaaaggttgtacaagtatctgtgcaggggtgatgctcagattccagcggagtacctggagtgggaccctggagaggcctgcctgattccagcctagggacccacgaccagggcttgatgttggcattgtgtagcaggcgggaggggacgaattttaaggagctggt

SEQ ID NO: 174271 - DNA, 601 bp, Human
agctgataccatcctcgggggaccattttccacgtctctaacacattcgaacaaaacgcagtaaaacgaaacacatacttttttcaagttgcaatcgcaacagccgcaggaaaggggagcagtgtttacagactgattctatcataatccacaagaagcagctctaacaaaaagttaccaccaacaacagccattgtggtttattaagttctacaaacccagggctctgcaagatgctcttctgggttccctttgcaatgctgagtgattgttagctagccctcatttccaaccaatagaygtttggggcaaaccaaaggagctctggcataatgcgataaagtaggtactaaaaccctccagctggtgcagttcacaatgtcaattatgtcagcagactaaacagataggaagatctccattatacttgagaatgaggagaccacaatcttgttctgatcagcctgtgttacgagagggctccttcgtaataattcttacatggtattataggattgcttgatagcaggcatcagaaaaaaaaggaacaattataaatagcaaactcaaagagttacattaaaaaaattaaaatgtggct

SEQ ID NO: 174272 - DNA, 601 bp, Human
cagaagagcccgcgacacagaagagacccactggggaaactcccttccacctcatccccggcagcatcttctcagacttctcatcctcctgcgacaaaggtgatgcagaatgagattcccagactttctaactatctatgtgtttcacagaaaccagcttgtctcctttttcctcatatccacccaaccagctcaacgttctcattccttttatcctctgtggtcgtgagaacattccagaggtgcggaatgtttcatgagcttgtttatttaagaggaggtcccttttatttttgcagargaaatggagaagcaccctccctgagtcatgttacaaggggactactcacaactcagctgataccatcctcgggggaccattttccacgtctctaacacattcgaacaaaacgcagtaaaacgaaacacatacttttttcaagttgcaatcgcaacagccgcaggaaaggggagcagtgtttacagactgattctatcataatccacaagaagcagctctaacaaaaagttaccaccaacaacagccattgtggtttattaagttctacaaacccagggctctgcaagatgctcttctggg

SEQ ID NO: 174273 - DNA, 601 bp, Human
caaaaacaaaacaagtcctgattttataatgcatctgtacaaagataggtgaaaagaaaacagctactcagaacaaaaacaaataaatcttaaataccaaacaaaaccatttgtcaacactctgtggattatgttctttcctcggggaaagagaaagtcactctctcatcctggaggctctgatgggtgtttgccaggcaaggaggctgctggaagaaggaaagagccagagggacttctagaccacttgggtaaccttgctgaccctggaggcgcctgtctttgttccttatacgtatgratgacctttcttgggggtacatcccactgacatgtgcttccaccatggcaagttcaacccactgagaagagcagaagagcccgcgacacagaagagacccactggggaaactcccttccacctcatccccggcagcatcttctcagacttctcatcctcctgcgacaaaggtgatgcagaatgagattcccagactttctaactatctatgtgtttcacagaaaccagcttgtctcctttttcctcatatccacccaaccagctcaacgttctcattccttttatcctctgtggtcgtga

SEQ ID NO: 174274 - DNA, 601 bp, Human
ggggaggggtcccccactctgagtttctcttaaagccggggacagataaggcaaaacatgaaactttaccccttgcaaagaaccgcacttttgtctgtgaagctttgccttggctgtttcctgaacctttacctttgcataagattgtttgggtatgttcatttgtgctttggggttttaaggcatgtctagttgactattgtatatttacatagctaatgtaattacagctaatcacataattgctggaaatgtgcataattgcctgatcccaacatataattataatgtatagcaacaytatgaatcccatttttaaaatccacattttggggctatttaaagttatttattagaactgtttgtggactacctataggcaggcttcaactctgtttctttacgaagcgctcaaagtgctttaaaaaaacaaacaaaaacaaaacaagtcctgattttataatgcatctgtacaaagataggtgaaaagaaaacagctactcagaacaaaaacaaataaatcttaaataccaaacaaaaccatttgtcaacactctgtggattatgttctttcctcggggaaagagaaagtcactctctc

SEQ ID NO: 174275 - DNA, 601 bp, Human
gctgcagaaccaaactagaagacggtgatgaacccccaaaccccagccacagactccagttgcactacacatccctggccccccaaataaaagcaaagtggccttaacatgttgctattagaaaaaagtggtgagtatgaagacatccgcccatcaccaaactgaccggtgcaaagagacgcttatgtttgtgcttgagaaatgagtaacaacagagaaataaaacaccgaacctgattcacagctgcagaacgggagggcagtctatgaaccccatccccagagtcggtggaggaacagrtggggtgaggggttccctggggaggggtcccccactctgagtttctcttaaagccggggacagataaggcaaaacatgaaactttaccccttgcaaagaaccgcacttttgtctgtgaagctttgccttggctgtttcctgaacctttacctttgcataagattgtttgggtatgttcatttgtgctttggggttttaaggcatgtctagttgactattgtatatttacatagctaatgtaattacagctaatcacataattgctggaaatgtgcataattgcctgatcccaacatataa

SEQ ID NO: 174276 - DNA, 601 bp, Human
tgcactgttccccccgcggcactccttccccctgcccaccccaagcactgctcccctcaaggcactgacttggcctgaaactagagatgctcttttcccaaaggtgccgggaccaagaggacaggcactgagagtaaagccctgggcagctgggcccaggggctccgggccacactgtgggaggtttcaactcaatcatcgatggagacagggcaccaccaaccaggcggtgggaaacagcgcgattcactgtggtaggggcaggagctgaaaaccgcagctgcagaaccaaactagaagrcggtgatgaacccccaaaccccagccacagactccagttgcactacacatccctggccccccaaataaaagcaaagtggccttaacatgttgctattagaaaaaagtggtgagtatgaagacatccgcccatcaccaaactgaccggtgcaaagagacgcttatgtttgtgcttgagaaatgagtaacaacagagaaataaaacaccgaacctgattcacagctgcagaacgggagggcagtctatgaaccccatccccagagtcggtggaggaacaggtggggtgaggggttccctggg

SEQ ID NO: 174277 - DNA, 601 bp, Human
ctggctaccctggggcctcctccaaacacggagactacggatgcactgttccccccgcggcactccttccccctgcccaccccaagcactgctcccctcaaggcactgacttggcctgaaactagagatgctcttttcccaaaggtgccgggaccaagaggacaggcactgagagtaaagccctgggcagctgggcccaggggctccgggccacactgtgggaggtttcaactcaatcatcgatggagacagggcaccaccaaccaggcggtgggaaacagcgcgattcactgtggtaggrgcaggagctgaaaaccgcagctgcagaaccaaactagaagacggtgatgaacccccaaaccccagccacagactccagttgcactacacatccctggccccccaaataaaagcaaagtggccttaacatgttgctattagaaaaaagtggtgagtatgaagacatccgcccatcaccaaactgaccggtgcaaagagacgcttatgtttgtgcttgagaaatgagtaacaacagagaaataaaacaccgaacctgattcacagctgcagaacgggagggcagtctatgaaccccatcccc

SEQ ID NO: 174278 - DNA, 601 bp, Human
gaaggttctccgcattcgtgcgggctgctgtctgctgctgtctggctaccctggggcctcctccaaacacggagactacggatgcactgttccccccgcggcactccttccccctgcccaccccaagcactgctcccctcaaggcactgacttggcctgaaactagagatgctcttttcccaaaggtgccgggaccaagaggacaggcactgagagtaaagccctgggcagctgggcccaggggctccgggccacactgtgggaggtttcaactcaatcatcgatggagacagggcaccaycaaccaggcggtgggaaacagcgcgattcactgtggtaggggcaggagctgaaaaccgcagctgcagaaccaaactagaagacggtgatgaacccccaaaccccagccacagactccagttgcactacacatccctggccccccaaataaaagcaaagtggccttaacatgttgctattagaaaaaagtggtgagtatgaagacatccgcccatcaccaaactgaccggtgcaaagagacgcttatgtttgtgcttgagaaatgagtaacaacagagaaataaaacaccgaacctgattc

SEQ ID NO: 174279 - DNA, 601 bp, Human
atgtggaagggctgagaaaggcacgtgaggtcactctgtagatggagatgagacagagacagaggaacgccctcgagcgcgcacgccaaggtgcctgagctttagtagcaagcgagccaagtggtagaaaccaatcagagaggagtctcatttcacagctttaacactgtacgttctggaaaaggagagagggcaagaagccggcagcaaaatgtatcttggggttctggttcacagtcaccccaaatacctgtcaattaggttgagctgtgtgaagcgcgcagaaggttctccgcattcstgcgggctgctgtctgctgctgtctggctaccctggggcctcctccaaacacggagactacggatgcactgttccccccgcggcactccttccccctgcccaccccaagcactgctcccctcaaggcactgacttggcctgaaactagagatgctcttttcccaaaggtgccgggaccaagaggacaggcactgagagtaaagccctgggcagctgggcccaggggctccgggccacactgtgggaggtttcaactcaatcatcgatggagacagggcaccaccaaccaggcggtgggaa

SEQ ID NO: 174280 - DNA, 601 bp, Human
acccatcccaggttgcaaatgggaagggaggaaccctcctggcacagacatctcttcaaccggaacacggaaaacaaaaccctcaggtgatgagaaacaggctggagggacagggagtgtgggatcccactgtgccccagcgctggacacccagaatgctctcccctctcggcatcttcacagcccagctggggtgctcagccaggctcctgctggatgtggaagggctgagaaaggcacgtgaggtcactctgtagatggagatgagacagagacagaggaacgccctcgagcgcgcacrccaaggtgcctgagctttagtagcaagcgagccaagtggtagaaaccaatcagagaggagtctcatttcacagctttaacactgtacgttctggaaaaggagagagggcaagaagccggcagcaaaatgtatcttggggttctggttcacagtcaccccaaatacctgtcaattaggttgagctgtgtgaagcgcgcagaaggttctccgcattcgtgcgggctgctgtctgctgctgtctggctaccctggggcctcctccaaacacggagactacggatgcactgttccccccgcggc

SEQ ID NO: 174281 - DNA, 601 bp, Human
gcccctccccacaaccacttcagccctctgagcctgagcccacatcaaagcccaaacagccccatttgcaagcctgggcatggtaggcactaagctaggcaaagcacccaccgcccaaatacaaatggctgcctgacagagacctgctccacctgagcctgcacacggacagtttcagcacacgggccttgatgggacggtcagcctttcttaggatacgaaagaactgactctcagcctcactcccaagtctcggataaatctgcgtcacccatcccaggttgcaaatgggaagggaggraccctcctggcacagacatctcttcaaccggaacacggaaaacaaaaccctcaggtgatgagaaacaggctggagggacagggagtgtgggatcccactgtgccccagcgctggacacccagaatgctctcccctctcggcatcttcacagcccagctggggtgctcagccaggctcctgctggatgtggaagggctgagaaaggcacgtgaggtcactctgtagatggagatgagacagagacagaggaacgccctcgagcgcgcacgccaaggtgcctgagctttagtagcaagcgag

SEQ ID NO: 174282 - DNA, 601 bp, Human
ggaggcttgggcacccacgcaacgcgccaaaggaagtcaggagagtgacgtcgagtgtctgaaccaacccagcctttttcagattagctgcatcctaagaagccccagtcctcatgtctctcagtatttagccatggtaagtgaaaacaaaggcctgcacattgcttctgactcaatttcttaactatattgtaaagcttcctgggaactgcattatgaaaattagaccactcattatggggtttcaaaagaaaaaaaaaaacaagcccattctcttgcactgcccattttgaaagtgttrgtggagccaaagtgtgcaacgggaccccagctgggatgcaggacaggcctcaccttggaccatgtcaggattcccatttctagcaatggaacacactcaacctcaagaggctgtgctcagctctggacagcacccggcacaagacgctccgcacagtaggtgctcaatgaacaccaccccttctgctctttagcagcttttcctgcagattcccaaagtctccacctcacctccatggtgacccgccccatcacactccactgtttgaggtctcctcggctgtcctgcgatcagaaggtc

SEQ ID NO: 174283 - DNA, 601 bp, Human
ttgcattccagcctgggcaacagagcaagactccatttcaaaaaaaaaaaaaaaaaaaaaaaaagtctttcctctcatcaaccccctaccccctgcccccgaacgtcctcaacccaaagtagccaagttggctaatctaacgcaaagggtgggaggccacaccaaatgcactggttacatagcaaacacaaagtctggctgggttttaaagcagccttcgtctaaatcacgcaagcacacagcaacaattagcaaaactgcccagacatcgtttcaggtatcaaaggggctgagtgcaccrtgcacccttgcttgcacactgagtgctctcaccaatttctgggcctggagcgcggaggcttgggcacccacgcaacgcgccaaaggaagtcaggagagtgacgtcgagtgtctgaaccaacccagcctttttcagattagctgcatcctaagaagccccagtcctcatgtctctcagtatttagccatggtaagtgaaaacaaaggcctgcacattgcttctgactcaatttcttaactatattgtaaagcttcctgggaactgcattatgaaaattagaccactcattatggggtttca

SEQ ID NO: 174284 - DNA, 601 bp, Human
gtgcaggttgcagtgagccgagacagaaccattgcattccagcctgggcaacagagcaagactccatttcaaaaaaaaaaaaaaaaaaaaaaaaagtctttcctctcatcaaccccctaccccctgcccccgaacgtcctcaacccaaagtagccaagttggctaatctaacgcaaagggtgggaggccacaccaaatgcactggttacatagcaaacacaaagtctggctgggttttaaagcagccttcgtctaaatcacgcaagcacacagcaacaattagcaaaactgcccagacatygtttcaggtatcaaaggggctgagtgcaccgtgcacccttgcttgcacactgagtgctctcaccaatttctgggcctggagcgcggaggcttgggcacccacgcaacgcgccaaaggaagtcaggagagtgacgtcgagtgtctgaaccaacccagcctttttcagattagctgcatcctaagaagccccagtcctcatgtctctcagtatttagccatggtaagtgaaaacaaaggcctgcacattgcttctgactcaatttcttaactatattgtaaagcttcctgggaactgcatta

SEQ ID NO: 174285 - DNA, 601 bp, Human
gcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcrgatcacctgatgtcaggagatggagaccatcctggccaacatggcgaaaccctgtctctactaaaaatacaaaaattagccgggcgtggtggcgggtgcctgtaatcccagctactcgggaggctgaggcaggagaatggcgtgaacccgggaggtgcaggttgcagtgagccgagacagaaccattgcattccagcctgggcaacagagcaagactccatttcaaaaaaaaaaaaaaaaaaaaaaaaagtctttcctctcatcaaccccctaccccctgcccccgaacgtcctcaaccc

SEQ ID NO: 174286 - DNA, 601 bp, Human
aggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcytgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcaggagatggagaccatcctggccaacatggcgaaaccctgtctctactaaaaatacaaaaattagccgggcgtggtggcgggtgcctgtaatcccagctactcgggaggctgaggcaggagaatggcgtgaacccgggaggtgcaggttgcagtgag

SEQ ID NO: 174287 - DNA, 601 bp, Human
cccgcccacttggtgggctgccaggtttgtctcaaggccttctcaggggaatagctcattctcaggaggcaacttaagttcccaactgaaggaacttaaggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcaggagatggagaccatcctggccaacatggcgaaaccctgtctctactaaaaatacaaa

SEQ ID NO: 174288 - DNA, 601 bp, Human
tcttaactgtgttgtcacccgcccacttggtgggctgccaggtttgtctcaaggccttctcaggggaatagctcattctcaggaggcaacttaagttcccaactgaaggaacttaaggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcaggagatggagaccatcctggccaacatggcgaaaccctgtc

SEQ ID NO: 174289 - DNA, 601 bp, Human
cctcttaactgtgttgtcacccgcccacttggtgggctgccaggtttgtctcaaggccttctcaggggaatagctcattctcaggaggcaacttaagttcccaactgaaggaacttaaggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcaggagatggagaccatcctggccaacatggcgaaaccctg

SEQ ID NO: 174290 - DNA, 601 bp, Human
gtccctcttaactgtgttgtcacccgcccacttggtgggctgccaggtttgtctcaaggccttctcaggggaatagctcattctcaggaggcaacttaagttcccaactgaaggaacttaaggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcaggagatggagaccatcctggccaacatggcgaaacc

SEQ ID NO: 174291 - DNA, 601 bp, Human
tgtgtccctcttaactgtgttgtcacccgcccacttggtgggctgccaggtttgtctcaaggccttctcaggggaatagctcattctcaggaggcaacttaagttcccaactgaaggaacttaaggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcaggagatggagaccatcctggccaacatggcgaa

SEQ ID NO: 174292 - DNA, 601 bp, Human
aatggtgtgtccctcttaactgtgttgtcacccgcccacttggtgggctgccaggtttgtctcaaggccttctcaggggaatagctcattctcaggaggcaacttaagttcccaactgaaggaacttaaggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctaygtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcaggagatggagaccatcctggccaacatg

SEQ ID NO: 174293 - DNA, 601 bp, Human
aactcctgacctcaggtgatccacccacctcagcctcccaaggtgctgggattacaggcatgagccactgcgcctggccagcgcctcaggattaagccaccttgccaatttctttcctccccttgttgtaatgaacaacatgaccttatgtggtgttagtactatgctaccccactcatggtgcatgcacacccctcaaagatgggtggataaacttggagcattccgggaaaatcccccatgccaagtcttttttgtagcagggtgaggtagctctgttgactcaccagcttctttgctrtctggttttcagctcagcaagttctcaaatgtaaacagggctctatagaagaatgtttacccggtagcgcctaagaaaccagtaatgattcttcagagaggttactgagctggtgtccaaggggtgatcgcaggagcagggcagatgtgggcagatgcgctttggggcagcatcagcctcccattgaaccaggaggcccagcttccatttctatcaactttcaacctgttctgcttggaaaccacccaaactcgcacagccttggctctgagatttgacaaatattatgacagatgtttt

SEQ ID NO: 174294 - DNA, 601 bp, Human
cctgcaagcattaaacccgagtgctgttcctcactcacatctctctcaatctagcactctactagaatcttctaaagagaaataccagtctttaaattttttttttttgagacacagtttttttttttttttgagaccgagttttgctcgtttctcaggctggagtgcaatggcgcgatctcggctcactgcagtctccgcctcctgggttcaagcaattctcctgcctcagcctcacaagtagctgggattacaggtgtgcaccaccacacccagctaatttttatatttttagtagagmctaccatgtctctactctatctacttcaccatgttggccagactggtctcaaactcctgacctcaggtgatccacccacctcagcctcccaaggtgctgggattacaggcatgagccactgcgcctggccagcgcctcaggattaagccaccttgccaatttctttcctccccttgttgtaatgaacaacatgaccttatgtggtgttagtactatgctaccccactcatggtgcatgcacacccctcaaagatgggtggataaacttggagcattccgggaaaatcccccatgccaagt

SEQ ID NO: 174295 - DNA, 601 bp, Human
catttccttaaacatatggaacagtaccagagaagcaacatcccagactaacacggtaggttcctgccctgcaactgcaggattcccatgacaaagaattcatagcaaaaataaaagccggtgattaggaagctacaaaggctgtatacattgaaagcactttaaaatgagacaacatgcatacctgcaagcattaaacccgagtgctgttcctcactcacatctctctcaatctagcactctactagaatcttctaaagagaaataccagtctttaaattttttttttttgagacacagtttttttttttttttgagaccgagttttgctcgtttctcaggctggagtgcaatggcgcgatctcggctcactgcagtctccgcctcctgggttcaagcaattctcctgcctcagcctcacaagtagctgggattacaggtgtgcaccaccacacccagctaatttttatatttttagtagagcctaccatgtctctactctatctacttcaccatgttggccagactggtctcaaactcctgacctcaggtgatccacccacctcagcctcccaaggtgctgggattacaggcatgagcc

SEQ ID NO: 174296 - DNA, 601 bp, Human
attcacatggattaagctttcagagtccacaaaggacttcaggcgcaataatgcaaagaacagcagttatttagataaaggagtgccccgaagtattaagacatttccttaaacatatggaacagtaccagagaagcaacatcccagactaacacggtaggttcctgccctgcaactgcaggattcccatgacaaagaattcatagcaaaaataaaagccggtgattaggaagctacaaaggctgtatacattgaaagcactttaaaatgagacaacatgcatacctgcaagcattaaacycgagtgctgttcctcactcacatctctctcaatctagcactctactagaatcttctaaagagaaataccagtctttaaattttttttttttgagacacagtttttttttttttttgagaccgagttttgctcgtttctcaggctggagtgcaatggcgcgatctcggctcactgcagtctccgcctcctgggttcaagcaattctcctgcctcagcctcacaagtagctgggattacaggtgtgcaccaccacacccagctaatttttatatttttagtagagcctaccatgtctctact

SEQ ID NO: 174297 - DNA, 601 bp, Human
gggaagcggctgcatctgaatatctcatcttcctttaggtatgtcaggatgaaaagcctaattccagcaggcttagatcctgcagatgcttttccatattcacatggattaagctttcagagtccacaaaggacttcaggcgcaataatgcaaagaacagcagttatttagataaaggagtgccccgaagtattaagacatttccttaaacatatggaacagtaccagagaagcaacatcccagactaacacggtaggttcctgccctgcaactgcaggattcccatgacaaagaattcayagcaaaaataaaagccggtgattaggaagctacaaaggctgtatacattgaaagcactttaaaatgagacaacatgcatacctgcaagcattaaacccgagtgctgttcctcactcacatctctctcaatctagcactctactagaatcttctaaagagaaataccagtctttaaattttttttttttgagacacagtttttttttttttttgagaccgagttttgctcgtttctcaggctggagtgcaatggcgcgatctcggctcactgcagtctccgcctcctgggttcaagcaatt

SEQ ID NO: 174298 - DNA, 601 bp, Human; identical to SEQ ID NO: 81174

SEQ ID NO: 174299 - DNA, 601 bp, Human; identical to SEQ ID NO: 81175

SEQ ID NO: 174300 - DNA, 601 bp, Human; identical to SEQ ID NO: 81176

SEQ ID NO: 174301 - DNA, 601 bp, Human; identical to SEQ ID NO: 81177

SEQ ID NO: 174302 - DNA, 601 bp, Human; identical to SEQ ID NO: 81178

SEQ ID NO: 174303 - DNA, 601 bp, Human; identical to SEQ ID NO: 81179

SEQ ID NO: 174304 - DNA, 601 bp, Human; identical to SEQ ID NO: 81180

SEQ ID NO: 174305 - DNA, 601 bp, Human; identical to SEQ ID NO: 81181

SEQ ID NO: 174306 - DNA, 601 bp, Human; identical to SEQ ID NO: 81182

SEQ ID NO: 174307 - DNA, 601 bp, Human; identical to SEQ ID NO: 81183

SEQ ID NO: 174308 - DNA, 601 bp, Human; identical to SEQ ID NO: 81184

SEQ ID NO: 174309 - DNA, 601 bp, Human
cgagtgccactgccaagttccaggggccaccactgagtcactgcccgaggggatggctgcccatgagtgccgggaccaggagccctctggatggccgccctggctgctggcttgtcccttggaatcagatggaccaattccaccagtgttccagagaaatgaacaacacgtcctcccgcaaaaggaccctgagtagcctgtagcctggcagacccagtcttaattttctcaccttatttcccagggtgaatgtccacaaaagcaaaataacaccctcctccttagctatggcagccaaggmtgagatgggagagggagaagcctcatgcttgcagcacactctcgtttttcgagtggtcctaaaacccaagaggaaagtgatccgcgaggactgctgtccggcaggccaagggccaagagcgctgcgcccaggcccagctcacagccaggaagtgaacattctcagcacaacagctggctggatgccgcctccactcttctttcttctctaactttttcttaaaatctagtaacttctacagcatcccaggctcagagcccagtttacaggaaaacactagaacccatcacaaaggcatat

SEQ ID NO: 174310 - DNA, 601 bp, Human
ggccatcctcccctgcctcgctggggccacagccgggctcccagggctccctccgtccactcccggtcttgcagttgggagggcgtcccggaagcccatgcagcccaaaccctagaggactccctctggctcgaggctgaggagggatgggctggcctcagtgctccccgaagcacttccaagaaggcgcctcgcccgcccgctgtgtggataccgctggtggaggtgttgggtgaacagctctcaagttctaaaaatgtgcccctgacaacaacagaaggggatgtttgagaaaaataarggaaaatagagaagagaaaagtacgaattgttgccagaggaatctggcagagcggccagctgctgcacactcactcgccggccgcacaagaggctgggtgctgggctggcagcgtgtccagtgtggacacacacggggctgggtgagattctgcaggaatctaaaaaggccacaggcaacccagagatggatggctcagtctgacttctcactgtgtgaaagtttgagaacgcctactgtgcgctgggtacccggatccctgcacctcacaaaaaggctctggcaccacccggggtgacg

SEQ ID NO: 174311 - DNA, 601 bp, Human
ggaatgtgattgttcgatctatcaaccaggcacacaaaatcaagaaccaagggcctgaggcttctcacgtgaggcatgcgctcttcccacccgggtgtctctctagatcttgcagcctaaaagagacgtcatcatggtaactgttatcagaacggcggagaacagaagggcacatccaagcaagaccgagacgccacaggatagtaacacgtgtgtgctggccccactccccaagctggatgcagggacacacggtcctcctcacggtgtcctattggcccagcaggcattcatggccccrgtgataagaaaccttgtcctaacctggacgacacagtgaaatcccatctctacaaaatttactgggcgtggtgccacgtgcctgtagtcccagctacttaggaggctgaggcaggtggatcccttgagcccaggagttcaaggctgcagtgagctatgagtgtgccactgcacttcagcctgggtgacagagtgagacttggctctaaaaaattaactgaaaaaacaaacacctgatccaagaaatggatctatgtcaacttggcccttaacactggcctctaagagggttaatgcaaga

SEQ ID NO: 174312 - DNA, 601 bp, Human
gttggaaagaccaccaagaatgcccaccatctgctcagcctcacctgtaatgaaaaccagctgcctgtagccaaggggccgcctgggatacccctactttacatatcccatgtgggcagggtgcattctgtgccacagtaattagacacagactagactttcccaggatgtgcctggaagctggggaaatacctgagactggaaacgcccgaagttgtaaaatagtctcgtgcgggcaccgctgccgtcagcctcttttacttaattggttttcaatactttattgcagcaataaaatcayctatgcaccaagaacccaaacacacagggagtcaagtttctggtaacaaagggatggtaaacagttagctccttataccatatgctgagcatcatgaccatggaatacagcctgtcccatttagaaggatggtcacggccacttctcttgcaccctccacacaaccctgtgccgtaggcgctgctgtttccccagcaggtaacggaggcggggggaacttgcccggggtcacacagcaagtaagtgatggagtcaggactcaaactcaggtctctctgacaccagagaccaagcatgcaa

SEQ ID NO: 174313 - DNA, 601 bp, Human
gtggccgatcctccaagcctctgtggaagagatgagcctcagggcatcgccaaagactaaaaattgttgttgttgttgttttgagatggagtctcacgctgttgtccaggctggagtgcagtggcgcgatctcggctcactgcaacctccgcctcctgggctcacgtgattctcctgcctcagccttccagatggggtttcaccaagttggccaagcaggtctcaaacttctgaactcaggtgatccgcccgcctcggcctcccaaagtgctgggattacaggcatgagccaccgcgcccsgccaaaagaagcacaaacctgccaaggacaaaaaggggctcccatatgactatctgttcaccctggtgaactcagtcgtcaaaaccaggactggctggtccacctaactcattcctccttgggaggtgcccacctcgcctctccaagctgccagccagcagcaaagaatgctatgactatggcgatgggccttctgtctcgagggtggcagctgccagcatgtggttccagcccacagctcctaaactatgagattctcagttcaaaggcccaagctccgagttgtgaggtggtctggag

SEQ ID NO: 174314 - DNA, 601 bp, Human
tctgatgctccccagagcctgggccatgttctcaggcccccaaaagctttctgggtgatcatgttaataacgaagagcatgtgtggtatcttccagggttggaaagagatgtccagacccacaccatcaagttcagaaaaaacacaaaatacaaacccccctgaaaacgaagctcatctgcaaccctagaaagacaagcacgtgcagtcacttcaacgggttcctcagagcccctggggaagctgcagcccgcaccctgcagtgtccgcgctatgcggaacggaggagcacagcgggcccrgaacacaggaaagtgacagctatttcccggtttgtaatggagtttaaaataaaaacaaaaccaagagtgatgttaggtgcttgaaagtgtttttaggcactggtggctttttggaagcccagacaccgtcctgttggctgcctctggtgttgagtgttcaggctccgtcaccttcacctaaccccgggtgcagctcatgttctggggtgaatttttgccctgagggagcaggtgccatccacccggggcagatccaacaaccccacccagcctgtgtgaatgcagacactgctgactcac

SEQ ID NO: 174315 - DNA, 601 bp, Human
tgggatctaaacaacaacaaatgttctgcagttggctgatctggaaagtgagcaagccacggtgactccccctccttgtgtccccagcagccgggaaggtgcctgttcccacggcagctgcagagaagactgcgggcaacaggcatctcccctctgcctttcacgagaaggaccacaggagcagggtgctgatgagcgggtggctccgggagcagcttcaaggcataatttggaagaaaatctgtgttgctaagagtggcactattttaaggttaaaaaaaaaaaaaaaaaaaaaaagcamctgctattggaaatctcagctttgtttctacgttgttatctgctttttcatttggcaaatgggctttctctctgtgttgcttctgggaagctctcccaatgctgcgtccacttctttgcccagcttcccagaggctgcgatttcattttacagtctcagtaatgtataggtagtatgtgctcccccagaatggagaacccaatccttgagttttaagtatcacctgacacgcccaacagattccctggctcatgtgcacactcctcctcccaccatgcaatgcaaatgcgcaacccttat

SEQ ID NO: 174316 - DNA, 601 bp, Human
ccccctccactggggccgtgactgcatcctgttaagactatacacggtgctggggagggacggcccagagcacctgcaccagccctgcatggaaggccgtgctcggccagtgggacttgggataattgtctctttgagcacaaagtacaaaaaaggcttttgtcccagcctcagaagaatgggctggggtagccaggtccacagccagccccgcatggcccccaagctaagtgcagttctcctgccacccccggctgggagaaatcatggcccctctcagccctgagcggcagctgcaccygacgctcagacaccaaaggcacacgtgcacccagtcactcctgctgctgccccgacacccaggtccccaaacagggtgtccgcatggatccgcactccaacatccttctgcaccaggaaaacagggcaggggagggggaaaataaggcagggacgagggccaacacccccgtgtcctcaccagcccacgacctgtatgagtggacaggaagcgtgcagcacaaagctggataccccctcagctcatccgcgagatccgcaacagcaccgtcacctgacgaggaacccgacacacatggct

SEQ ID NO: 174317 - DNA, 601 bp, Human
cctcagggcctcttttctctctttattctgtgcagcaaacccagcaggctccgaagacctcagagacagagaagcagcattttctccaacaaaaactgcccccttcaaatccatccttggatttcgtaggtcctcctgaccatctgcccaaacctcacatcttcaagacccacaccctggacacaagagaacaactacctgagttccagaggtgcaatccgccgagatgccaggaaggggcaatgtctcttgtcaaattagaactctttagcctcagattaaaactttggggctcatcaasttttcagatatccagatcaaccctgacggcggccttacatccccatcccctccctccctctgaggctggacggtccaggccattgctccaggctgagcccagcctggtgacccaccatgggtaacccaaccaggaaggtgtgacattcccgggatcactggcctttgagcacaaggcagcaggctcagggtcccacaggcaaaagcaggagccttccacaaaggccaacttcatctgtgtggcctcgccttccatccctaacctcctcaagggctcttagtagtccccaagctggccact

SEQ ID NO: 174318 - DNA, 601 bp, Human
ggcagacaccctgcggggcccgcccaggatgcagcgagagcctcagggcctcttttctctctttattctgtgcagcaaacccagcaggctccgaagacctcagagacagagaagcagcattttctccaacaaaaactgcccccttcaaatccatccttggatttcgtaggtcctcctgaccatctgcccaaacctcacatcttcaagacccacaccctggacacaagagaacaactacctgagttccagaggtgcaatccgccgagatgccaggaaggggcaatgtctcttgtcaaattasaactctttagcctcagattaaaactttggggctcatcaagttttcagatatccagatcaaccctgacggcggccttacatccccatcccctccctccctctgaggctggacggtccaggccattgctccaggctgagcccagcctggtgacccaccatgggtaacccaaccaggaaggtgtgacattcccgggatcactggcctttgagcacaaggcagcaggctcagggtcccacaggcaaaagcaggagccttccacaaaggccaacttcatctgtgtggcctcgccttccatcccta

SEQ ID NO: 174319 - DNA, 601 bp, Human
cctgagggcaggaggcctctaggggctcaggagagcaaacttctcaaaggaccacacagcaagcagctctctagacaggccagagccatcatattaatcctgacagatttcctggtgctgccaacaaggtgaagggacagctgtgaggacagaggggcaggggtgaccccaggaagggccccagtggtccttcccacaagtccaagtacaaattctctagcaacttcatctggaccagcgcggctgcatctagacgttcagcagggtggtggaaggccttacctgccacactacagacgcrcatgcttgcgccccgtgcacatacagggcagacaccctgcggggcccgcccaggatgcagcgagagcctcagggcctcttttctctctttattctgtgcagcaaacccagcaggctccgaagacctcagagacagagaagcagcattttctccaacaaaaactgcccccttcaaatccatccttggatttcgtaggtcctcctgaccatctgcccaaacctcacatcttcaagacccacaccctggacacaagagaacaactacctgagttccagaggtgcaatccgccgagatgccagg

SEQ ID NO: 174320 - DNA, 601 bp, Human
cgtgcctccctgcctgcaccggcaccagctgcccctcacacactatgacaggggataaggcgtgtgcgtccaaaggaacttcctggacaggccctgcacaaacaggcggcctgggcaggctcctccagcccctctcacctgcgctgggtgaggagaaatggcgggtctggggcagggaaggtatgcctgagggcaggaggcctctaggggctcaggagagcaaacttctcaaaggaccacacagcaagcagctctctagacaggccagagccatcatattaatcctgacagatttcctggkgctgccaacaaggtgaagggacagctgtgaggacagaggggcaggggtgaccccaggaagggccccagtggtccttcccacaagtccaagtacaaattctctagcaacttcatctggaccagcgcggctgcatctagacgttcagcagggtggtggaaggccttacctgccacactacagacgcgcatgcttgcgccccgtgcacatacagggcagacaccctgcggggcccgcccaggatgcagcgagagcctcagggcctcttttctctctttattctgtgcagcaaacccagcaggc

SEQ ID NO: 174321 - DNA, 601 bp, Human
ggcaccgcctccacctgcatcaccttccagggagccactgacacgaagaggagccacttcccatccacttgcggctctggctggagacgcacacggctgcttccctgccagcagaccatagtcccgagagcctcaggaccatggggccccgaggccagcacaggctagtccagcacaggacgggtccctgcaccgcgtgcctccctgcctgcaccggcaccagctgcccctcacacactatgacaggggataaggcgtgtgcgtccaaaggaacttcctggacaggccctgcacaaacagscggcctgggcaggctcctccagcccctctcacctgcgctgggtgaggagaaatggcgggtctggggcagggaaggtatgcctgagggcaggaggcctctaggggctcaggagagcaaacttctcaaaggaccacacagcaagcagctctctagacaggccagagccatcatattaatcctgacagatttcctggtgctgccaacaaggtgaagggacagctgtgaggacagaggggcaggggtgaccccaggaagggccccagtggtccttcccacaagtccaagtacaaattctctagc

SEQ ID NO: 174322 - DNA, 601 bp, Human
ccccactcatcactcagggcagggcttgggcaagcgagggtggcggagcagcgagggcaccgcctccacctgcatcaccttccagggagccactgacacgaagaggagccacttcccatccacttgcggctctggctggagacgcacacggctgcttccctgccagcagaccatagtcccgagagcctcaggaccatggggccccgaggccagcacaggctagtccagcacaggacgggtccctgcaccgcgtgcctccctgcctgcaccggcaccagctgcccctcacacactatgacaggggataaggcgtgtgcgtccaaaggaacttcctggacaggccctgcacaaacaggcggcctgggcaggctcctccagcccctctcacctgcgctgggtgaggagaaatggcgggtctggggcagggaaggtatgcctgagggcaggaggcctctaggggctcaggagagcaaacttctcaaaggaccacacagcaagcagctctctagacaggccagagccatcatattaatcctgacagatttcctggtgctgccaacaaggtgaagggacagctgtgaggacagaggggcaggggtga

SEQ ID NO: 174323 - DNA, 601 bp, Human
agctccccactcatcactcagggcagggcttgggcaagcgagggtggcggagcagcgagggcaccgcctccacctgcatcaccttccagggagccactgacacgaagaggagccacttcccatccacttgcggctctggctggagacgcacacggctgcttccctgccagcagaccatagtcccgagagcctcaggaccatggggccccgaggccagcacaggctagtccagcacaggacgggtccctgcaccgcgtgcctccctgcctgcaccggcaccagctgcccctcacacactatsacaggggataaggcgtgtgcgtccaaaggaacttcctggacaggccctgcacaaacaggcggcctgggcaggctcctccagcccctctcacctgcgctgggtgaggagaaatggcgggtctggggcagggaaggtatgcctgagggcaggaggcctctaggggctcaggagagcaaacttctcaaaggaccacacagcaagcagctctctagacaggccagagccatcatattaatcctgacagatttcctggtgctgccaacaaggtgaagggacagctgtgaggacagaggggcaggg

SEQ ID NO: 174324 - DNA, 601 bp, Human
gggcagctccccactcatcactcagggcagggcttgggcaagcgagggtggcggagcagcgagggcaccgcctccacctgcatcaccttccagggagccactgacacgaagaggagccacttcccatccacttgcggctctggctggagacgcacacggctgcttccctgccagcagaccatagtcccgagagcctcaggaccatggggccccgaggccagcacaggctagtccagcacaggacgggtccctgcaccgcgtgcctccctgcctgcaccggcaccagctgcccctcacacamtatgacaggggataaggcgtgtgcgtccaaaggaacttcctggacaggccctgcacaaacaggcggcctgggcaggctcctccagcccctctcacctgcgctgggtgaggagaaatggcgggtctggggcagggaaggtatgcctgagggcaggaggcctctaggggctcaggagagcaaacttctcaaaggaccacacagcaagcagctctctagacaggccagagccatcatattaatcctgacagatttcctggtgctgccaacaaggtgaagggacagctgtgaggacagaggggc

SEQ ID NO: 174325 - DNA, 601 bp, Human
ctgcctctgcttttcttcggaagcctctgtcatcaactgtgttgggcaggggcccacctgctttggtgctgacctggaccacatgctgctaaggctgccctcccagaacgggaggcccaggttcccatgtggacaggggcctagagctgtgcacacggcaggggcagtttaggggacacacacggcaggggtcatttaggggacgcacccagcaggggtggtttagaggacatgtggccagtcgcattctcccctctggaggcggcactgggtgtctccaaattgagcctgtgccagctgrgtgttgctctgagggcagagatgcctcacagccccgcagaccccacacaagggccagcagggactatcctacctgtgtcatgtgaaggcagggccgcaaggtgctccacagcccggcctggaggcagccaccttgctacagccagaagcggctgctccgtggtcccagttccagctgcttctccaagcccacccgagcagggcccacagagctccggacaactccaggcagccagcgctgcctcgcactcaccgagctcgccggcagccttgatgtccacgttgtcatagccactgccta

SEQ ID NO: 174326 - DNA, 601 bp, Human
gaaatagcgcctgggctattcctggagcacaggaagagctgttccaaggccaggctgctgccttggaattcatggtgcctcatgaatttggggcacctcagcactcgtaaggcagagtacagcccccacccccaaaatgcaggggtggcgtgttccaaacacagagcaagcacagtgcccacctggccctctcccgaggacgctcgatgccagcggtctgcttcttgtgcctctgcactcagcactcacgagctcacacggggtgctgggcagaggcccccctcaacatgcacccccagcygcaagtgcatggggccgataagcagctttgaagcccccaactctgggttcccgcctgctgcctctgcttttcttcggaagcctctgtcatcaactgtgttgggcaggggcccacctgctttggtgctgacctggaccacatgctgctaaggctgccctcccagaacgggaggcccaggttcccatgtggacaggggcctagagctgtgcacacggcaggggcagtttaggggacacacacggcaggggtcatttaggggacgcacccagcaggggtggtttagaggacatgtggccagtc

SEQ ID NO: 174327 - DNA, 601 bp, Human
ctcattttccgcctccagagtctacattcgaaaagtgccctttaaaagggccccgcagatgtcttccaagcgcccttatcagatgggaccaggatcaatgaaaatccaccactcacagcccttctacattttccaaaaccgcagtccctggtcctggtcgtcttctgtgggtctcagaactcagggaacacaacctcccatctcggccctcccaggccccctgtcattgaggccttggtgcctttctggccccactgcctgtgcggggcacttctagaaatggagaaataggaagttccayaggcaaggacctcccctctctccctggaaagcagcgtctggtccagccgaggaagggcagggtcagcacccgtatgggcctgggagctgtgtggtgaggggccgacgtgctggagaagcaagaggtgcgggggacaaggatttgagagcccctggcacatgaagctgtattctcctctgctgttgaaacttgggatttcagctctacccagagcacaaaggacatttgttttcaaacaaaaatatccttgtttgtgccagggaaagatggaaaattttagtttatattaaacacgccttt

SEQ ID NO: 174328 - DNA, 601 bp, Human
cagccctcagcacaaaaggcccgttgaccgcatgatgtggggaatatgcattcggagacaaaggacgtctggacagaggctcattttccgcctccagagtctacattcgaaaagtgccctttaaaagggccccgcagatgtcttccaagcgcccttatcagatgggaccaggatcaatgaaaatccaccactcacagcccttctacattttccaaaaccgcagtccctggtcctggtcgtcttctgtgggtctcagaactcagggaacacaacctcccatctcggccctcccaggcccccygtcattgaggccttggtgcctttctggccccactgcctgtgcggggcacttctagaaatggagaaataggaagttccacaggcaaggacctcccctctctccctggaaagcagcgtctggtccagccgaggaagggcagggtcagcacccgtatgggcctgggagctgtgtggtgaggggccgacgtgctggagaagcaagaggtgcgggggacaaggatttgagagcccctggcacatgaagctgtattctcctctgctgttgaaacttgggatttcagctctacccagagcacaaagg

SEQ ID NO: 174329 - DNA, 601 bp, Human
cgggggtggggaggggtgtagggccctctcgaggtcttcccggctcgtggggagaagtgcaggtgagcagcttcctcaagccttgccctgctcttgccgtgaagcgctgactctcgcctgtcattccagggctgacagctcagagccttgcgatcccagaaggtgtcaccagaggcctagtgtgctgcctcgtgcaacatggagggccttgttttctgggcctgcgagggaccctctttcatcaggagagggcctgcctgcagccacctgccgctcccagccctcagcacaaaaggcccgytgaccgcatgatgtggggaatatgcattcggagacaaaggacgtctggacagaggctcattttccgcctccagagtctacattcgaaaagtgccctttaaaagggccccgcagatgtcttccaagcgcccttatcagatgggaccaggatcaatgaaaatccaccactcacagcccttctacattttccaaaaccgcagtccctggtcctggtcgtcttctgtgggtctcagaactcagggaacacaacctcccatctcggccctcccaggccccctgtcattgaggccttggtgccttt

SEQ ID NO: 174330 - DNA, 601 bp, Human
tggcgtcaacagcagcacctcctcctaggagatgagctgatgctggctgggagaccccacaaggccacgtgtgtaaaggcacccgggtgggtgggtggcacaaaaaggcaggttgaggcaggacatctggtcagtcttctcaccgaacttggacattcagctccgtggttccactgctcaccggagtgcagagtcccaggacggggagatggtgcaggaggaagagctgcagccactgcctgggatggcagaaccttcccacccagaccgcggcggcgccactgccaggaacctccataaccctcaccgctctctcggagggagcatcttcttagctgtcctctatcgctctgtggatgcagcctcccttctggatgagtcaagctgatccttcaagtgccacacgatgggtggctctgatactcgcaggctgggcctcccagcatccacggagcctggaaaacggccccaaagaggcaagctgcttttctctcacggtcagtgccatcgtgctttaatcccttcatgactgccgctggcaaggaaaccacataaaccagcttgctagaggcggcgggggtggggaggggtgtagggccct

SEQ ID NO: 174331 - DNA, 601 bp, Human
ttaaggcagcccaggattcctctatcttaagtcctgaagattggggtggggacagattggggtggggacggcaatcaccaaggcagcttcttcggctctactggacaggaaacaagaccagtgggtgccacaaacccactttctagatggctgcgtggctgtctccccacaagggccacccctaggtctagggccttgagagtgacccgcttagcaagacacacagctcagagaaggtgaagccactgtgagcaggtcacccacccacccaacgtggccactgagggctcctctgggccaycgacccctgccaagggaccagtgtggttgacggtgactgaggccgaccaactttcccacgagctggatgccaggaatcttgcaggaaactggcctcattcatttgaaatagctcagcagagaagctggggcttgatcacatgccatgttattattaagtcagacagactgaggctgatgccagaggttcaagaaaatctttggcggctgggacaattttcattcctcgggcaggctaaagcccagcagggaggccccgcagcagaatcaccctcaaggacgctggctccgtgctgctgcc

SEQ ID NO: 174332 - DNA, 601 bp, Human
catactggttttaaaaaaacacctccacccccacacggatgcaagggctggccccgggaacggaaccgatggccgaagcgtgtgcacaatcgccctgtggtcatgtgctcagcaccctgctctgctgggaagaactcagagcagacaggatgccctccctgccccgtggagcagccttcaggtcagggccgagggtggcttggggtgagccctctggccccacacgagctgcagagaccagggtcaagtatctcccagcacaaagcagctgtggcatggagagttaacccaagtcataggyagaaagggccctgccatttaccctcctcagccagagggtgtctggggaagaatgaatgactgccagatacaacaggggtgcaagtaggcagagggccaggctgggaacggcccctccctacacccgacaggtggagatccagaggcctgcttgcagcagagaccagaggggccgagccaggggcggggccccagagggtgggctcagcagccagcctgtggctcccagttgagctctctgaggaggggtgtggctatctgggcatcacgtcagcccaagtgaaatggttccctcctaatc

SEQ ID NO: 174333 - DNA, 601 bp, Human
tcctgggcttgcactgagtcccaagaaaggacccggagtggcaggaagccagtgggcctcagaccagactcctccaagtggaccccactcagcctcaaacccctcagggtctccctcatggagctggcagggtgacaaagaatggcttttggttttaagctatgctaacagtttgatgcaaaaaacatacgttttaaacatactggttttaaaaaaacacctccacccccacacggatgcaagggctggccccgggaacggaaccgatggccgaagcgtgtgcacaatcgccctgtggtcrtgtgctcagcaccctgctctgctgggaagaactcagagcagacaggatgccctccctgccccgtggagcagccttcaggtcagggccgagggtggcttggggtgagccctctggccccacacgagctgcagagaccagggtcaagtatctcccagcacaaagcagctgtggcatggagagttaacccaagtcataggcagaaagggccctgccatttaccctcctcagccagagggtgtctggggaagaatgaatgactgccagatacaacaggggtgcaagtaggcagagggccaggct

SEQ ID NO: 174334 - DNA, 601 bp, Human
caacccaactcctatggctgattttgggcctgactggcttcctcctgggcttgcactgagtcccaagaaaggacccggagtggcaggaagccagtgggcctcagaccagactcctccaagtggaccccactcagcctcaaacccctcagggtctccctcatggagctggcagggtgacaaagaatggcttttggttttaagctatgctaacagtttgatgcaaaaaacatacgttttaaacatactggttttaaaaaaacacctccacccccacacggatgcaagggctggccccgggaayggaaccgatggccgaagcgtgtgcacaatcgccctgtggtcatgtgctcagcaccctgctctgctgggaagaactcagagcagacaggatgccctccctgccccgtggagcagccttcaggtcagggccgagggtggcttggggtgagccctctggccccacacgagctgcagagaccagggtcaagtatctcccagcacaaagcagctgtggcatggagagttaacccaagtcataggcagaaagggccctgccatttaccctcctcagccagagggtgtctggggaagaatgaatgac

SEQ ID NO: 174335 - DNA, 601 bp, Human
gtgagcagggtggggacctcctcgagcccccatggaatcaggctgcttaccatcaccttctccgtggcaccggcccctaccaccctgctgaagaccctcctgggcctctcctcacgtctccttttcctgcccctctctcaggagagctttccaagctgatggcctgactgtgccaccccaacctggcatttgaaggccttcaggagtgaggccatgtccataacccgcgtctccactgaaccctacgccagcccctacacgagccccaagcctggctgctgctttacgacacacctccatrcagcccctgcccttcacccctgcccagggaaatttactgggcacagcgccttgcccgctgccccacagcaaagaatgctgtcctgccagacactacagacagcagtggacacgcattcttccagaaccagcccagatcctgcctctagggtgagttgcctgatgggtcttgactccgatctcctaccccgtgcaacacggggagggtgctggccctgcctgccctggctcctcaagagcaggctggggttgcctttcccgaggggtccccactacaccagccccagtgtcggaggggttg

SEQ ID NO: 174336 - DNA, 601 bp, Human
cagctgggagtctcccggaggccagaacattactggccccgtgtgcacatgcgccttcttggagtcccaaaaggcagataccacgtatcccaccaaatatctacttacagattgggaaattgaggcaaaaagctcaggtaattcccacaaggccacagagctggtaagcggtggggttgagattcagtggcaacgggccgaggtctcctgggtgtggtgtggaccctgatggtgagcagggtggggacctcctcgagcccccatggaatcaggctgcttaccatcaccttctccgtggcaccggcccctaccaccctgctgaagaccctcctgggcctctcctcacgtctccttttcctgcccctctctcaggagagctttccaagctgatggcctgactgtgccaccccaacctggcatttgaaggccttcaggagtgaggccatgtccataacccgcgtctccactgaaccctacgccagcccctacacgagccccaagcctggctgctgctttacgacacacctccatacagcccctgcccttcacccctgcccagggaaatttactgggcacagcgccttgcccgctgccccacagc

SEQ ID NO: 174337 - DNA, 601 bp, Human
agaggagcacgggggcttcgtcctcggaggcgcggagctccaagcaagggctgagcagcagctgggagtctcccggaggccagaacattactggccccgtgtgcacatgcgccttcttggagtcccaaaaggcagataccacgtatcccaccaaatatctacttacagattgggaaattgaggcaaaaagctcaggtaattcccacaaggccacagagctggtaagcggtggggttgagattcagtggcaacgggccgaggtctcctgggtgtggtgtggaccctgatggtgagcagggtrgggacctcctcgagcccccatggaatcaggctgcttaccatcaccttctccgtggcaccggcccctaccaccctgctgaagaccctcctgggcctctcctcacgtctccttttcctgcccctctctcaggagagctttccaagctgatggcctgactgtgccaccccaacctggcatttgaaggccttcaggagtgaggccatgtccataacccgcgtctccactgaaccctacgccagcccctacacgagccccaagcctggctgctgctttacgacacacctccatacagcccctgcc

SEQ ID NO: 174338 - DNA, 601 bp, Human
ttctctcttgttcaagtggcaccccaggtccagagcggggcttgtggggagaggagcacgggggcttcgtcctcggaggcgcggagctccaagcaagggctgagcagcagctgggagtctcccggaggccagaacattactggccccgtgtgcacatgcgccttcttggagtcccaaaaggcagataccacgtatcccaccaaatatctacttacagattgggaaattgaggcaaaaagctcaggtaattcccacaaggccacagagctggtaagcggtggggttgagattcagtggcaaygggccgaggtctcctgggtgtggtgtggaccctgatggtgagcagggtggggacctcctcgagcccccatggaatcaggctgcttaccatcaccttctccgtggcaccggcccctaccaccctgctgaagaccctcctgggcctctcctcacgtctccttttcctgcccctctctcaggagagctttccaagctgatggcctgactgtgccaccccaacctggcatttgaaggccttcaggagtgaggccatgtccataacccgcgtctccactgaaccctacgccagcccctacacgag

SEQ ID NO: 174339 - DNA, 601 bp, Human
atccagggtggtggcggcaggggttagtgtacagtctcgagaaaacagggcggcggcagggggctgcactgacctctatacaccgagagggtttttaaagttgaatgacaagggcacagctacaggaacgaccccaggaagaagtcccgtgacggctggagtcagaagcccctgaaacaagcacctccccagtgaggccccaccgtgtacccagggtgctcatgaccacccccaggctctgcagcctggccagagaccaccgaggccccaggaggggcttcagagatggagatgaagctgyatctccgagccatgaggcccagtggggcccggacagagggagcctggtgttcacacaccacatctgttttccaacaaagtcaaaacacggtgggtcctttcagaagatccccagcacccgacacttcaactcagactccaggcgtcgggcgaggccagacccaggagatcacagcctgtagcggggacagaaaggtgtgcactcctggaagcgtccagcaacttctctcttgttcaagtggcaccccaggtccagagcggggcttgtggggagaggagcacgggggcttcgtcctcggag

SEQ ID NO: 174340 - DNA, 601 bp, Human
acagtccctgtgctgaggatccagggtggtggcggcaggggttagtgtacagtctcgagaaaacagggcggcggcagggggctgcactgacctctatacaccgagagggtttttaaagttgaatgacaagggcacagctacaggaacgaccccaggaagaagtcccgtgacggctggagtcagaagcccctgaaacaagcacctccccagtgaggccccaccgtgtacccagggtgctcatgaccacccccaggctctgcagcctggccagagaccaccgaggccccaggaggggcttcasagatggagatgaagctgcatctccgagccatgaggcccagtggggcccggacagagggagcctggtgttcacacaccacatctgttttccaacaaagtcaaaacacggtgggtcctttcagaagatccccagcacccgacacttcaactcagactccaggcgtcgggcgaggccagacccaggagatcacagcctgtagcggggacagaaaggtgtgcactcctggaagcgtccagcaacttctctcttgttcaagtggcaccccaggtccagagcggggcttgtggggagaggagcacg

SEQ ID NO: 174341 - DNA, 601 bp, Human
cctgtcccactggtggggcctcgcgcccatctgcattatgcagcctgggcctcccgccagctatgtcacaggatgaggaggtgtctcccactccccaacggctgtcatttcataaacccatggggtccccctcgatagcacctccagcttcccagagcagttttcagcattttgaaaacaaaatggttagtgttgatgctcgactggttctcttggagatcacagaaggaatctttaaagccatggctccaaggtgcaggcaggagaaggacaaagatgcgcatttccgagcaggcagccygtgttccaggggtacctcaatgctggatggctcctcctgcagcagctccatctaaccgatggcctggctaggacaactgccgtagtttagaacaaaggttgaataaggccagtctgatcagggacagctgcaggacaactagtatagcaaggcacgaaccatcacgcctctcctcctcagtgtcaccctttacagcaggcaggactggacggtggcagggacggagtgagagatggctctctgacgcactggcaacatgaaactgaggaccccagcatgcaactgctgggagctcacact

SEQ ID NO: 174342 - DNA, 601 bp, Human
ggggtcataaaatatgacgctgaatccaaaggccttggctcgaactgcaaccgcctgccccgtgcgacctgtacagaaacagagcgtccaggtgagtgagtccacagcccgcgccccagcgctgccacctccattgcttctgagctgagtccgggcttggcatccccgctggtagctgctgccagagaaaccgtgtgcccaaagcttagtgaggcctgaggcgagcactgcccgcgaggggccaccatggccggtgtaggacaggtgaggaccgcagtgcttgctgcttatattgggtacrgcaggatttttgttaaaaacaaaacaaaacccttccttgttattgacattttcaaacacagagtgttctgacaagcccacatgcccctcccatcaccacccgtgtcctccgttcccacccctctccccacttcttgtgtgcactgcaggcttcttaacatgagctttgtgtttgaaaaacttgctctcaatgtcacagggagtaatgtcctgcctcctcattgctgggctcgctcctgcaaagggtgacatgagcacaatggctccctgcaggctggcccgagtgcagactggccacatg

SEQ ID NO: 174343 - DNA, 601 bp, Human
tcagcctccctagcagctgagactgcaggtgtgcgccaccacacgtgactgggaagccttctggttttaagatggctttagaatgaaaggcagttcctagcacctgtggtcaatcacatctgaccgaacacacccccttttaaaataggagcttctgtttgttccatgaaattaggcattggaagaaatgggggcggtgtacacagttcctgctgagaaggctgattgttctgaccctgacttagcatctgcgggaggttaagcttccgccaagtttgggcttctctccctggccccgggsccgtggtgctcacaagctgagacaaagtcagttccttttctcacctgtatgtggcaccattgagctcaggatgaattgcttgctggtctattactgaccaaggcgctgatgtgacaaagaattccttgttcacacaatttcttaagctttctgggatgcgacctagggtaagatgattaaaattaatcatattatttttacaaatcacagtaagttcaacattacacctgtagctgcttatgtggggaaataagcatttgtaaaaatgtagaacatccaaaggcccaagtgcttgagctc

SEQ ID NO: 174344 - DNA, 601 bp, Human
ctgccatcctgtcaccaagaccttcagaaggactctggtcattagggtcccttcctcagtgcacacatactgttctagggggcctaagagccccagcttacgtgaaggataaataacaatggagacatggaagaggtgggcccccagctccacccaacaggggaatctggtgctgtgataggctcaaaatacttttgagggccaaaaggacggggctggatgaaatgtgaagacagccatgtgacctgcaagcaccggcatagcttcttcaagagtgtcagagccttcattacacaaactraatgcaccctggtcgtcactgtggctacagcaggggacatgtggctggagacattctcaatcatcatgagtgggagtgggaggtgctactggcatcccgtgggtagaggccagggatgccgctgaacgtcctacaatgcacaggacaggccaggcctcctacgagagaatgaagagaatgatctggccccaaatatacttattgccaagagctagaaaccctggtttagaatatgcaaaaatttttcttaagattcaaggctgcaacttcattcatttatgcatgagggggctactgatt

SEQ ID NO: 174345 - DNA, 601 bp, Human; identical to SEQ ID NO: 174153

SEQ ID NO: 174346 - DNA, 601 bp, Human; identical to SEQ ID NO: 174154

SEQ ID NO: 174347 - DNA, 601 bp, Human; identical to SEQ ID NO: 174155

SEQ ID NO: 174348 - DNA, 601 bp, Human; identical to SEQ ID NO: 174156

SEQ ID NO: 174349 - DNA, 601 bp, Human; identical to SEQ ID NO: 174157

SEQ ID NO: 174350 - DNA, 601 bp, Human; identical to SEQ ID NO: 174158

SEQ ID NO: 174351 - DNA, 601 bp, Human; identical to SEQ ID NO: 174159

SEQ ID NO: 174352 - DNA, 601 bp, Human; identical to SEQ ID NO: 174160

SEQ ID NO: 174353 - DNA, 601 bp, Human; identical to SEQ ID NO: 174161

SEQ ID NO: 174354 - DNA, 601 bp, Human; identical to SEQ ID NO: 174162

SEQ ID NO: 174355 - DNA, 601 bp, Human; identical to SEQ ID NO: 174163

SEQ ID NO: 174356 - DNA, 601 bp, Human; identical to SEQ ID NO: 174164

SEQ ID NO: 174357 - DNA, 601 bp, Human; identical to SEQ ID NO: 174165

SEQ ID NO: 174358 - DNA, 601 bp, Human; identical to SEQ ID NO: 174166

SEQ ID NO: 174359 - DNA, 601 bp, Human; identical to SEQ ID NO: 174167

SEQ ID NO: 174360 - DNA, 601 bp, Human; identical to SEQ ID NO: 174168

SEQ ID NO: 174361 - DNA, 601 bp, Human; identical to SEQ ID NO: 174169

SEQ ID NO: 174362 - DNA, 601 bp, Human; identical to SEQ ID NO: 174170

SEQ ID NO: 174363 - DNA, 601 bp, Human; identical to SEQ ID NO: 174171

SEQ ID NO: 174364 - DNA, 601 bp, Human; identical to SEQ ID NO: 174172

SEQ ID NO: 174365 - DNA, 601 bp, Human; identical to SEQ ID NO: 174173

SEQ ID NO: 174366 - DNA, 601 bp, Human; identical to SEQ ID NO: 174174

SEQ ID NO: 174367 - DNA, 601 bp, Human; identical to SEQ ID NO: 174175

SEQ ID NO: 174368 - DNA, 601 bp, Human; identical to SEQ ID NO: 174176

SEQ ID NO: 174369 - DNA, 601 bp, Human; identical to SEQ ID NO: 174177

SEQ ID NO: 174370 - DNA, 601 bp, Human; identical to SEQ ID NO: 174178

SEQ ID NO: 174371 - DNA, 601 bp, Human; identical to SEQ ID NO: 174179

SEQ ID NO: 174372 - DNA, 601 bp, Human; identical to SEQ ID NO: 174180

SEQ ID NO: 174373 - DNA, 601 bp, Human; identical to SEQ ID NO: 174181

SEQ ID NO: 174374 - DNA, 601 bp, Human; identical to SEQ ID NO: 174182

SEQ ID NO: 174375 - DNA, 601 bp, Human; identical to SEQ ID NO: 174183

SEQ ID NO: 174376 - DNA, 601 bp, Human; identical to SEQ ID NO: 174184

SEQ ID NO: 174377 - DNA, 601 bp, Human; identical to SEQ ID NO: 174185

SEQ ID NO: 174378 - DNA, 601 bp, Human; identical to SEQ ID NO: 174186

SEQ ID NO: 174379 - DNA, 601 bp, Human; identical to SEQ ID NO: 174187

SEQ ID NO: 174380 - DNA, 601 bp, Human; identical to SEQ ID NO: 174188

SEQ ID NO: 174381 - DNA, 601 bp, Human; identical to SEQ ID NO: 174189

SEQ ID NO: 174382 - DNA, 601 bp, Human; identical to SEQ ID NO: 174190

SEQ ID NO: 174383 - DNA, 601 bp, Human; identical to SEQ ID NO: 174191

SEQ ID NO: 174384 - DNA, 601 bp, Human; identical to SEQ ID NO: 174192

SEQ ID NO: 174385 - DNA, 601 bp, Human; identical to SEQ ID NO: 174193

SEQ ID NO: 174386 - DNA, 601 bp, Human; identical to SEQ ID NO: 174194

SEQ ID NO: 174387 - DNA, 601 bp, Human; identical to SEQ ID NO: 174195

SEQ ID NO: 174388 - DNA, 601 bp, Human; identical to SEQ ID NO: 174196

SEQ ID NO: 174389 - DNA, 601 bp, Human; identical to SEQ ID NO: 174197

SEQ ID NO: 174390 - DNA, 601 bp, Human; identical to SEQ ID NO: 174198

SEQ ID NO: 174391 - DNA, 601 bp, Human; identical to SEQ ID NO: 174199

SEQ ID NO: 174392 - DNA, 601 bp, Human; identical to SEQ ID NO: 174200

SEQ ID NO: 174393 - DNA, 601 bp, Human; identical to SEQ ID NO: 174201

SEQ ID NO: 174394 - DNA, 601 bp, Human; identical to SEQ ID NO: 174202

SEQ ID NO: 174395 - DNA, 601 bp, Human; identical to SEQ ID NO: 174203

SEQ ID NO: 174396 - DNA, 601 bp, Human; identical to SEQ ID NO: 174204

SEQ ID NO: 174397 - DNA, 601 bp, Human; identical to SEQ ID NO: 174205

SEQ ID NO: 174398 - DNA, 601 bp, Human; identical to SEQ ID NO: 174206

SEQ ID NO: 174399 - DNA, 601 bp, Human; identical to SEQ ID NO: 174207

SEQ ID NO: 174400 - DNA, 601 bp, Human; identical to SEQ ID NO: 174208

SEQ ID NO: 174401 - DNA, 601 bp, Human; identical to SEQ ID NO: 174209

SEQ ID NO: 174402 - DNA, 601 bp, Human; identical to SEQ ID NO: 174210

SEQ ID NO: 174403 - DNA, 601 bp, Human; identical to SEQ ID NO: 174211

SEQ ID NO: 174404 - DNA, 601 bp, Human; identical to SEQ ID NO: 174212

SEQ ID NO: 174405 - DNA, 601 bp, Human; identical to SEQ ID NO: 174213

SEQ ID NO: 174406 - DNA, 601 bp, Human; identical to SEQ ID NO: 174214

SEQ ID NO: 174407 - DNA, 601 bp, Human; identical to SEQ ID NO: 174215

SEQ ID NO: 174408 - DNA, 601 bp, Human; identical to SEQ ID NO: 174216

SEQ ID NO: 174409 - DNA, 601 bp, Human; identical to SEQ ID NO: 174217

SEQ ID NO: 174410 - DNA, 601 bp, Human; identical to SEQ ID NO: 174218

SEQ ID NO: 174411 - DNA, 601 bp, Human; identical to SEQ ID NO: 174219

SEQ ID NO: 174412 - DNA, 601 bp, Human; identical to SEQ ID NO: 174220

SEQ ID NO: 174413 - DNA, 601 bp, Human; identical to SEQ ID NO: 174221

SEQ ID NO: 174414 - DNA, 601 bp, Human; identical to SEQ ID NO: 174222

SEQ ID NO: 174415 - DNA, 601 bp, Human; identical to SEQ ID NO: 174223

SEQ ID NO: 174416 - DNA, 601 bp, Human; identical to SEQ ID NO: 174224

SEQ ID NO: 174417 - DNA, 601 bp, Human; identical to SEQ ID NO: 174225

SEQ ID NO: 174418 - DNA, 601 bp, Human; identical to SEQ ID NO: 174226

SEQ ID NO: 174419 - DNA, 601 bp, Human; identical to SEQ ID NO: 174227

SEQ ID NO: 174420 - DNA, 601 bp, Human; identical to SEQ ID NO: 174228

SEQ ID NO: 174421 - DNA, 601 bp, Human; identical to SEQ ID NO: 174229

SEQ ID NO: 174422 - DNA, 601 bp, Human; identical to SEQ ID NO: 174230

SEQ ID NO: 174423 - DNA, 601 bp, Human; identical to SEQ ID NO: 174231

SEQ ID NO: 174424 - DNA, 601 bp, Human; identical to SEQ ID NO: 174232

SEQ ID NO: 174425 - DNA, 601 bp, Human; identical to SEQ ID NO: 174233

SEQ ID NO: 174426 - DNA, 601 bp, Human; identical to SEQ ID NO: 174234

SEQ ID NO: 174427 - DNA, 601 bp, Human; identical to SEQ ID NO: 174235

SEQ ID NO: 174428 - DNA, 601 bp, Human; identical to SEQ ID NO: 174236

SEQ ID NO: 174429 - DNA, 601 bp, Human; identical to SEQ ID NO: 174237

SEQ ID NO: 174430 - DNA, 601 bp, Human; identical to SEQ ID NO: 174238

SEQ ID NO: 174431 - DNA, 601 bp, Human; identical to SEQ ID NO: 174239

SEQ ID NO: 174432 - DNA, 601 bp, Human; identical to SEQ ID NO: 174240

SEQ ID NO: 174433 - DNA, 601 bp, Human; identical to SEQ ID NO: 174241

SEQ ID NO: 174434 - DNA, 601 bp, Human; identical to SEQ ID NO: 174242

SEQ ID NO: 174435 - DNA, 601 bp, Human; identical to SEQ ID NO: 174243

SEQ ID NO: 174436 - DNA, 601 bp, Human; identical to SEQ ID NO: 174244

SEQ ID NO: 174437 - DNA, 601 bp, Human; identical to SEQ ID NO: 174245

SEQ ID NO: 174438 - DNA, 601 bp, Human; identical to SEQ ID NO: 174246

SEQ ID NO: 174439 - DNA, 601 bp, Human; identical to SEQ ID NO: 174247

SEQ ID NO: 174440 - DNA, 601 bp, Human; identical to SEQ ID NO: 174248

SEQ ID NO: 174441 - DNA, 601 bp, Human; identical to SEQ ID NO: 174249

SEQ ID NO: 174442 - DNA, 601 bp, Human; identical to SEQ ID NO: 174250

SEQ ID NO: 174443 - DNA, 601 bp, Human; identical to SEQ ID NO: 174251

SEQ ID NO: 174444 - DNA, 601 bp, Human; identical to SEQ ID NO: 174252

SEQ ID NO: 174445 - DNA, 601 bp, Human; identical to SEQ ID NO: 174253

SEQ ID NO: 174446 - DNA, 601 bp, Human; identical to SEQ ID NO: 174254

SEQ ID NO: 174447 - DNA, 601 bp, Human; identical to SEQ ID NO: 174255

SEQ ID NO: 174448 - DNA, 601 bp, Human; identical to SEQ ID NO: 174256

SEQ ID NO: 174449 - DNA, 601 bp, Human; identical to SEQ ID NO: 174257

SEQ ID NO: 174450 - DNA, 601 bp, Human; identical to SEQ ID NO: 174258

SEQ ID NO: 174451 - DNA, 601 bp, Human; identical to SEQ ID NO: 174259

SEQ ID NO: 174452 - DNA, 601 bp, Human; identical to SEQ ID NO: 174260

SEQ ID NO: 174453 - DNA, 601 bp, Human; identical to SEQ ID NO: 174261

SEQ ID NO: 174454 - DNA, 601 bp, Human; identical to SEQ ID NO: 174262

SEQ ID NO: 174455 - DNA, 601 bp, Human; identical to SEQ ID NO: 174263

SEQ ID NO: 174456 - DNA, 601 bp, Human; identical to SEQ ID NO: 174264

SEQ ID NO: 174457 - DNA, 601 bp, Human; identical to SEQ ID NO: 174265

SEQ ID NO: 174458 - DNA, 601 bp, Human; identical to SEQ ID NO: 174266

SEQ ID NO: 174459 - DNA, 601 bp, Human; identical to SEQ ID NO: 174267

SEQ ID NO: 174460 - DNA, 601 bp, Human; identical to SEQ ID NO: 174268

SEQ ID NO: 174461 - DNA, 601 bp, Human; identical to SEQ ID NO: 174269

SEQ ID NO: 174462 - DNA, 601 bp, Human; identical to SEQ ID NO: 174270

SEQ ID NO: 174463 - DNA, 601 bp, Human; identical to SEQ ID NO: 174271

SEQ ID NO: 174464 - DNA, 601 bp, Human; identical to SEQ ID NO: 174272

SEQ ID NO: 174465 - DNA, 601 bp, Human; identical to SEQ ID NO: 174273

SEQ ID NO: 174466 - DNA, 601 bp, Human; identical to SEQ ID NO: 174274

SEQ ID NO: 174467 - DNA, 601 bp, Human; identical to SEQ ID NO: 174275

SEQ ID NO: 174468 - DNA, 601 bp, Human; identical to SEQ ID NO: 174276

SEQ ID NO: 174469 - DNA, 601 bp, Human; identical to SEQ ID NO: 174277

SEQ ID NO: 174470 - DNA, 601 bp, Human; identical to SEQ ID NO: 174278

SEQ ID NO: 174471 - DNA, 601 bp, Human; identical to SEQ ID NO: 174279

SEQ ID NO: 174472 - DNA, 601 bp, Human; identical to SEQ ID NO: 174280

SEQ ID NO: 174473 - DNA, 601 bp, Human; identical to SEQ ID NO: 174281

SEQ ID NO: 174474 - DNA, 601 bp, Human; identical to SEQ ID NO: 174282

SEQ ID NO: 174475 - DNA, 601 bp, Human; identical to SEQ ID NO: 174283

SEQ ID NO: 174476 - DNA, 601 bp, Human; identical to SEQ ID NO: 174284

SEQ ID NO: 174477 - DNA, 601 bp, Human; identical to SEQ ID NO: 174285

SEQ ID NO: 174478 - DNA, 601 bp, Human; identical to SEQ ID NO: 174286

SEQ ID NO: 174479 - DNA, 601 bp, Human; identical to SEQ ID NO: 174287

SEQ ID NO: 174480 - DNA, 601 bp, Human; identical to SEQ ID NO: 174288

SEQ ID NO: 174481 - DNA, 601 bp, Human; identical to SEQ ID NO: 174289

SEQ ID NO: 174482 - DNA, 601 bp, Human; identical to SEQ ID NO: 174290

SEQ ID NO: 174483 - DNA, 601 bp, Human; identical to SEQ ID NO: 174291

SEQ ID NO: 174484 - DNA, 601 bp, Human; identical to SEQ ID NO: 174292

SEQ ID NO: 174485 - DNA, 601 bp, Human; identical to SEQ ID NO: 174293

SEQ ID NO: 174486 - DNA, 601 bp, Human; identical to SEQ ID NO: 174294

SEQ ID NO: 174487 - DNA, 601 bp, Human; identical to SEQ ID NO: 174295

SEQ ID NO: 174488 - DNA, 601 bp, Human; identical to SEQ ID NO: 174296

SEQ ID NO: 174489 - DNA, 601 bp, Human; identical to SEQ ID NO: 174297

SEQ ID NO: 174490 - DNA, 601 bp, Human; identical to SEQ ID NO: 81174

SEQ ID NO: 174491 - DNA, 601 bp, Human; identical to SEQ ID NO: 81175

SEQ ID NO: 174492 - DNA, 601 bp, Human; identical to SEQ ID NO: 81176

SEQ ID NO: 174493 - DNA, 601 bp, Human; identical to SEQ ID NO: 81177

SEQ ID NO: 174494 - DNA, 601 bp, Human; identical to SEQ ID NO: 81178

SEQ ID NO: 174495 - DNA, 601 bp, Human; identical to SEQ ID NO: 81179

SEQ ID NO: 174496 - DNA, 601 bp, Human; identical to SEQ ID NO: 81180

SEQ ID NO: 174497 - DNA, 601 bp, Human; identical to SEQ ID NO: 81181

SEQ ID NO: 174498 - DNA, 601 bp, Human; identical to SEQ ID NO: 81182

SEQ ID NO: 174499 - DNA, 601 bp, Human; identical to SEQ ID NO: 81183

SEQ ID NO: 174500 - DNA, 601 bp, Human; identical to SEQ ID NO: 81184

SEQ ID NO: 174501 - DNA, 601 bp, Human; identical to SEQ ID NO: 174309

SEQ ID NO: 174502 - DNA, 601 bp, Human; identical to SEQ ID NO: 174310

SEQ ID NO: 174503 - DNA, 601 bp, Human; identical to SEQ ID NO: 174311

SEQ ID NO: 174504 - DNA, 601 bp, Human; identical to SEQ ID NO: 174312

SEQ ID NO: 174505 - DNA, 601 bp, Human; identical to SEQ ID NO: 174313

SEQ ID NO: 174506 - DNA, 601 bp, Human; identical to SEQ ID NO: 174314

SEQ ID NO: 174507 - DNA, 601 bp, Human; identical to SEQ ID NO: 174315

SEQ ID NO: 174508 - DNA, 601 bp, Human; identical to SEQ ID NO: 174316

SEQ ID NO: 174509 - DNA, 601 bp, Human; identical to SEQ ID NO: 174317

SEQ ID NO: 174510 - DNA, 601 bp, Human; identical to SEQ ID NO: 174318

SEQ ID NO: 174511 - DNA, 601 bp, Human; identical to SEQ ID NO: 174319

SEQ ID NO: 174512 - DNA, 601 bp, Human; identical to SEQ ID NO: 174320

SEQ ID NO: 174513 - DNA, 601 bp, Human; identical to SEQ ID NO: 174321

SEQ ID NO: 174514 - DNA, 601 bp, Human; identical to SEQ ID NO: 174322

SEQ ID NO: 174515 - DNA, 601 bp, Human; identical to SEQ ID NO: 174323

SEQ ID NO: 174516 - DNA, 601 bp, Human; identical to SEQ ID NO: 174324

SEQ ID NO: 174517 - DNA, 601 bp, Human; identical to SEQ ID NO: 174325

SEQ ID NO: 174518 - DNA, 601 bp, Human; identical to SEQ ID NO: 174326

SEQ ID NO: 174519 - DNA, 601 bp, Human; identical to SEQ ID NO: 174327

SEQ ID NO: 174520 - DNA, 601 bp, Human; identical to SEQ ID NO: 174328

SEQ ID NO: 174521 - DNA, 601 bp, Human; identical to SEQ ID NO: 174329

SEQ ID NO: 174522 - DNA, 601 bp, Human; identical to SEQ ID NO: 174330

SEQ ID NO: 174523 - DNA, 601 bp, Human; identical to SEQ ID NO: 174331

SEQ ID NO: 174524 - DNA, 601 bp, Human; identical to SEQ ID NO: 174332

SEQ ID NO: 174525 - DNA, 601 bp, Human; identical to SEQ ID NO: 174333

SEQ ID NO: 174526 - DNA, 601 bp, Human; identical to SEQ ID NO: 174334

SEQ ID NO: 174527 - DNA, 601 bp, Human; identical to SEQ ID NO: 174335

SEQ ID NO: 174528 - DNA, 601 bp, Human; identical to SEQ ID NO: 174336

SEQ ID NO: 174529 - DNA, 601 bp, Human; identical to SEQ ID NO: 174337

SEQ ID NO: 174530 - DNA, 601 bp, Human; identical to SEQ ID NO: 174338

SEQ ID NO: 174531 - DNA, 601 bp, Human; identical to SEQ ID NO: 174339

SEQ ID NO: 174532 - DNA, 601 bp, Human; identical to SEQ ID NO: 174340

SEQ ID NO: 174533 - DNA, 601 bp, Human; identical to SEQ ID NO: 174341

SEQ ID NO: 174534 - DNA, 601 bp, Human; identical to SEQ ID NO: 174342

SEQ ID NO: 174535 - DNA, 601 bp, Human; identical to SEQ ID NO: 174343

SEQ ID NO: 174536 - DNA, 601 bp, Human; identical to SEQ ID NO: 174344

SEQ ID NO: 174537 - DNA, 601 bp, Human
tactggaattggcaattaaggtatcagtctttgagaagcatgttagtcttcttaaagtgttttggatcgaaaggtagagataaaagccaaattgaaaagaggataataataaataggagaacaggcatccactgcaacaggagtttcaacctatgctgtattcagtaactatgaatttgtccctaatgactaatatgatcattacatctctgatgccacctgagacctaggcttccactaacataagcaaatttatactagcgtcttatttggaatattgacactaatattccgaacacarttcagatcactgtccccctcagtcacattcaaaatgtgaggctcttcattctcccatgcacttatccctacaccactatgtgttcccctctctgagacccagtctttcattcctcccctctctaccaaacttctccacataccatttggcattctacatctcctgtcaggggggaatgtcttcagtttccttatccctcattccttcaaatctatctttacctatactctttacccttaaaagataaaggaaatatctcttgctgtcagtaggccagtctcaacctggatgctctaagct

SEQ ID NO: 174538 - DNA, 601 bp, Human
tgaaaagaggataataataaataggagaacaggcatccactgcaacaggagtttcaacctatgctgtattcagtaactatgaatttgtccctaatgactaatatgatcattacatctctgatgccacctgagacctaggcttccactaacataagcaaatttatactagcgtcttatttggaatattgacactaatattccgaacacaattcagatcactgtccccctcagtcacattcaaaatgtgaggctcttcattctcccatgcacttatccctacaccactatgtgttcccctctmtgagacccagtctttcattcctcccctctctaccaaacttctccacataccatttggcattctacatctcctgtcaggggggaatgtcttcagtttccttatccctcattccttcaaatctatctttacctatactctttacccttaaaagataaaggaaatatctcttgctgtcagtaggccagtctcaacctggatgctctaagctcattctcatttctttaagaaattccttcagttatcccccttctctactgtatcttcagctctccaaattgaatctttcaatgttagcatctt

SEQ ID NO: 174539 - DNA, 601 bp, Human
ttctctgcacaaatctttctggattattgagacaatattattttatactcccttgctcactcataatacttttctactacagcacttaactacagtttgcattgtgattctatccccacaaatgagtgtgattttcctgtgatgaggagaaaaaaaaattttttttctttctttttttttttttttttttgagacagagtctcgctctgtcccccaggctggagtgcagtggcaggatcttggctcactgcaagctccgcctcccgggttcacgccattctcctgcctcagcctccctccygagtagctgggactacagcgcctgccaacacgcccggctaattttttgtatttttagtagagacggggtttcaccattttagtcagaatggtcttgatctgacctcgtgatccgcccgtctcggcctcccaaagtgctgggattacaggcgtgagccactgtgcccggcccaaattttttttttttagtctctttaatgggagagaaattgtcttcatgtcttacacatagtatgtattcagtaaatgctggtttaagtttttgttggttgtgctgttttgttagccatggacagaagcc

SEQ ID NO: 174540 - DNA, 601 bp, Human
tgcaataagccttggatatgggtacagtcactagaaggaactgcttttgagttccagctttgccagttactcatcagatattcaaacttggtctcagtataatcgtttgtaaaacttaggtaactgtacacagctgttccttaagattatgtatagaaaactactctgtaaccaataaaatgctaagtagaaaagcaaaaaaaaaaaaaaaaagttgcaataagcaaatcagctccttgccagtaggcggcagatggccatgctgtacccactgctctagcccattccttttttccctccscatcttcctaggaacccatcttccatggaacctaaaggaatataccagatatagtgctgaacttaacaattcaggaagttaattgtcttcaggcagttagtcaggggacataataacttggggcagtttttctgtatctatggaaagagacttttgaaaagttagttggctccgtaataattactagtccttttaagaaaagaaataagaaaaactcttgggcaggagtaatttgaagtgtgaagttccacaaaaatcaacatgttcaaaatttgactttttttttttttttgcaccgga

SEQ ID NO: 174541 - DNA, 601 bp, Human
ttgtttgagacagagtctcactctgttggccaggctggagcacagtggcacgatcttggcccactgtaacctctgcctcctcagttcaagtgattctcctgcctcagcctcctgagtagctggtattacaggcatgtgccaccacgcccagctaatttttttttattatactttaagttctagggtacatgtgcacaacgtgcaggtttgttacatatgtatacatgtgccatgttggtgtgctgcacccattaactcgtcatttaacgttacgtatatctcctaatgctatccctccccsctccccccaccccacaacaggccctggtgtgtgatgttccccttcctgtgtccatgtgttctcattgttcaattcccacctatgagtgagaacatgcagtgtttcgttttttgtccttgcgatagtttgctgagaatgatggtttccagcttcatccatgtccctacaaaggacatgaactcatcctttttatggctgcatagtattccatggtgtatatgtgccacattttcttaatccagtctatcattgctggacatttgggctggttccaagtctttgctattgtgaatagtgccg

SEQ ID NO: 174542 - DNA, 601 bp, Human
tttttttggagacaggacctcattctgttgccctggctggagtgcagtggctcagtcatagctcactgcaacctcaacctcccaggcttaagtgattctcccaccacagcctcccaagtagctggaactacaggagcgtgccaccatgcccacctaattttttgtaggaatggggtttcaccatgttgcccaggctggtctcaaactcctaggctcaagcgattctccagccttggcttcccaacgtgctgggattacagccaccacacctggccattcttgattcttattcacttatgtktttcaaaaaatgttactacaagtagttctgtatcttatataggagccagtgtccgttatagactcagcagtacttaaaataagaaaaagtattgattacacacataaaatttattttaaccagtttccattgctaaacattactaagaatatcctttgcaaacagtatttttggtaataatcagaatatttgttttaccttagctgtaagttttttttaataattcagtgtgctccttgaaaaattgaaagtattagtgagttttgcaaaaggattacataaaattaaagctataatcta

SEQ ID NO: 174543 - DNA, 601 bp, Human
tccttccgaaaacgagcttttttttccttaagcctcgacctgtctgttcccacctggctccgcagctccctatggctgagcgctcaccgcggccgggtcatttacataagaaagagcctcaggccaagccgggaagctctcattccccgcctcggggtatgggggtggggatggggccggggccggggacgggcagggccaggggcgcgctcagaattgagtttctgaaatgcccgggattaggggattggctcctggcccgggcctgggctacgatttgaggtaggggacaagttgggargggattagctggagggaggttgttttaagagctgtgaggcaacggagcgttgctcagttacatacttggaatttcaatatctgatgggaacacatttttgggaaaatgtcttgccattaccgttctgtgcgacaacctgctcatattcccattctggcggtcccgagggcataggaggcatattaatgtagtgatggcgcgtgaacctccaagaaaagcagaagttacccagcctcaagtctggaggagcgagcagaggcggttgatttacttgggttttactgtttgtaaatggctgtt

SEQ ID NO: 174544 - DNA, 601 bp, Human
aagagtaaaggaggagacctttctggagaaagaagctaaaccagggctgcaggaagtggaggagctgggcagggccagctagtcttaggccaaagggatggtatatgggtggacacttggaggggtagttcgcagttatctcttcatccaaagcatgacctgaggccaaagcatgacctgaggccggtcctgaggagggagagagaaagggaggagagtttcctgtccttcagcaatcaagactgtgtgtcctgcctatggagagatagaagattctttctatttttttttttttttttttgagacggagtctcgctctgtcgcccaggctggagtgcagtggcgcaatctcagctcactgcaaactccgcctcccgggttcacgccattctcctgcctcagcctcccgagtagctgggactacaggcgcctgccaccatgcccgggtatttttttgtatttttagtagagacgaggtttcaccgtgttatccaggatggtctcaatctcctgacctcgtgatctgcctgactccgcctcccaaagtggtgggattacaggagtgagccaccgcgcctggctgattctttctattgattga

SEQ ID NO: 174545 - DNA, 601 bp, Human
gctgcaggaagtggaggagctgggcagggccagctagtcttaggccaaagggatggtatatgggtggacacttggaggggtagttcgcagttatctcttcatccaaagcatgacctgaggccaaagcatgacctgaggccggtcctgaggagggagagagaaagggaggagagtttcctgtccttcagcaatcaagactgtgtgtcctgcctatggagagatagaagattctttctatttttttttttttttttttgagacggagtctcgctctgtcgcccaggctggagtgcagtggcgsaatctcagctcactgcaaactccgcctcccgggttcacgccattctcctgcctcagcctcccgagtagctgggactacaggcgcctgccaccatgcccgggtatttttttgtatttttagtagagacgaggtttcaccgtgttatccaggatggtctcaatctcctgacctcgtgatctgcctgactccgcctcccaaagtggtgggattacaggagtgagccaccgcgcctggctgattctttctattgattgagataagttagtatacaagatgcaggattttgtcatttaagaatgg

SEQ ID NO: 174546 - DNA, 601 bp, Human
cagggccagctagtcttaggccaaagggatggtatatgggtggacacttggaggggtagttcgcagttatctcttcatccaaagcatgacctgaggccaaagcatgacctgaggccggtcctgaggagggagagagaaagggaggagagtttcctgtccttcagcaatcaagactgtgtgtcctgcctatggagagatagaagattctttctatttttttttttttttttttgagacggagtctcgctctgtcgcccaggctggagtgcagtggcgcaatctcagctcactgcaaactccrcctcccgggttcacgccattctcctgcctcagcctcccgagtagctgggactacaggcgcctgccaccatgcccgggtatttttttgtatttttagtagagacgaggtttcaccgtgttatccaggatggtctcaatctcctgacctcgtgatctgcctgactccgcctcccaaagtggtgggattacaggagtgagccaccgcgcctggctgattctttctattgattgagataagttagtatacaagatgcaggattttgtcatttaagaatggagaatcagggttaaccatagagat

SEQ ID NO: 174547 - DNA, 601 bp, Human
aattggaggtccttttccaaggggggaatcagagcaacacaaaccacagttggcaatgggagtaaggagatctgatgaactgaaagaacttggagccccagaaaactggcttcctttgttcagatacttccggtttaaaagaccacatcttgataagacgttcctcattatcatcgttgagctttgaagtcagcaggtttggtttgttttccaacactgtacgtagtctgtctttgccttttcaaagctgtgggggttatgccgggcgcggtggctcacgcctgtaatcccagcactttgrgaggccaaggcgggcggatcacgaggtcaggatatcaagaccatcctggctaacacggtgaaaccccgtctctactaaaaatacaaaaaaaaaaaaaaaaattagccgggcgtggtggcaggcacctgtagtcccagctacttgggaggctgaggcaggagaatcagttgagcccgggaggtggagcttgcagtgagctgagatcgcaccaatgcactccagcctgggcgacagagcaagactctgtctcaaaaaaaaaaaaaaaaaaaaaaagctgtgggggttgggatgtggcaaatt

SEQ ID NO: 174548 - DNA, 601 bp, Human
atgtctacagtgtcaaatttgagaaactgctttagaagaacatggtccatccctgccacccccttcagttttcaggtgtattgctgatggtcatacagcaagttagtagccctagttgggatcagagccctgagttgtcaacagtgtgccatgtcttgtgaccgtcatggtgggaaatgggcttctacaaaagacgaacttaagatgaggtctacagttcacagcagtctgcagatgcccacagttccttgctggggggcaggtttccagggaacgggagctagttgctgtttctgtattytcaaccagagaaatgtgggcaatacaagtgctccagaaagccagcaagaggagtttagtcagttgcccttggaagatgctcaccctggtgctgctgtagtttccatggaggctgggcatgagccaggcttcccaacaagacaggcatgtgagctggtgtaatggaaattcagaaggcacttgagctggggagcagaggaggtaggccagtgacatccactgagggacagcctgacagttactgggagaggctgtttgatgagctggagtcaggctccctggggttgaactctggctttct

SEQ ID NO: 174549 - DNA, 601 bp, Human
ccccattcgaggtctctgggatgcctgggacattagtgcacttcaggttgaagcatccttgcgatgtcgcaggagacacagttgtgctgaatgatcacagggttagttccagctccttttccctaacctctgtctccccggtaactaacccagagaagagcagaggcttcagagggcattgtggaggctgcttacttgggatttcatattcttctgctgtggagtttgtcagttaaatacttgctcactcatcctcacatctctcccagacctggctttccacaggggaaatcatttgcartgccctgtgctgaagagtcacaggacccgccatgataggtttggccccaccgacccctggaatttcacagaagggaatggccattctcacattctttcggcagattgggtgaggttccctgggcatcctgggatttggcagtcagctctttgcccctcatatacagaccctgggctgttgagtgtgttccttcctgctgagcccagggtgccctgggttcttcacgaagcccagggggattctgcatgtgcaacccataccctccatcccacctcttgaacagccgttgccttatccacg

SEQ ID NO: 174550 - DNA, 601 bp, Human
tggctctggaagcccttggggcccacccacctcctgcccactcagccttcctgcctttccaccatttctgccctggatgcttggaggtggtccatgttcttaaaaggcctttttcccaatcccttccttctggcatctccatattgtctgaaggaataaagccagatgaaccatctgacagctttaattagggttaaatgagggcattcgaaactgccacttttccttctttcccatttgagggacttcctcttcctgcttcctgtttcctcccaaacttttctgtctcagtcccctccaygaagtcctgtagcctcttcccatcagctctgtgtgtagtaactcaggccaccctcaagctgccctccaggtaggtcctgttattatctattattcaaatgaagagaccaggcacaaaataggatagtaccttgccccagggcaagccagaatccagacccaggcaatgtgactccagagccagtgcccttaacccccagcacaaagctgctgggacaactatgtttcagtttcacttatgtttcagtttcatggggttatgagtcaggtatcagctgggaagggacctttgggaccatgt

SEQ ID NO: 174551 - DNA, 601 bp, Human
aactcttatcattttaggtgtcagtttcccaagatcaaaggcaggatttacttagctgtatctagggggatgccctaattgtccaaactgggccgcttttgaaaatggaggaaagcactatcagtagttatgccatgaccacaggtgtaaactgagattgtcttgggtaagcagggaagtgtgggtaccttgcctgtggtgggtgtgatcttggggtggatggggcagactgggacagacccagaggtatttgatccagcaagtggaccgctggcagcagacaggagtggggagttcagaygccactgtggggcaagaggctcagaggcagattctggtccctggcctggggctgtcgaggggtaggcagagtctgacttctagggacctagcatcctaggcagggcagacaggtggactgggaggaaaccatgctgctgcggggatcccatgcagtgtgggcgccagcctgaagagcaaggcccgacacagagcacctggtcagtcgggagtagccagctcttccccttcaccaagttacttgtcaacttttctctttggtgttcccatagccccttgtgtataactataacaaaggttt

SEQ ID NO: 174552 - DNA, 601 bp, Human
actatcagtagttatgccatgaccacaggtgtaaactgagattgtcttgggtaagcagggaagtgtgggtaccttgcctgtggtgggtgtgatcttggggtggatggggcagactgggacagacccagaggtatttgatccagcaagtggaccgctggcagcagacaggagtggggagttcagatgccactgtggggcaagaggctcagaggcagattctggtccctggcctggggctgtcgaggggtaggcagagtctgacttctagggacctagcatcctaggcagggcagacaggtgkactgggaggaaaccatgctgctgcggggatcccatgcagtgtgggcgccagcctgaagagcaaggcccgacacagagcacctggtcagtcgggagtagccagctcttccccttcaccaagttacttgtcaacttttctctttggtgttcccatagccccttgtgtataactataacaaaggtttcttgagcacctattatatcctagtattgagatagctgctgctatgactgcagagaggccatttatgctgggctatggagggtcagtgggagtttgttagacaaggggaggggacat

SEQ ID NO: 174553 - DNA, 601 bp, Human
taagttgcaagcatgtgtcagcacagagtcactggaagtctttgtgtggccagatttaaatgatggatctctctttgtttggcctcttttgacctctttaatcttctttggctctttgactgtgtatagtgggtaaacttgggccaagtcagtgcaacctgcctttttttttccagcgtcttttgaattgaagtataatgcacatgggaaactgaaagcagcaggtaaccaccatccagatccagtaacagatcattacctgaaccagccccgtgttctcctacccaccaccaccatcaartgtaatcactgtcctgactaacagcataggtctgtttttgtacttaatataaatagactcatacaggatataaaagatgccatttgtgtctggcatttttcagccagtgttttactgtattttgagattcatctatgtggttgcatgtagtggtaggtggtgcattcttgttgctgtatactatctcttgcaccactctggcttgtttttgtttttaagagacagggtcttgcactgttgcccaggctgagtgcagcagcgtgatcatggctcactacagccttgacctcctggcttcaa

SEQ ID NO: 174554 - DNA, 601 bp, Human
ctgtctctacagaaaaaataaaattaaaaaaatcagctgggtacgagggtgcatacctatagtcttagctacttgggaggctgcagtggaaggatcatgagcccaggagtttaaggctgcagcctaggagtttgaggctgcagtgaaccatgattgcgtcattgcactccagcctgggcagccgagcaagactctgtctctaaagttaaacaaacttgacgaagctccaagcttcctgacagtcaaggcaaaaaggatagttagttctctttgagtcagtcgttttcatcccatcggcctmtaacaggtagcacagtgtgtctgggcagccagactttctcctgacactaacccttactggggactgaatggctagggaagcattagtgaaagacacagcagctttacctggtgcagtggtctttatagtctttcctgtgagcccttgattaaaagtgatagaactaaacctatgaagcatttcatggggagctaatgtaatgttgtgaaggtgaggagctttctgttcctggaattggtaatttcccagggtcttaggggcttgcccatgcctcctgagccttttcacactgctgtctct

SEQ ID NO: 174555 - DNA, 601 bp, Human
gctgggtacgagggtgcatacctatagtcttagctacttgggaggctgcagtggaaggatcatgagcccaggagtttaaggctgcagcctaggagtttgaggctgcagtgaaccatgattgcgtcattgcactccagcctgggcagccgagcaagactctgtctctaaagttaaacaaacttgacgaagctccaagcttcctgacagtcaaggcaaaaaggatagttagttctctttgagtcagtcgttttcatcccatcggcctataacaggtagcacagtgtgtctgggcagccagacyttctcctgacactaacccttactggggactgaatggctagggaagcattagtgaaagacacagcagctttacctggtgcagtggtctttatagtctttcctgtgagcccttgattaaaagtgatagaactaaacctatgaagcatttcatggggagctaatgtaatgttgtgaaggtgaggagctttctgttcctggaattggtaatttcccagggtcttaggggcttgcccatgcctcctgagccttttcacactgctgtctctaggtaagcatttatctgctaagatggctgagctcc

SEQ ID NO: 174556 - DNA, 601 bp, Human
taggtaagcatttatctgctaagatggctgagctccaaaagtatcccctttgattgccagtctctcaggccacttaaatctgtgacacttcccatgggctgccttgtattgtgcccgacattcttattagacaagactcatctctccacgcattctagagacactcattggtctataatatgagccagcttctttgatataaagtcctagagagcagggctgttgatttcttaaaatttttaagaattgtaataaaatattaatcacaaaatttaccattttaaccattttaagtgtacartttagtggcattaagtgtgttattcacattgctgtgcaactaccaccactattcatttccagaattaatttcttgtaaaattatgtttctgtacactagtgctttgtatttaatagctgttccataaatgccataacatggaagatgctggggttgcaacagtagtcaggattcagggattgaatgatacggatcttacagacttagacattgaaatttaaggtttcgtttcgtctacacttcccttttaaaacccttgagtaccttactcaaggtaggatctgtagtacttcatataaa

SEQ ID NO: 174557 - DNA, 601 bp, Human
cttgctgaagaaatatcaactaacagtgctatctctgtctaacacgccctcgcttcctgggctggcagcttggcaggcagacgggaaggtaacccgttcttcagccaggctttgctctggcctgcctccgattccccagcctggaatgccccctcctcctttcctcctctcccagatagagatttaaagagaagcagccttgtccatgcccatcacagaaagagaaggaatagtttggggaaacagcctctgctttgtgactaaggagggttgagaaatgtctgtgattgcctgaaggtgmccctgggtggagagaagctttagaagaaagaaggggtggaaggaaagggggggtgatagagaactcttttgtccccacagttatgctaatgactctgtcatgtggggctattcatcctgttttgtggcaaggaagctggggttcagatgaagagtcctctaatgtcgcacacctgtacgaacgctaccactaggatttgcatactggtgtttctgatgccagagcactcctttcaccaccaccagctacaaatcaagggttgacctgaatgagtctgctttgatagtatccagaaactta

SEQ ID NO: 174558 - DNA, 601 bp, Human
tcagatgaagagtcctctaatgtcgcacacctgtacgaacgctaccactaggatttgcatactggtgtttctgatgccagagcactcctttcaccaccaccagctacaaatcaagggttgacctgaatgagtctgctttgatagtatccagaaacttacatctcttaaaaacaaatgcagagtttgtcttcccaactcccagcaggctggatcaacacaggattacttcacagggtcacacctggcctaatatcttaaccaccgactctcaaagattccaggcagaaaagtgatatgcagygttgatcagaacagggccaaccacgatcacgttattggcatattggaaacctcccagaggagaggggaaggtgtttgagccccagccttagaggtgtcatttggttagtctggaatggatccttggaattcttactgttttctttaaaagctcctcatgtgattctgatgtgcagcaagtttggaaactcttatcacaagtgacagaatggagattaggcagaagtatcagaaagcagatttatctttgattgaggaaactctttgaaacaagtagagctgttcaaaaatggaatttaga

SEQ ID NO: 174559 - DNA, 601 bp, Human
gcatgtttacctaccactccctctgactggaaaccacacccacttctgagatttttatttgacattcagataaatgtacacactccggaaggccagggccttgtctttatttcacccagcactaacactaagtaagtaccctaaatcttttctaaatacatatgggctaaggactcttttgggcacctcaatgtattaactcatttacttttcaaaaacctttatggtaagtacaaattttatccacaatttttagatgaggaatttgaggttcaaatgtcaaacaagttgtccaaaatcmtacagccagtgggaggccgagttaggaatcaagcttgtgtaagccaaagttcaggcatcggtactgcacgtgatgtgttatatgtgttcatgtatgtgttagcctgtgcacttggcgctggagcacactgcaaatgctcaactaaaatttttttggaacggagttgggactgattgtttggactgtattataggcaggtgaattaagtttgttggggagaactaattatggggcaagctttcaaaattctcattgctttcctgaagctggaggctccaagacctcccatgcaccttgaag

SEQ ID NO: 174560 - DNA, 601 bp, Human
tgcaaatgctcaactaaaatttttttggaacggagttgggactgattgtttggactgtattataggcaggtgaattaagtttgttggggagaactaattatggggcaagctttcaaaattctcattgctttcctgaagctggaggctccaagacctcccatgcaccttgaagcttgcactgtttgcagcacatactggaatgtcttactcactgaaacaaaggaagtggcccctggaataatggagaccagattgcaggaaacccacacctaatccctccctccgcatttgcagggggtcyataggttagctcctcacctccatactctctgggactcagcctttgcttttgtaaagtaaagaggttggacctagcagttctagtctgttctgcacatctactagaactattgtgctagtctattcacacaaacacttctgagatcctgtaatgggagataaacccttggtgttcattggatggtgtcttagttcatttttgtgttgctgtaaagtgggacatatgtatatatgacaactcagcaattccacttccaactatatgccctgaacagactcctgtatgaatccaaggagacat

SEQ ID NO: 174561 - DNA, 601 bp, Human
gactgattgtttggactgtattataggcaggtgaattaagtttgttggggagaactaattatggggcaagctttcaaaattctcattgctttcctgaagctggaggctccaagacctcccatgcaccttgaagcttgcactgtttgcagcacatactggaatgtcttactcactgaaacaaaggaagtggcccctggaataatggagaccagattgcaggaaacccacacctaatccctccctccgcatttgcagggggtccataggttagctcctcacctccatactctctgggactcakcctttgcttttgtaaagtaaagaggttggacctagcagttctagtctgttctgcacatctactagaactattgtgctagtctattcacacaaacacttctgagatcctgtaatgggagataaacccttggtgttcattggatggtgtcttagttcatttttgtgttgctgtaaagtgggacatatgtatatatgacaactcagcaattccacttccaactatatgccctgaacagactcctgtatgaatccaaggagacatggctgaataatgttcattacagtgttgcttaatcgcacc

SEQ ID NO: 174562 - DNA, 601 bp, Human
cagattgcaggaaacccacacctaatccctccctccgcatttgcagggggtccataggttagctcctcacctccatactctctgggactcagcctttgcttttgtaaagtaaagaggttggacctagcagttctagtctgttctgcacatctactagaactattgtgctagtctattcacacaaacacttctgagatcctgtaatgggagataaacccttggtgttcattggatggtgtcttagttcatttttgtgttgctgtaaagtgggacatatgtatatatgacaactcagcaattmcacttccaactatatgccctgaacagactcctgtatgaatccaaggagacatggctgaataatgttcattacagtgttgcttaatcgcacctataatcccagctactcaggaggccgaggcagagagaatcaatcacctgaacctgggagatggaggttgcagtgagccgaagttgcgccactgcactccagcctgggtgacagcatgagactctgtctcaaaaaacaaacaaaaatagataaatttaaaaaaaataaagtggtcagcatcagggctctcaagttttgctttgtcagttg

SEQ ID NO: 174563 - DNA, 601 bp, Human
ttatggaatatggcagtgaaaataggtgactcctaagttgatacagactatcaaaaatgaaaattctctattgtcagcaccccagtgaagtgctgcgaggaaaggccgaggtgaagttgtgttagcgattccccccatgtggtcgcacacagcctgggtgcctgccgctgctgctgggggtgaagctgcatccctctcccacagaaggctcgaggccttttctccaggggcacctgttcagtgccacctttctcagaacattcgtttctcagcccgttcatggctagtattcttttcaaayctgagaaaccaaaccccagatctagagggagccaatttttaaatccatagctttctaacttttctgggctatatcttcacagcaagaaacacatgcatataaatatttatatgaaaggaaataaatttggggaccagaatttattcttaaacatgatgaagttgggtttgtcttctattctttaagaaagttgctagtcagaacctgctaaatgtttttcactttgcagtttgaaagccactgccttaaatgatccttggcccagtttgattctagatgagcatttcctttcttgctggc

SEQ ID NO: 174564 - DNA, 601 bp, Human
tatttatatgaaaggaaataaatttggggaccagaatttattcttaaacatgatgaagttgggtttgtcttctattctttaagaaagttgctagtcagaacctgctaaatgtttttcactttgcagtttgaaagccactgccttaaatgatccttggcccagtttgattctagatgagcatttcctttcttgctggcacgaaatatgtagtttcaggacagtgtggggtgagaggtgagaatcagaattataggttcaaatgggtttgaattcaagctgtgtgcttcagagcgatttatgmtgtgatcctctatttcctcatttgtgaaaaggggaaacttcagggggatcggttttctgagaattaagggagaatcagatatgtgactttctcacatgtgttacaaacactcctgcagccacaaaccaccactgcaaaaggcactctcattgccaaatttactaagaaaaggtgtgtaagactcccaggttttaattttggaagattggcatcaagggagcaggtgtgagggttcatccccatcaccaggggccctgcattttggagtgaagaccaggccccagctcttataccagctcc

SEQ ID NO: 174565 - DNA, 601 bp, Human
taatcaaagtcctattagaaaatgtggagaaaccagaaagtttcaggccatttatttgtggtggaggcctccccatcacggcttatgggctcttgtgtgagaaggcagggaatgtcagtagccactgaaccccgtaggggtgaaatgttcaaggtaaatcgtgaagtacctgtgcttcataggttgtgtggcctacacagtgtgaagaaacacagttggcataattaaaagtgcaatagacataaacggtccaggaatgtcttactcaatgactgaatttggtgtcagccagaatacattraaaatggtctctatttgtcgttttgcttctttcccaaacagttttaagaagttgaaagaattctatagtggtcatctatattttacttggtttgctttatcaaccccccaatccttctatccatcagtccagcttgttataattgatgcattacaaaacataaattgctgagaaagtatagtaaatactaatactgaactctagttactatgtatgctgaagttttagggttcagacgtatacttacatagtaactagagttcaatatttgctgtattttcttgtgatgtaagatctaga

SEQ ID NO: 174566 - DNA, 601 bp, Human
ccaaaacagacaaataccgcacgttttcacttataagtgggagctaaacagtgtgtccacatggacatagaaagtggaatgatagaccatggagacttggaagggtgagggtaggagggtggggggcatgagggtaggagggtggggggtggtgtggatgatgagaaattacttaacggatgtagtgggtgttggatacactaaaagccctcacttcaccattgtgcagtatatccatgtaacaaaattatgtttgcacctcataaatttaaacaactaaaaaaaacctccatcaagatayagaacattaccatcaccccagaaagttaccttgagccccttcccagtcaatccctgtacctgatccccccagaggcaatcacattctactattttccacatatgtgagttttgcctgttccagaacttcacatataaatcgactcacacagtatttgttttttatgcaagtctttttttatttgtcataatgtgggatttatctgtgttgtgtctatcagtgtctcgttccttttggctgctgattccatggtatgattagaatctgatatgaatattgatggacacccgggcagtttcc

SEQ ID NO: 174567 - DNA, 601 bp, Human
atgatgctgatggtgacggtgatgatgatgatgataaaaattgtagacatcgttagtgccaggtactgtgctgaacgctgtgtttgagctatctcatcatttcttacagtcatccagtggtaggtacgctgaacttcactttacagaaaaaggcaatagatttggagcaattaggcaacttgcccaaagtcacagtgagcaagtggcagcattgggattggaacttggccagccaaattgctaatgcctgggcttttaagcacaccaccagtggcacattggtgctgtgctgctagcacartgtgtggattcttctcttactaacctaggcctagctgttcagctcattcaacagtcctctccgaggcttggtcctctgtgcagcagcagtgtgctaagctgcctcgtgccctttaaagagtgaaagttgtgctggggagataaggcccatgtagacaaaacaattagagatatcgggccatataatgcaagcacatgatgtgataaagggagaccgggctggtgatacgttgcatggaagctggttaaacctgaaggaagcccttatcttggttgctctgcattatattaacaactgtac

SEQ ID NO: 174568 - DNA, 601 bp, Human
agtggtaggtacgctgaacttcactttacagaaaaaggcaatagatttggagcaattaggcaacttgcccaaagtcacagtgagcaagtggcagcattgggattggaacttggccagccaaattgctaatgcctgggcttttaagcacaccaccagtggcacattggtgctgtgctgctagcacaatgtgtggattcttctcttactaacctaggcctagctgttcagctcattcaacagtcctctccgaggcttggtcctctgtgcagcagcagtgtgctaagctgcctcgtgccctttraagagtgaaagttgtgctggggagataaggcccatgtagacaaaacaattagagatatcgggccatataatgcaagcacatgatgtgataaagggagaccgggctggtgatacgttgcatggaagctggttaaacctgaaggaagcccttatcttggttgctctgcattatattaacaactgtacagcggagacatacatccagagctagcacacagcaagttaattggggtacttacgtagtccaggcgatataaattgaagattgtactgatagatagcctcagtacagcagatggca

SEQ ID NO: 174569 - DNA, 601 bp, Human
aattgctaatgcctgggcttttaagcacaccaccagtggcacattggtgctgtgctgctagcacaatgtgtggattcttctcttactaacctaggcctagctgttcagctcattcaacagtcctctccgaggcttggtcctctgtgcagcagcagtgtgctaagctgcctcgtgccctttaaagagtgaaagttgtgctggggagataaggcccatgtagacaaaacaattagagatatcgggccatataatgcaagcacatgatgtgataaagggagaccgggctggtgatacgttgcayggaagctggttaaacctgaaggaagcccttatcttggttgctctgcattatattaacaactgtacagcggagacatacatccagagctagcacacagcaagttaattggggtacttacgtagtccaggcgatataaattgaagattgtactgatagatagcctcagtacagcagatggcacttacattgtcaggcgttgtgccaaacgccttacacttccttgcactgaatcttgacaaggtgcgtgtgtgtatgtgtgcgtgtatatgtgtgtgttttcctgtgttcttgttctgggtt

SEQ ID NO: 174570 - DNA, 601 bp, Human
ttcaacagtcctctccgaggcttggtcctctgtgcagcagcagtgtgctaagctgcctcgtgccctttaaagagtgaaagttgtgctggggagataaggcccatgtagacaaaacaattagagatatcgggccatataatgcaagcacatgatgtgataaagggagaccgggctggtgatacgttgcatggaagctggttaaacctgaaggaagcccttatcttggttgctctgcattatattaacaactgtacagcggagacatacatccagagctagcacacagcaagttaattggggkacttacgtagtccaggcgatataaattgaagattgtactgatagatagcctcagtacagcagatggcacttacattgtcaggcgttgtgccaaacgccttacacttccttgcactgaatcttgacaaggtgcgtgtgtgtatgtgtgcgtgtatatgtgtgtgttttcctgtgttcttgttctgggttgtggagggaggtgctgactagaaggaggttatcgttacccttttaaaacagatgatgaaatctgagtgtcagatttctaataaattgcccaaagccacatggctaatgcatg

SEQ ID NO: 174571 - DNA, 601 bp, Human
tgatgtgataaagggagaccgggctggtgatacgttgcatggaagctggttaaacctgaaggaagcccttatcttggttgctctgcattatattaacaactgtacagcggagacatacatccagagctagcacacagcaagttaattggggtacttacgtagtccaggcgatataaattgaagattgtactgatagatagcctcagtacagcagatggcacttacattgtcaggcgttgtgccaaacgccttacacttccttgcactgaatcttgacaaggtgcgtgtgtgtatgtgtgcrtgtatatgtgtgtgttttcctgtgttcttgttctgggttgtggagggaggtgctgactagaaggaggttatcgttacccttttaaaacagatgatgaaatctgagtgtcagatttctaataaattgcccaaagccacatggctaatgcatgttagagtgggatttgaacccaggtctgcctgcctaaaaagctgaacatgctcagagcttacacaatattgaaacataatcatgttttaaccctttgaagagtggtttcacatctgtggggctaattacacctctctgtgactggcacgt

SEQ ID NO: 174572 - DNA, 601 bp, Human
tttacgttgtggcatttggcccaccaattttatttggaaataagcattctgttgcttaaaatggtttgaaaacaaatgatgtagaagatcagatcactccattcctagtctgtaccagacaccagcgttaactgtgattcagtgcctttaatgacacggagtattgaatacttctgtatggctgagctcttgaatggtggccggcattgcattgtaatggagtaattggaatcctggggtttaaaaagaggctgccaggtgtggtagtgatcatggcgattccgggtacatggaaaatacrtgccttgagacctgtgtcttgctacattacctgcttaggacttggagatgtatcttttcggtcctcgtttcatttggagtatatgccatacattctcagagcagtccactgttgtgtgctagcaggtgcttgaaaactaaaggaaaaaaacaagatcccctcaacccagagtcaccccatagaggatgattggaatgttcagtgcagttacctggggccactggaaatgatattgtagggcagaaagggcaggtccctttaggggcattaagttataaatatagggctggttcaggaact

SEQ ID NO: 174573 - DNA, 601 bp, Human
tgaaaacaaatgatgtagaagatcagatcactccattcctagtctgtaccagacaccagcgttaactgtgattcagtgcctttaatgacacggagtattgaatacttctgtatggctgagctcttgaatggtggccggcattgcattgtaatggagtaattggaatcctggggtttaaaaagaggctgccaggtgtggtagtgatcatggcgattccgggtacatggaaaatacgtgccttgagacctgtgtcttgctacattacctgcttaggacttggagatgtatcttttcggtcctygtttcatttggagtatatgccatacattctcagagcagtccactgttgtgtgctagcaggtgcttgaaaactaaaggaaaaaaacaagatcccctcaacccagagtcaccccatagaggatgattggaatgttcagtgcagttacctggggccactggaaatgatattgtagggcagaaagggcaggtccctttaggggcattaagttataaatatagggctggttcaggaactgaatgtgaaagtatgcgtttgtgactttgacccacctccaagtttacggctgcatgcctcaggcat

SEQ ID NO: 174574 - DNA, 601 bp, Human
accttcttaagaacgaaagaaagtccttggcaatggtatttgctgtgcgtttatagccatgtcacgtgagccctatgttgtagctactctggacatgccattttttggcacccacaaattaatgccaacttatagttataccaaacctctgtcctgccttactggacaccagagcatgccacaaacctccatggccttgacagggagaaagggaacaagtaccttgataggatctattaacggaggaataatttactgtgtttcttctttgttgttgttgtcatttgtttgttttttttttgagacagagtctggctctattgcccaggctggggtacagtggcgagatctcagttcactgcaacctccacttcctgggttctagtgattctcttgcctcagcctcccaagtaactgggattacagggctacgccaccatgcccggcaaatttttgtattattagtagagacagggtttcaccatgttgaccaggctggtctcaaactccagacctcaagtaatctgcccgccttggcctcccaaagtgctgggaatacaagcatgagccaccacacccagcctgtgtgtttctatatgtt

SEQ ID NO: 174575 - DNA, 601 bp, Human
gccttactggacaccagagcatgccacaaacctccatggccttgacagggagaaagggaacaagtaccttgataggatctattaacggaggaataatttactgtgtttcttctttgttgttgttgtcatttgtttgttttttttttgagacagagtctggctctattgcccaggctggggtacagtggcgagatctcagttcactgcaacctccacttcctgggttctagtgattctcttgcctcagcctcccaagtaactgggattacagggctacgccaccatgcccggcaaatttttrtattattagtagagacagggtttcaccatgttgaccaggctggtctcaaactccagacctcaagtaatctgcccgccttggcctcccaaagtgctgggaatacaagcatgagccaccacacccagcctgtgtgtttctatatgttcacatacaacatagtccatgtttcacgtaagcatcacaaccgctgggagatgtcagcattatgaatcctgttctacaggtgaggtgacatgctcagagagccctgtgatgtgcccacaccacacaggtagtgaagctgctgagctggaattcaaa

SEQ ID NO: 174576 - DNA, 601 bp, Human
ctgtgtttcttctttgttgttgttgtcatttgtttgttttttttttgagacagagtctggctctattgcccaggctggggtacagtggcgagatctcagttcactgcaacctccacttcctgggttctagtgattctcttgcctcagcctcccaagtaactgggattacagggctacgccaccatgcccggcaaatttttgtattattagtagagacagggtttcaccatgttgaccaggctggtctcaaactccagacctcaagtaatctgcccgccttggcctcccaaagtgctgggawtacaagcatgagccaccacacccagcctgtgtgtttctatatgttcacatacaacatagtccatgtttcacgtaagcatcacaaccgctgggagatgtcagcattatgaatcctgttctacaggtgaggtgacatgctcagagagccctgtgatgtgcccacaccacacaggtagtgaagctgctgagctggaattcaaaatgaggcctgcctacctgtctaaggtccagtgcctaaccactgctctggcatgggcacgtaaccatgcgtgggcgttacgagagggcccgtctcaggatt

SEQ ID NO: 174577 - DNA, 601 bp, Human
agtcggtggtattatcacccaggatctggatgtttcctgtctacactgctgtttcctggagggtaggaactgcaccttcccagtgacacatgacagtcttcacccatctgtgtctgtggctcctttctggagtctcactcatcctctttcctgctcccccacagcttttctgttgcttcagtggcctgactcttgtcgtacatacatgctctggggtcagcattctcttgcattctgataagcctgagatcctttgagggggcacctgcttgccttattcaccaggcctcaatgtgttggwcctcattccactccatcacatgacccctctggtcttgctgcaggacatggccctcataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaatt

SEQ ID NO: 174578 - DNA, 601 bp, Human
tttcctgtctacactgctgtttcctggagggtaggaactgcaccttcccagtgacacatgacagtcttcacccatctgtgtctgtggctcctttctggagtctcactcatcctctttcctgctcccccacagcttttctgttgcttcagtggcctgactcttgtcgtacatacatgctctggggtcagcattctcttgcattctgataagcctgagatcctttgagggggcacctgcttgccttattcaccaggcctcaatgtgttggtcctcattccactccatcacatgacccctctgrtcttgctgcaggacatggccctcataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgacagaatactac

SEQ ID NO: 174579 - DNA, 601 bp, Human
ctggagggtaggaactgcaccttcccagtgacacatgacagtcttcacccatctgtgtctgtggctcctttctggagtctcactcatcctctttcctgctcccccacagcttttctgttgcttcagtggcctgactcttgtcgtacatacatgctctggggtcagcattctcttgcattctgataagcctgagatcctttgagggggcacctgcttgccttattcaccaggcctcaatgtgttggtcctcattccactccatcacatgacccctctggtcttgctgcaggacatggccctyataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgacagaatactacttagccataaaaaggaacaaatt

SEQ ID NO: 174580 - DNA, 601 bp, Human
tctttcctgctcccccacagcttttctgttgcttcagtggcctgactcttgtcgtacatacatgctctggggtcagcattctcttgcattctgataagcctgagatcctttgagggggcacctgcttgccttattcaccaggcctcaatgtgttggtcctcattccactccatcacatgacccctctggtcttgctgcaggacatggccctcataatatgcaaacattagaaagtaaatttagtactgcaattgcaatatgcaaacataatatgcaaacattagaaagtaaatttaatacygtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgacagaatactacttagccataaaaaggaacaaattaatggcattcgtagcaacctggatgggattggagaccattattctaagtgaagtaactctggaatggaaaaccaaacatcatatgttct

SEQ ID NO: 174581 - DNA, 601 bp, Human
ttcaccaggcctcaatgtgttggtcctcattccactccatcacatgacccctctggtcttgctgcaggacatggccctcataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaaytgtcttatattgttgattgaattataaaagtaatgtatatgcgacagaatactacttagccataaaaaggaacaaattaatggcattcgtagcaacctggatgggattggagaccattattctaagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttt

SEQ ID NO: 174582 - DNA, 601 bp, Human
gacccctctggtcttgctgcaggacatggccctcataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgasagaatactacttagccataaaaaggaacaaattaatggcattcgtagcaacctggatgggattggagaccattattctaagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtat

SEQ ID NO: 174583 - DNA, 601 bp, Human
cttgctgcaggacatggccctcataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgacagaatactactyagccataaaaaggaacaaattaatggcattcgtagcaacctggatgggattggagaccattattctaagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtatagcatgaaatta

SEQ ID NO: 174584 - DNA, 601 bp, Human
ataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgacagaatactacttagccataaaaaggaacaaattaatggcattcgtagcaacctggatgggattggagaccattattctaagtgaagtaactctggaatggaaaaccaaacatcatatrttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtatagcatgaaattagactatatgtaatgtctgtagaggagtgaatcccactggccgccccttacccacagatattcctggagggacttggagttttaagtctcggttggttcctggaaga

SEQ ID NO: 174585 - DNA, 601 bp, Human
aatggcattcgtagcaacctggatgggattggagaccattattctaagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtatagcatgaaattagactatatgtaatgtctgtagrggagtgaatcccactggccgccccttacccacagatattcctggagggacttggagttttaagtctcggttggttcctggaagaattttgcccaaaattaatagtggcccttcctttctctgcagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccaggtatgacccttctctcagggcagccc

SEQ ID NO: 174586 - DNA, 601 bp, Human
tccgtgtgctttgggtgaaagtaacggacaatgggctccagaaggtggagatggagaatcagatctatgccatccctgaggacatcatgcgaggcagtggcacccaggtatgacccttctctcagggcagcccctggtgacaaaaaacttccttggcatgttctttctgtactttctccagccgctcccagcgtgtggataggcagtcacccaagacactcatggatgccagcacagctgtaagggctccctctcagccggagctcaggctgttctggttgtattttatacccaacatgtactcagtattaaaaggagtgactagagaagaagcatgaaatccaagtaagacgctgttcagtgttgtcacatctcgggcctcagggcttggaagaggtcaagccctctgattcgtggtcggctgttccctctcccacacaaggctccctcctgggaaaggaatttctgaccatgagtagaacacgctggggagatatttttagactcattatttgtctttggggtggccttgaggtaaacctgctttccttgttatcatgctggggttggagaagggaggctgcatccctagggctgtggg

SEQ ID NO: 174587 - DNA, 601 bp, Human
taagtgggtggccctgctctttctttccaccttctatttgtaaattgtccatgggaactgtgagccacctaaggaaagttgtgttgaggtggccaagattggggtctctgaaagctcctttcatagctccaactccatcaccacccagaggacaggctgacagctggctgctcattgctgctccctggggtcccagggcctcctgctgcagctgcaggcagacccatggcccctggagacattggctgaggagcttccttggcctccttcacttggaccttggcccaactatgtcctgggrtggattggaggaggggcgtctagcattttggatcctgaatattgtattctccagcctggcctgcctttgtttttagttgcttttatctcttacaaaaccttatttcaccctcacaaacatttgccaaatgtgcgtgtgaaagatcttgaaacagggattgcttcaaggtctgaagcagttgcaaaatattttgagcaatacagatcatctctggtcttgtgactgttgtagaaaagcttttcgtgcagatctctacttggacaggaaaattgaaccctataaatcaagtcagtggtgggt

SEQ ID NO: 174588 - DNA, 601 bp, Human
ccgcatctctaacagcccccagtaggctgcagcctactcctgcacttggagtaggaaggccctggagaccatggctccaagtggccactacccagagagttcctggctgaacacgttgtctttagctgtgcagacacctttgggatcattggcagaaactggcaaaagagaggctaaagtccagaagagcatctctagcttttaattttgggtctttcccagacagcagctagtgaaatgagtgatagaacaagacagataggtggcatcagaaccacctaataccacagggctgctccakcaaagaggctgatggtaccatgttgggcaagggagcagtggccagggggccttcttcagtgaggaagaggaggtcttgtgtggctgcatgtaggggacagtggcttattaaaaggtcttttcctttcattggcgggggtgaaccaatcctgggtggtcatagttgatatggttcttgtagtggttcctaacttgggacagtggagagaggatgtttagggcagcacccactcctgcaggtgccttttggcatttggattaaggcggtgggcaactgtctaactatttgcaccattgaccc

SEQ ID NO: 174589 - DNA, 601 bp, Human
cttttaattttgggtctttcccagacagcagctagtgaaatgagtgatagaacaagacagataggtggcatcagaaccacctaataccacagggctgctccagcaaagaggctgatggtaccatgttgggcaagggagcagtggccagggggccttcttcagtgaggaagaggaggtcttgtgtggctgcatgtaggggacagtggcttattaaaaggtcttttcctttcattggcgggggtgaaccaatcctgggtggtcatagttgatatggttcttgtagtggttcctaacttgggasagtggagagaggatgtttagggcagcacccactcctgcaggtgccttttggcatttggattaaggcggtgggcaactgtctaactatttgcaccattgaccctaaccatggacacctgtctcttacccgccctggggaactgcagttttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacat

SEQ ID NO: 174590 - DNA, 601 bp, Human
cctctgcaaacagtagtaatggtcaacacttattgaatgcttactgtgtgtcaaagcactttatgtgtatgagctcatttaatctttgttaactgttaaaaaatattagcagttaattttatgtattcacctatgtttgacagaaaactgaggcgcagagaagttaagacacctgcctaaattcacacaactagaaaatgtcggagctgggattcaaacccaggaattcaggttctagaatctgctcttgcaatcaccacattggtctgagtcagggttggcaaactatggcccatgggcwgaatctggcccaccacctgtttttgtacataaggttttattacacagccatgcccatgcgtctgcacgttgcttatggttgttttgcactgtcttggcaaagttgagtggtggcagcaaagactgcatgacccacagggcctaaaacgtttgctgtctgggcctttacagaaaaagatttctgacccctgctgtaagtcttgtaacctcagaaatggtggtcttattccaattcagagaagacagtcgatgagcaggccagtgtagcacagttgttacaggttccagagacagactggga

SEQ ID NO: 174591 - DNA, 601 bp, Human
actgtgtgtcaaagcactttatgtgtatgagctcatttaatctttgttaactgttaaaaaatattagcagttaattttatgtattcacctatgtttgacagaaaactgaggcgcagagaagttaagacacctgcctaaattcacacaactagaaaatgtcggagctgggattcaaacccaggaattcaggttctagaatctgctcttgcaatcaccacattggtctgagtcagggttggcaaactatggcccatgggctgaatctggcccaccacctgtttttgtacataaggttttatttcacagccatgcccatgcgtctgcacgttgcttatggttgttttgcactgtcttggcaaagttgagtggtggcagcaaagactgcatgacccacagggcctaaaacgtttgctgtctgggcctttacagaaaaagatttctgacccctgctgtaagtcttgtaacctcagaaatggtggtcttattccaattcagagaagacagtcgatgagcaggccagtgtagcacagttgttacaggttccagagacagactgggatttggtccctgctctaccctgtcctggtcgtatggccccggg

SEQ ID NO: 174592 - DNA, 601 bp, Human
accaaaatattttcaagtagatactatcttaacttttcatgccaacaggttatatatttatttatatatttgccagggaaaccagaatgtgtgttaactgtttctgtctgaattgtgagattccaggccattggattaggttttattctgtgttccaggtttctctgaggagcacgtgttaggtctagagccgtaaaaattaagagcaaataaagcagaagtcatttcttcctgtgggctctggcaagaccctcctgtgatggggaaatcccaccagtgcagaggcccctggggttagagrccccagggctctgtggcccccagctgtgtttcccagctgttgggcctccacttgcctcatcagtaaggatcacctgaaattatgttatttgaacatcccgtaaacacaaacttgcgtcaaacatgtgaagctaacttgtagagagctgggtggagatcagcacacactggtcagccagctctctgagggtatgtgctttgtttttctgaatctcctggggtctgaacacagtgtgacacctccaggttgatgtgaatgaaatgccaagctgatgggcatgaatccctgagcaaggcctgg

SEQ ID NO: 174593 - DNA, 601 bp, Human
atgaaatgccaagctgatgggcatgaatccctgagcaaggcctggagaaatcatgcaagtgggtgggttatgagcacacagctcatttatggaagccgagctcttgggtaaggagtctgaagccctgaggcttgtttcctggtgggctgtggcagcagagagggcatcagggaataaaacccaaagcatttctcccaggttcaaagccgtcaagcatctgctcccagaggaccacattgaaggcaaggggccactgaggatgctgaggaggagcctggagttgttttcctcactgaaagayatggggtggtggtgaagcctagctgtcacccagctgtgggcaaagcacttgttcgccagatgctggagtttgaaaattaggagacatacactgacccttctgatgtaaaggatagggacagagcaaactgctttgcccagtgagcgaaccaagcacataggaagaagttgcacagcagggtcagctgcgtggtgcttatgagcccattcactggggtcggagggcctcggagtgcatcctgcttctctcttccaagctgtaggccttgagcaagtcactccagagcctcagtttcttata

SEQ ID NO: 174594 - DNA, 601 bp, Human
agctcctcaatgattggcctggtctgtgtgttcagaaagtgaaggcaacagtaagtgtggctgcatgggttgggaggaagattaactcaagcgtcgttcagcagtttagtgtgcactgtgtgtcaagcaatgctctcagcactggcggttcaggagtgaccacaacaaagctttgttctataaagtccatgacctagtggcaggtgctgttaagagctgtgaaacacacacacacacacacacacacacacacacacacacacagtaaaggaataaaagaatggccactccataagcaaarcagccatgagggctgctggttgcacatttttatggttatttcttgattatatgctaaacaaggggtgtattattcatgccttccctttttagaccatatagagtttaaaaaaaaaaaagaaagaaaaggagtgaagtggggtgaggagagcagatggagcaagtgtgctggaaaggggcactgttaaatagcacaacttgggagggtctcaccaaagaggtgacatttaagcacagacctgaatggaatgagagggtcagccatggtgtatgatatatattttatatacctgtaaatctc

SEQ ID NO: 174595 - DNA, 601 bp, Human
gacatttaagcacagacctgaatggaatgagagggtcagccatggtgtatgatatatattttatatacctgtaaatctcccatgcaattgtctgaaaggagaatattggggttcacctgtgaactgggcatctgcttcttccctctcaggagtttgacctggatgtggttgctgtggtgaacgacacagtcggaactatgatgacctgtggctttgaagaccctcactgtgaagttggcctcattgttggtaaggacccagactgtcctttccacatggggatgcacagccttgggtgtgraggggttggtgctgagtgaggccctggtatcctgtgattggcaggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggtaggcacccaactggggccctgttaagtgtatcccaggactggatggcaacaagtgatcagagcttccaca

SEQ ID NO: 174596 - DNA, 601 bp, Human
aattgtctgaaaggagaatattggggttcacctgtgaactgggcatctgcttcttccctctcaggagtttgacctggatgtggttgctgtggtgaacgacacagtcggaactatgatgacctgtggctttgaagaccctcactgtgaagttggcctcattgttggtaaggacccagactgtcctttccacatggggatgcacagccttgggtgtggaggggttggtgctgagtgaggccctggtatcctgtgattggcaggcacgggcagcaatgcctgctacatggaggagatgcgcaaygtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggtaggcacccaactggggccctgttaagtgtatcccaggactggatggcaacaagtgatcagagcttccacaatggcatctcccaggacgccggttctcgtgagatgttaataaaggaggttttcttggaaagggtttcttgtcgaatgcacctgga

SEQ ID NO: 174597 - DNA, 601 bp, Human
ggcactctaaggagaaacaagtagaaagttgaagcacctgctgctgacaggctgaagagcatctcttgggtgatgcagacaggagcaaatcctctccctcctccatcttccagcgccgagcaccacctactgtcagaattgagcaaggggccagccccagtgtcacaaggtcctgtgcatggtaggggagcggggtctgagctaagagacaatagcttaagatctaacacacttctcattaagatgttgtctgtagtgtttcctaactagattaatcaaacaccctagtcctgcagaataygctttgcaaaacatgtgtctagaatagaagttacagactaaaatgcctctaggggccaggcaggcaacattaatgaaggaagcaggctgggtcaagataagatggggtggtgatgggctattggttgaaactagggacctcgtttttttttcaaggcaggattcaggaccaaaagaccctcaagccactgcataataacgtttagttccagtggccaggatgggggccctacagctggcagtagttacttgagtaatgatggttaggtccaagagaatgtatactgaatgcctagtgagg

SEQ ID NO: 174598 - DNA, 601 bp, Human
attctcatcgatttcaccaagcgtggactgctcttccgaggccgcatctcagagcggctcaagacaaggggcatctttgaaaccaagttcttgtctcagattgagaggtgagagcttagggctcagggtagcaggggggccatgtccttttttctcactggcagacaaactgaaggatttccataactcagggcatgactcatacaaaagtcagtttagtggcaaacacattcatgtctatagtgtttactaaaagcacattatgggcagttgtcattttaagggcaaacagagcattctyatgaaagtttgtgctaagcctggcctgaggtcatgcaaagtgatattgttgggttttagaccatgtatcaaaggtagaaagatacctgctcatagcatgtaaattgaaacgcacagaggaagataacctattaaagcatccacacttggcttgaaagcccttcctaactgctggctgcagtaatcaggcagccaggattgagtaaaggttggaacgtcaggcaatgcagacacatgccacacagtggctcattagagcaaagcctccctcctacagtcaaatggtggaaaatctccaaat

SEQ ID NO: 174599 - DNA, 601 bp, Human
tgttgggttttagaccatgtatcaaaggtagaaagatacctgctcatagcatgtaaattgaaacgcacagaggaagataacctattaaagcatccacacttggcttgaaagcccttcctaactgctggctgcagtaatcaggcagccaggattgagtaaaggttggaacgtcaggcaatgcagacacatgccacacagtggctcattagagcaaagcctccctcctacagtcaaatggtggaaaatctccaaattagaacagtgaatttcagagccctttaaaaattaatgctgtgccatyactctcagggcagagaagaacaggaactagacaactgatgtgagtagacccctcgggcatctgcaccagtgaatagaaagatatattctagcttataggtctgttatgttcagcgaggtgattccaggcttctaaaatagctttctttatataggagggtttattttctttctataactttatttacacttccttcgtaaatagcatataaatacagttcagaccacccagagcagcagagcagaaataaagcacgagtctaatgctgcttggttagttcctgccctgcaaacccatgaa

SEQ ID NO: 174600 - DNA, 601 bp, Human
ttcttggtgcatgactgaacacttgctgtctccctcccaccccagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcagtgagtgcctgatcccagcccyccctgcctaccttctttctgtctttgttctttcccttttctttctctctttcctttgttactttatagtgaattatcagccattccaaatagtgtatataatacatggattatagtttaaagattcataatcagaagtaggcctgtgtttcaccccccaccgtgggaagccccctccgagcccctccacaactgtgtcatcattctcccatgccaggggtaagtgttgtgctgaatcagtcccttgcttttcttttccacccccatatatgtaggtatgcatccatattgtttagtttta

SEQ ID NO: 174601 - DNA, 601 bp, Human
aggacacagtggaaaaaacagaggaccagactcagggactcacgttccaaacccagcaccagaactcactgccaagtgatcagggtgattcggctggcctcttaggacctgattttatttctttccaatatttcctatggctttatagatgtttttgaatattttgagcactcttcaaataatatggtgctagtgaatttgaggcaacatcttgagaccaatcattctgagcataaaaatctatgaaaatgaatagaatatttaaaaactagatgtgacgggccctttaacaagccaactkttgcttgttataccttttcaaactagaaatgaagccacggaagcatcttacaggtagacgcttgtactgtgttggctggagaaactcacaccatagcagagactgatagcgtctggcctgcgtgcactgctgaatgcctgcgggatgggtatggcctcttcctcaccacgtctaaatgcaagcttctagaaactgaagacaaggcagctggggagggagcagactgtcattaactttagaactcctaacttgggcttcaacaacacagatggttctgaatgacagaccaccatatgaaat

SEQ ID NO: 174602 - DNA, 601 bp, Human
ctgttgagcccagggaaaacccgcacgggcagcaagggagccagttgaccaggttttcataaaagcagctacatgcacatccctgaaagagagagtgatgagggagtcccggagaaaagacacagctgtagtaaaacacttcagttgccataagaacaaaatagcctattaaacaccaggaagggtccaatgagaaaaatttgctcatcatttcctacttctatgtttggcttatttctaaaatacagtaataactaaattggcaaactaaatttaaactcagccaagcatgctttcatgytgagtttagaggaaaaacaagcccctgcagctgaccaaattaaaggcagatcacaccttcaacttttgcccacctcttccacgtaggatcaatcatagatttctgaccaagaaaaatgcaaagccattaaagcacttcccagaccacattctgtagtcctacctcataggactgatgagagtttaaatatggctgcgcatgaggcactgcatacaagttcagccgtcagtgggctgatggtgaccattctcaccacatcaagtccaaggtctcctcactttcaaggatacctcctaccta

SEQ ID NO: 174603 - DNA, 601 bp, Human
tcgtcttgggtcccaggcccagtgcagcttcatcacctgggggacaaaactgagttttgcttcactccacacagctgtccctggaaaaatgatttccagatttcattgctttgactattaaagactgaaaactgagcagcactgcttagcagacatcagatattctgctaatcaatcgtattaatgaactattgactaatagtatcatccttaacgtcaccagtcaattacaaatgtgtgtgagctggctccatgggctgcttcacggagagcaggtttttggaaacgtaagcagcgggtstccactcactcgttcactaaggctcgaatgtggacacgtcccccaagcactcagccttctcatctgtcaaatcacactccctgcagacatcatgctgccccgatgggggtggcgatgcgggggtgacagggataatttcaaagcatggctaccgctgaggctggcagtgtgaatacctgtgcccagctggctctatttctagagggctgctctggctacttaaaaagaagaatatgctgaaaacagttaacctatgaagttatcaactccccggtaaaaaatcaggatgtctcttccacc

SEQ ID NO: 174604 - DNA, 601 bp, Human
cccagcttaagtgaagacattttaaatgttgtctttgaaataaaggacgaaaaatgctggtctgagattgtttgaatgacaaggctaaaggggaagctagggaagaagaaaatgtaagcctgcttactctattaacacagataaagcagatcctatctggccttcaagatccccaaaggcaggggtagtcgtcttgggtcccaggcccagtgcagcttcatcacctgggggacaaaactgagttttgcttcactccacacagctgtccctggaaaaatgatttccagatttcattgctttractattaaagactgaaaactgagcagcactgcttagcagacatcagatattctgctaatcaatcgtattaatgaactattgactaatagtatcatccttaacgtcaccagtcaattacaaatgtgtgtgagctggctccatgggctgcttcacggagagcaggtttttggaaacgtaagcagcgggtgtccactcactcgttcactaaggctcgaatgtggacacgtcccccaagcactcagccttctcatctgtcaaatcacactccctgcagacatcatgctgccccgatgggggtgg

SEQ ID NO: 174605 - DNA, 601 bp, Human
aataaatgtcgactgaatccattaccttttcacttacttcagctgagacccttttagaaaggcaaaaacttaaaaacaaaacagggtctcattctctcacccaaactggagtgtagtggggtgatcatagctcactgcagctttgacctcctgggctcaagtgatcctcccaccccagcttcctgggtaactgggaccacaggcgcatgccaccatgcccaaaacattttttaatttttagtagagatggagtctccctatgttgcccaggctggtctcaaactcctgagctcaagcaatyctcccaccttggcctcccaaagtgctgggaatggccaccaggcccagcttaagtgaagacattttaaatgttgtctttgaaataaaggacgaaaaatgctggtctgagattgtttgaatgacaaggctaaaggggaagctagggaagaagaaaatgtaagcctgcttactctattaacacagataaagcagatcctatctggccttcaagatccccaaaggcaggggtagtcgtcttgggtcccaggcccagtgcagcttcatcacctgggggacaaaactgagttttgcttcactccac

SEQ ID NO: 174606 - DNA, 601 bp, Human
gggatcaagctgaagaatccttgcattttgacccgtggaggagaaggcaaggaataaaggctgcacttcttcccagaattaaacacagtgcctgacttccaggaggtgctcaataaatgtcgactgaatccattaccttttcacttacttcagctgagacccttttagaaaggcaaaaacttaaaaacaaaacagggtctcattctctcacccaaactggagtgtagtggggtgatcatagctcactgcagctttgacctcctgggctcaagtgatcctcccaccccagcttcctgggtarctgggaccacaggcgcatgccaccatgcccaaaacattttttaatttttagtagagatggagtctccctatgttgcccaggctggtctcaaactcctgagctcaagcaattctcccaccttggcctcccaaagtgctgggaatggccaccaggcccagcttaagtgaagacattttaaatgttgtctttgaaataaaggacgaaaaatgctggtctgagattgtttgaatgacaaggctaaaggggaagctagggaagaagaaaatgtaagcctgcttactctattaacacagataaagc

SEQ ID NO: 174607 - DNA, 601 bp, Human
agtagttgtaacttcagatgaatgccacatttccagagagaaaacaatttttaaataagacaaaacatacaatgctctccttgaggcaggcacctgtggattttcccctaaaaccccaaaaatgtgtatttgctcttctttcttcctctattgacatgagtactttggggaaagaatgagaagcgccaaggcacaagtcactgagaaaccggttaaaaggtggcgagcaatggcttgcagaagtggacaaacatttactgatagctgggcacgaccattaaagagcctctaacacctttaygagtaagtaaaaacaaataagcacagctgccagttatcctgttcaacagatgtacagcgtgcaaagctgaccacagccaggtcctccttccagaaattaattccccataaaatgtcagctccatagagcgaggcttttcatctggttctccacgaaaaccccggcacctagaatagtgtctggtgcatggatggtgcatttaataaatgtttgcagaaagaataactcagttctgcagctcttgctactcatcctcagagcttattcactggtcaatgaccaatggcctgagagaatcca

SEQ ID NO: 174608 - DNA, 601 bp, Human
cccacggggaactctggtggaaaaagcatttttttaatgttaaaatgtcttgcatgtgggcatgttatggattggaatacaatttattttttaatttttttcttacgagatggggtctagttatgttgcccaggctggtcttaaactctgggttcaagcgatccttccacctcagcctcccaagtagttgtaacttcagatgaatgccacatttccagagagaaaacaatttttaaataagacaaaacatacaatgctctccttgaggcaggcacctgtggattttcccctaaaaccccaraaatgtgtatttgctcttctttcttcctctattgacatgagtactttggggaaagaatgagaagcgccaaggcacaagtcactgagaaaccggttaaaaggtggcgagcaatggcttgcagaagtggacaaacatttactgatagctgggcacgaccattaaagagcctctaacacctttatgagtaagtaaaaacaaataagcacagctgccagttatcctgttcaacagatgtacagcgtgcaaagctgaccacagccaggtcctccttccagaaattaattccccataaaatgtcag

SEQ ID NO: 174609 - DNA, 601 bp, Human
gaagggccgccatcctccggagaggccaggatgggcaggaaacgccagcttggcacccaccgtccagagcatgcctcctgctctccctgcctcagtccccacagctgccgcccattcacagagcaaaaggctcacgtgaaaagactcaccacaattttccaaggaatggagtttattaaaatactgctggaggcttttggctggaatgttttttctccttgtaaaacgggaactatagcagtgttgtctataggaaagctcagaatacgctcagaaacatcagtcacaacagagactatgyaggggctggtgcatattaccagtgattccatccattccgcggctcctgctccagagataacattcggctcagaggagaaaacttccaggcagaccctaggatgggtaggagagaggaagccaagtttccccacccttaacataaacccacggggaactctggtggaaaaagcatttttttaatgttaaaatgtcttgcatgtgggcatgttatggattggaatacaatttattttttaatttttttcttacgagatggggtctagttatgttgcccaggctggtcttaaactctgggttc

SEQ ID NO: 174610 - DNA, 601 bp, Human
aataggaataccacttgtgattgttctaagttcttccattactgagtctgtttctgagaattctgactgatttgcttccgccactcagcctggagctctgcagctgtcttcacgcactgcctgcttgcctcttaggtgactgcctttaaattaaatgtaccaaaatcagcctgtgctccagcataaatcagttagaacagataggatgccaggggagatggagggacaagagcccatttgtaacagcaaaaggagatgccacctagaaataagctcccttactgaaccatcccgttggttsttgcagtgcactgctttttccaaaatttttacatttgttttaactgaaagtatagtgatatactacttgtgtctgggcaggatgctttcaaaatagcactttccccccaaacacacacaatgcaaagtgtgtatgggtggggggtggtggggggctgcaataggaagctttgcctctgccccactgttccaactgagcccgggttccccacagcccagccggttgaagggagcggcggctcctctgctggtcaagctctggaggaacatcgcctgcccagagctccacaccagcagtggc

SEQ ID NO: 174611 - DNA, 601 bp, Human
aaaggtacaaatgcttttcagagtgtgttccttgctttttaattttgtgtaaacttctaagttaaatttgcatgcagtcaaagctatcatttcggcactggcttatgcaccttctaaaggcctcttccatctcaagatcaaatactgatgtttgctctctgggtctttcatgttcgtttaatagttaattcttcagtccatgagaaatacgcaatatgactacatgctgttgcaatagagttttagtgtgttttccttcaaaagtattagctgtttcaacacatttattgaacaattattyttctcccaaataggaataccacttgtgattgttctaagttcttccattactgagtctgtttctgagaattctgactgatttgcttccgccactcagcctggagctctgcagctgtcttcacgcactgcctgcttgcctcttaggtgactgcctttaaattaaatgtaccaaaatcagcctgtgctccagcataaatcagttagaacagataggatgccaggggagatggagggacaagagcccatttgtaacagcaaaaggagatgccacctagaaataagctcccttactgaaccatcc

SEQ ID NO: 174612 - DNA, 601 bp, Human
gttcaaagcttagctccaccatcatacttggtgaccctggataaactgctggaggccctgcttcttcatctgtccaatggggacaactctaatagcctcagcaggtgttctcagatttaaagagagaagcgttttgccaaaaggtacaaatgcttttcagagtgtgttccttgctttttaattttgtgtaaacttctaagttaaatttgcatgcagtcaaagctatcatttcggcactggcttatgcaccttctaaaggcctcttccatctcaagatcaaatactgatgtttgctctctgsgtctttcatgttcgtttaatagttaattcttcagtccatgagaaatacgcaatatgactacatgctgttgcaatagagttttagtgtgttttccttcaaaagtattagctgtttcaacacatttattgaacaattatttttctcccaaataggaataccacttgtgattgttctaagttcttccattactgagtctgtttctgagaattctgactgatttgcttccgccactcagcctggagctctgcagctgtcttcacgcactgcctgcttgcctcttaggtgactgcctttaaatta

SEQ ID NO: 174613 - DNA, 601 bp, Human
tgtttcccaaagcacattccttgaacgtgagttgggataacaggttcagttctttttttattaactgtgggacttctcagagcctttaatatgccaacatgggtgatgatgctcttaatggataatggagtctgattatccagactctggatttctcccagtcaatcgctgccctttatccctcaagagactcaatgccaaggtgaggggatccacttcattagaaagtcacgaaatgtgcaggtcacagtccaacaagaaacgaatccacccaccaagcagaaggaacagtcatccatgmaggaggcttttccagccatcccatctcggtttattttgcacttctaactactagtgaggaccaaagtttcacatattaggcgtttgtgtttcttcctctgtgaattgcctatgtagccagctctttcttctaacaaagtattcctacttctcctattgatggaggcaatgccatgtggtagttaagagccccggagtcaggttgtctgggttcaaagcttagctccaccatcatacttggtgaccctggataaactgctggaggccctgcttcttcatctgtccaatggggacaactcta

SEQ ID NO: 174614 - DNA, 601 bp, Human
ttggctaatatcacacttagggccattgtcaaaaaagggtgtagaatccaggccacttagtgtgtaggttatgatccttcccaggaaaacaatgtttcccaaagcacattccttgaacgtgagttgggataacaggttcagttctttttttattaactgtgggacttctcagagcctttaatatgccaacatgggtgatgatgctcttaatggataatggagtctgattatccagactctggatttctcccagtcaatcgctgccctttatccctcaagagactcaatgccaaggtgaggsgatccacttcattagaaagtcacgaaatgtgcaggtcacagtccaacaagaaacgaatccacccaccaagcagaaggaacagtcatccatgaaggaggcttttccagccatcccatctcggtttattttgcacttctaactactagtgaggaccaaagtttcacatattaggcgtttgtgtttcttcctctgtgaattgcctatgtagccagctctttcttctaacaaagtattcctacttctcctattgatggaggcaatgccatgtggtagttaagagccccggagtcaggttgtctg

SEQ ID NO: 174615 - DNA, 601 bp, Human
tctagtgagccacccagggacaaagactgtgggctggagtatctgctggaggcccctgccggctctgttctctccacctatttaccagatggggcagctcataggcctgagagaaactgaggtctcttctgccagcaaaaggggagcctgaaagtggtgacatcaacagaagggtatccatggtgatgttcttttagttctaggcaacagacctccagttctgagagactgagagaccatcaggcctgcacttcgcagagtgggggcccgagacccaaagacctgcaattcccaaagcaarttagtggcagactcaaagccacagcccaggtctcctgacttccagtaagatttgccaaggcaccttcttaatggacatagtgcttccttttcatctacctttgtccctcctattgaagcagcaggaagtttcctgaagcagttctctatttgcacaaatagataaataattccaaaaaagctatgtttccttctaccccattttaccaaacacttatgaaaataaaaggtttggctaatatcacacttagggccattgtcaaaaaagggtgtagaatccaggccacttagtgtgtaggtt

SEQ ID NO: 174616 - DNA, 601 bp, Human
cagggcatcagggcacagcctctaggctggtggaacccaggagtgagccaatcggccctaggaagccaacaaaggcagtaaaggcaacagccagcatcaattaagtgcctgtcttccactcacatctgcagtttacacgcaccccaaatcctcacaaccgtctcatgaattcggctttcggaaactgtgggagatgaagtgccttgtccaaggtctcaaagctggaaggtgaccaggccaggattcaagtcctagtgagccttctcttctggctctagtgagccacccagggacaaagacggtgggctggagtatctgctggaggcccctgccggctctgttctctccacctatttaccagatggggcagctcataggcctgagagaaactgaggtctcttctgccagcaaaaggggagcctgaaagtggtgacatcaacagaagggtatccatggtgatgttcttttagttctaggcaacagacctccagttctgagagactgagagaccatcaggcctgcacttcgcagagtgggggcccgagacccaaagacctgcaattcccaaagcaaattagtggcagactcaaagccacagccc

SEQ ID NO: 174617 - DNA, 601 bp, Human
gtggcattttcagcttcccattcagggatccttaccttgacaagttctcatgactatctacaaggcctcaatggagggcctcttaatctccttcctcagttaaataagccaagtccttgcaaacgtgcactgggttataaaatgccccactgtgggagccaaggctgggacttggttcacctgtgaaaactcagcccaaaaggctgcccagggcatcagggcacagcctctaggctggtggaacccaggagtgagccaatcggccctaggaagccaacaaaggcagtaaaggcaacagccrgcatcaattaagtgcctgtcttccactcacatctgcagtttacacgcaccccaaatcctcacaaccgtctcatgaattcggctttcggaaactgtgggagatgaagtgccttgtccaaggtctcaaagctggaaggtgaccaggccaggattcaagtcctagtgagccttctcttctggctctagtgagccacccagggacaaagactgtgggctggagtatctgctggaggcccctgccggctctgttctctccacctatttaccagatggggcagctcataggcctgagagaaactga

SEQ ID NO: 174618 - DNA, 601 bp, Human
aggatcctgaggacccaggtttcacaggtgacctggcacctctggaaggctgaggattgaggggtctgatgacctgggaggctgcaaggctggcttgtccttggacactgagatcaacctaagactccttcctgccgccttagaccatccagccacgctcttgtctagctttctctcccagggcttccgaagactttcccaatgataaccggggtcagctcctcattcagggagcagaagcaggaagaaaagtgcctagcaagcaatcaggaagaggagggggagagaccctcaccagggyggactgtgcagctggtgtcagatgacccttatctctgcagaatggaaaccagccagccaaagtctggaggctcaccttctgacctccatgactcgcctttgggtggggggccgtggcattttcagcttcccattcagggatccttaccttgacaagttctcatgactatctacaaggcctcaatggagggcctcttaatctccttcctcagttaaataagccaagtccttgcaaacgtgcactgggttataaaatgccccactgtgggagccaaggctgggacttggttcacctgtgaaa

SEQ ID NO: 174619 - DNA, 601 bp, Human
gtagggggcactaaatggccaatctgtttccaaggaagtctgcaaaacaaatgaggactccacttccagccttggtctgcttcttggctagtggcacctcacaagcattttctgcatcagggtcatgaataggtagcagcaggtgagctgctaaaatagcctccccaccagaaagcagtcccaggagaggcccagagatacagaacagaggcccatcactgggaggttgtgtaggaccctcacacatagactggggggctctcaagctggggaaaagggtacctggggggagactagagaygtaggttcaagaaggggacaagagattcagaggaaagaggagcaagaggtgagcagtgctgataaggaagagggtaaatggcaaggaagctgggaaaccgacagaaaggatcctgaggacccaggtttcacaggtgacctggcacctctggaaggctgaggattgaggggtctgatgacctgggaggctgcaaggctggcttgtccttggacactgagatcaacctaagactccttcctgccgccttagaccatccagccacgctcttgtctagctttctctcccagggcttccgaagac

SEQ ID NO: 174620 - DNA, 601 bp, Human
ctggtgacctgcagtgacaaggagaaagctactcctggggcagctttgggcacaaacagcgtgacggagaagacaggctttgcagacgggtagatcccaactctgctccttactaattagctgtgaggcttggaccaactcatgaaacctcacttggtttcctcatctgtaaaatgggcataaaagatcaaccttgtggtgtgcagtttaaataagcaaagggtctggaacagtacctggcacacgatagtcatctcttaaaacccgggagaacagcagagtattttgcgcaagtttgacrtgacctcagaactccatgcagacagctactacaagccaggtactatgctagaagctttacaccccccatctctcattcttgaagttagtgtcatgcccatctcacagatgaggaaactgaggctcagtggtcacacagctaagacgtggtaaagacaagagctgaacaggattgtgcctttcgatttcaaggcactccactatcaacttcaatgctcctaaccaagcatttcaggcatcctcagactaacagcctagaaacacctaaccaagaattttgtagaatttgaattcccaaata

SEQ ID NO: 174621 - DNA, 601 bp, Human
gactgagtaacttcttgccggtgctaagaattgtgaagacagctgcattcagagtcagccatcctctggtgacctgcagtgacaaggagaaagctactcctggggcagctttgggcacaaacagcgtgacggagaagacaggctttgcagacgggtagatcccaactctgctccttactaattagctgtgaggcttggaccaactcatgaaacctcacttggtttcctcatctgtaaaatgggcataaaagatcaaccttgtggtgtgcagtttaaataagcaaagggtctggaacagtamctggcacacgatagtcatctcttaaaacccgggagaacagcagagtattttgcgcaagtttgacatgacctcagaactccatgcagacagctactacaagccaggtactatgctagaagctttacaccccccatctctcattcttgaagttagtgtcatgcccatctcacagatgaggaaactgaggctcagtggtcacacagctaagacgtggtaaagacaagagctgaacaggattgtgcctttcgatttcaaggcactccactatcaacttcaatgctcctaaccaagcatttcagg

SEQ ID NO: 174622 - DNA, 601 bp, Human
atgtggccaggcactgtgttagggtctggggatagaggtgagcatcatggcatcccgcaggtgctcggaagccagagggccctccagtgctaagagtacagttacagcacacagcagtgctttcagtgcgttagataaaacgtggagatttggctgcccctacaggcagcgtttgggactaggaaggtcaatgagacaggaaaacaatgcgggcgaagaagtattaagcctctttaaaacacctgatgtacatatctcctctactcccaactgatgttcaacacatagctagaaagaggcaaaaaaaaaaaaaaaaaaaaaaatccccttgtatgaaggataatcctttcagcctggggcaaatctcctgaagagttttgttctgaactaggagtgttgttttagcttccagtcaatagtaattaagagtcccaatatattccagaaagagggagagggagattaacgatcattaaatctcttctgcatttggctccaaatctcttttcggaggggccggctgtcagatgatccctccaaagcgtccatctgacagcactcccgccgccaccatctggaacatcaattcgagagctcgcct

SEQ ID NO: 174623 - DNA, 601 bp, Human
gaggtctcctgagtcatagctcagctccaagaggcatccgtcccttctcatctctgggtctcagatcacacagcctagaatgtctaatgtggactcccctcagaatttggggatagcagggtttttggttcattatctcatatttatttgtggccatatcgacatgtggccaggcactgtgttagggtctggggatagaggtgagcatcatggcatcccgcaggtgctcggaagccagagggccctccagtgctaagagtacagttacagcacacagcagtgctttcagtgcgttagatamaacgtggagatttggctgcccctacaggcagcgtttgggactaggaaggtcaatgagacaggaaaacaatgcgggcgaagaagtattaagcctctttaaaacacctgatgtacatatctcctctactcccaactgatgttcaacacatagctagaaagaggcaaaaaaaaaaaaaaaaaaaaaaatccccttgtatgaaggataatcctttcagcctggggcaaatctcctgaagagttttgttctgaactaggagtgttgttttagcttccagtcaatagtaattaagagtcccaatat

SEQ ID NO: 174624 - DNA, 601 bp, Human
tgagacgagatcacgccactgtactccagcctgggtgacagagcaaaactccatgttaaaaaaaaaaaaaaaaaaaaagaggtaatgggaaaaatgctcgcttgtcattgcaagatctgagctcacctcacagtccctctcccacctggaagaaggcaggacatttcagagcccgatcaagcagcattcacccacctatctggccaaacagggaaacgcaggctgcttttgacaaggggcacgcaccctcctccttaaaaggacagctcagcaatcatgggaaagcagtggattccagccrctcctgtcagggattccaccaccttctttggatgatttgcaccaagtattttccctacatgacttcctttaatattcacaattgtcctcttttagagtgaggcaaatccagaattctctccattacacagatgaggaaactgaggcctggagtctggtagcttaccgagggtcacctagatattcaggatgcatgctcccagccccagctaactcatgactccgtgaccttaaagactctgtccatatactgccacctgccgggaccaccagcccttgagtcccaggggctgaggtctcc

SEQ ID NO: 174625 - DNA, 601 bp, Human
actcaagaggttgaagtacaagaggtaacagtagtaggccgggcacggtggcatcacttgaggtcgggagtttgagactagcctggccaacatggtgaaatctcgtctctactaaatatacaaaaattagctggctatagtggtacacacctgtagtcccagctactcgggaggctgaagcaggagaatcgcttgaattgggcaggcagaagttgcagtgagccaagatcgtacaactgcactccagcctgggagacagactgagactccatctcaaaaaaaaaaaaaaaaaaaaaaaaawtatggctgggcgcagtggctcatgcctgtaatctcagcactttgggaggccgaggcaggcagatcacttgaggtcaggagtttgaaaccagcctggccaaattggtaaaaccgcatctctactaaaaatacaaaacttagccaggcacggtggtacaggccagtagttccagctattccagacgctgaggctggagaatcacttgaactcgggaggtggaggctgcagtgagacgagatcacgccactgtactccagcctgggtgacagagcaaaactccatgttaaaaaaaaaaaaaaa

SEQ ID NO: 174626 - DNA, 601 bp, Human
atgtgttctccgggcttgatcccgacaatgtggagtcattaagggacattatccgaagtgcattttggcaagactactctgtatgcagagcaggcaggggatgacaggcaggaaggcctgtctacaggctattataacactccagtaatgcagggaggagcagtagcaataaacattcattgaactgctctaaaatgaggattgggacataccttcacccaacaggctggataaggtggatggcactctgtaaaaaagtgaccccgctttgggcaggtggaactacatctccactggcctycagcagcctgagctgcacccagtgccccttctgcctgcctccctcctggactccagccgcagttcctccctgtcacatgccctacttaacgcctgcagcatcaagactcaagaggttgaagtacaagaggtaacagtagtaggccgggcacggtggcatcacttgaggtcgggagtttgagactagcctggccaacatggtgaaatctcgtctctactaaatatacaaaaattagctggctatagtggtacacacctgtagtcccagctactcgggaggctgaagcaggagaatcgcttg

SEQ ID NO: 174627 - DNA, 601 bp, Human
tgggaagatgagcagttagagggagcagagttggtgtggacatgtgtcccagtcaaggaaacggcatgtacaaagatgcaacaagacagggcacaggcctgggagtgtgcaagacaaggagacaggaggaaggggcagggccagatcaagagctcttccacctagatgtgttctccgggcttgatcccgacaatgtggagtcattaagggacattatccgaagtgcattttggcaagactactctgtatgcagagcaggcaggggatgacaggcaggaaggcctgtctacaggctattatracactccagtaatgcagggaggagcagtagcaataaacattcattgaactgctctaaaatgaggattgggacataccttcacccaacaggctggataaggtggatggcactctgtaaaaaagtgaccccgctttgggcaggtggaactacatctccactggccttcagcagcctgagctgcacccagtgccccttctgcctgcctccctcctggactccagccgcagttcctccctgtcacatgccctacttaacgcctgcagcatcaagactcaagaggttgaagtacaagaggtaaca

SEQ ID NO: 174628 - DNA, 601 bp, Human
tctatccatcctgggttatctggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggatacaaaggtgaacaaaagaaaagatccctgccctccaagagccaaagctcctaggatggagcaagtccaagagacaggagaagcaaggggcatgctggggggcagggtgagggaagtgaggctccagcrgagatgggaagatgagcagttagagggagcagagttggtgtggacatgtgtcccagtcaaggaaacggcatgtacaaagatgcaacaagacagggcacaggcctgggagtgtgcaagacaaggagacaggaggaaggggcagggccagatcaagagctcttccacctagatgtgttctccgggcttgatcccgacaatgtggagtcattaagggacattatccgaagtgcattttggcaagactactctgtatgcagagcaggcaggggatgacaggcaggaaggcctgtctacaggcta

SEQ ID NO: 174629 - DNA, 601 bp, Human
attctggctgggagcggtggctcacctctgtaatcccagcactttggaaggccgaggcgggtagatcacctgaggtcaggagttcgagaccagcatggccaacatggtgaaactccatctctactaaaaatacaaaaaattagctgggggtggtggcaggcacctgtaatcccagctacttgggaggctgaggcaggagaattgcttgaaccagggaggcagaggttgcagtgagccaagattgtgccatcacactccagcctgggcaacaagaacaaaactccatctctaaaacaaaacaaaaaaaaagaagccttgcattctatccatcctgggttatctggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggatacaaaggtgaacaaaagaaaagatccctgccctccaagagccaaagctcctaggatggagcaagtccaagagacaggagaagcaaggggcatgctggggggcagggt

SEQ ID NO: 174630 - DNA, 601 bp, Human
gggaacctgctgatctctgtcccttacccatctagaaagtctgagtgggagctaacagctgatcctcagcaaaaccagagtgtgcgcccatcacctgctttctggtaagggacccatgtggcctgaatcaaaactcaaagctcactagacaccaattcacacgctctatctaatcaggcagaaacccagctgctcctgctcagtccctgcccagctagtaccttcccaccacccaccagctgtatctcaggctctgcccactctaagctttccctgggatttgcctgccaagggtgggccacggtgtcctctgtggtgctctgcagtgcccatgttcctcacatcagaagccttgcattctggctgggagcggtggctcacctctgtaatcccagcactttggaaggccgaggcgggtagatcacctgaggtcaggagttcgagaccagcatggccaacatggtgaaactccatctctactaaaaatacaaaaaattagctgggggtggtggcaggcacctgtaatcccagctacttgggaggctgaggcaggagaattgcttgaaccagggaggcagaggttgcagtgagccaagattgt

SEQ ID NO: 174631 - DNA, 601 bp, Human
aaacttcccccaaacaaaagtgagggctttcaaggagacttgctgagtgggcaaacattttggaaagatggaattttaaacacaaacacaaaagggcaaagatttgcagcagaagagctatgcacacagccgggaggactttaattagggaaagctttgcaaagcccagggagcatcagcatcggcaaatctccccttggtctccggaatggaaagaatgtggaaaccaatgggtgatcaaggagttcgaattttgcctgacactcttgctgggaatgaagcatgcagtcctgtcttttgccaccttttcagcagcctcaggtgagccttttaaaaaggtgaaaaacgaaggaccacctagcctgggagaagccagggtggatcctctccttcctagggtgcttcctgcagatggcacacagccaaagctcttctggtgttttaaggcagaaacagaattcaggggaggactaaacaacccctttagagctacgtgctgtgttttttgtttgcatttttccaagtccaggcatttttccaggtatttccaatgagactgaaatggcctacacataggctgacgacctataataacataaga

SEQ ID NO: 174632 - DNA, 601 bp, Human
gcactgttgcacattgaacaggagggaaaagctcttttgttcattttccttagaatggaaccaaaatgatactccagtagctccatctaaaagctcaagtggcagctaacagcacggacaccaggggcatcccttgccagcttccaatgccatggtgagagacactcatcatggtttaaaaaaagaccagagagcattttcacaagcaattcctaagagacttaaatttcctacacataggcagaataaaaaccaaaaaggaaaaaaaaaaaacttcccccaaacaaaagtgagggctttsaaggagacttgctgagtgggcaaacattttggaaagatggaattttaaacacaaacacaaaagggcaaagatttgcagcagaagagctatgcacacagccgggaggactttaattagggaaagctttgcaaagcccagggagcatcagcatcggcaaatctccccttggtctccggaatggaaagaatgtggaaaccaatgggtgatcaaggagttcgaattttgcctgacactcttgctgggaatgaagcatgcagtcctgtcttttgccaccttttcagcagcctcaggtgagccttt

SEQ ID NO: 174633 - DNA, 601 bp, Human
tgggcttcccggcccacattcctggcctatttcaaacatcagggaagcagactgagcgtgccatgccctcctcaagtatttttaacctgtttccaaaaccagacatgttctaaggggggcgacccaggaattcctcatccagggccagtgcctgccaaccgcgagatgttggctttctaacagctctgaggagggagttgttgtctgccttttctggcacgtggggaagtgggatctctctccaattcacttttacgtctcacatttctcatcaaccagagggcaggatctaacttaaagkgagagtcttcagaccatcctcaatggaagctctccaaacactgttctccggcttccaacaacaacaggagtccataaggttccccaaatgaaggacctggatagatcttgtaggaaaaaaaatcctatgaggacaaggccaaggaacgggcctatatgcacttcacttgaattatgcctcctggctctaggtgacaagagccatctttttcaccactggagagctcagcctcctaccaccttgccccgatcctgacctggttcagattcctcgctaacatacttctctcaccttgtagca

SEQ ID NO: 174634 - DNA, 601 bp, Human
cactggcagttaaagggggtgatgatggagaggagaaaccccaggctccaactacaaaaccctgcgggacacgcaggctcctctgggcttcccggcccacattcctggcctatttcaaacatcagggaagcagactgagcgtgccatgccctcctcaagtatttttaacctgtttccaaaaccagacatgttctaaggggggcgacccaggaattcctcatccagggccagtgcctgccaaccgcgagatgttggctttctaacagctctgaggagggagttgttgtctgccttttctggyacgtggggaagtgggatctctctccaattcacttttacgtctcacatttctcatcaaccagagggcaggatctaacttaaagtgagagtcttcagaccatcctcaatggaagctctccaaacactgttctccggcttccaacaacaacaggagtccataaggttccccaaatgaaggacctggatagatcttgtaggaaaaaaaatcctatgaggacaaggccaaggaacgggcctatatgcacttcacttgaattatgcctcctggctctaggtgacaagagccatctttttcaccact

SEQ ID NO: 174635 - DNA, 601 bp, Human
tcagtctcccgatgagccaggcgaggtgctgagccctgtactcctcgccccaggggtcctgatagccccttgggaggcgaatgacctttgaagccacagcagaggctgaccagctcagagcacggagccactgagtcagagggcggaggtctggcttcctccaacagattctccaaaaatcctcacgaccacaagcttctaaacctcaatgacctaccatgattccagtaatacttctgtttcccttcaagtgggagtgtttgtgccatgtttacgtgtctgagtgggggagcgggtgctraggcagactcaacaagtcgggttgcttcgctgttctcagcacaaaagtcacccaggctgtctggccacaatgtttcacactggattccttccactggagggatgtctcatcaggttttgctgtaatttcactgagtcacccatagaaacgaccaagcaggggagactggaggggacatctccagggggccacatctgagctgagttacagaaagtgaggcagggctggcagttagggcaggtcgcaaagcagcccaaggactaaggtgcagacagagagcatctctgtctgtcaaaggca

SEQ ID NO: 174636 - DNA, 601 bp, Human
aactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagaggctgaccagctcagagcacggagccactgagtcagagggcggaggtctggcttcctccaacagattctccaaaaatcctcacgaccacaagcttctaaacctcaatgacctaccatgattccagtaatacttctgyttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggagggatgtctcatcaggttttgctgtaatttcactgagtcacccatagaaacgaccaagcaggggagactggaggggacatctccagggggccacatctgagctgagttacagaaagtgaggcagggctggcagttagggca

SEQ ID NO: 174637 - DNA, 601 bp, Human
gccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagaggctgaccagctcagagcacggagccactgagtcagagrgcggaggtctggcttcctccaacagattctccaaaaatcctcacgaccacaagcttctaaacctcaatgacctaccatgattccagtaatacttctgtttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggagggatgtctcatcaggttttgctgtaatttcactgagtcaccc

SEQ ID NO: 174638 - DNA, 601 bp, Human
agacacctgaggcagaaagtgacaataaggagtcacacggccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagrggctgaccagctcagagcacggagccactgagtcagagggcggaggtctggcttcctccaacagattctccaaaaatcctcacgaccacaagcttctaaacctcaatgacctaccatgattccagtaatacttctgtttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggaggga

SEQ ID NO: 174639 - DNA, 601 bp, Human
catttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacrtcgacactggtggggatgccagggaaatctcacatgttctgtttagcagaaacgagacacctgaggcagaaagtgacaataaggagtcacacggccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgc

SEQ ID NO: 174640 - DNA, 601 bp, Human
agctgaaagagtcaccagctggatggtggcagagagaagtacttggcaagattggtttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacgtcgacactggtggggatgccagggaaatctcacatgttctgtttagcagaaacgagacacctgaggcagaaagtgacaataaggagtcacacggccaggcaaccatgggcaatggcaacgcaggggatactttagaatctgaaa

SEQ ID NO: 174641 - DNA, 601 bp, Human
ggtcttaccatttaaaaggcatgtaacacacatcctcattttatcatcacagcaaccctgcagaaggcaggggtgttattatcccacattactgtttacaggtgaaaaaaagaggcacaggtaggttaagcaacttggctatggtcacacagcaggtaattcaatgaaagccatgcgatcccaccctaaggccgtgcggactctagaatgacacctggtgagtaacctagcaggcaaaataattcagctgaaagagtcaccagctggatggtggcagagagaagtacttggcaagattggkttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagc

SEQ ID NO: 174642 - DNA, 601 bp, Human
atataagttgatttttctccaaagacactgtaatttcacagaggatctctgtcctctcgtttaagtgaaaagatacatagtgaaaccaaatttttgttctcgtcaacattttaatgaaacattattcaagggcctgctgtaggtcataattcccaagaacctatggacaacattaagtgaggacttactgaactatcaaagttatgattggaataacagcaaagatgtttaggtcttaccatttaaaaggcatgtaacacacatcctcattttatcatcacagcaaccctgcagaaggcargggtgttattatcccacattactgtttacaggtgaaaaaaagaggcacaggtaggttaagcaacttggctatggtcacacagcaggtaattcaatgaaagccatgcgatcccaccctaaggccgtgcggactctagaatgacacctggtgagtaacctagcaggcaaaataattcagctgaaagagtcaccagctggatggtggcagagagaagtacttggcaagattggtttttcacacaaggtcaacgcgaacggaacctctcataccagccacctactagggtacagcatcaagacc

SEQ ID NO: 174643 - DNA, 601 bp, Human
gtaccctacacaggctcctcctaaagccagacccgcagccttcccagcatgaaggcaagcacggggtagctgctgttctcttcccggacggtcctcagtcctcggtccagctttctcagtccacatttttattaaggattattggccagacgcagtggctcatgcctgtaatcccagcactttgggaggccgaggcaggaggatcacttgaggccaggagttcgagaccagcctgaccaacacggtgaaaccccacctctaataaaaatacaaaaaaaaaaaaaaaaagaaattaggcacygtggcgagcacctgtaatcccagctactcaggagactaagggaggagaatcgcttgaacctgggaggcggagggtgcagtgagccgagatggcgccactacactccagcctgggtgacagagaggactctgtctcaaaaaattaaaaaaaaaaagattatcgtattggcttgtattcttctgtcacctgaaatctttttgggaaaagaccaggtaaaaatacacaaacataactcatatataagttgatttttctccaaagacactgtaatttcacagaggatctctgtcctctcgttta

SEQ ID NO: 174644 - DNA, 601 bp, Human
ccatcacctgtgtgcagagaagccagggtctctctaagctcccggctgcttttaattaaggactcgtccctgagagatgaagcacaacatacaaaaccaccttcgagtcaccagaatggaagtcatcttggacttagtgctgagaactgcctgcagccggccagccagccggcaggagaagctgccgcctacagccaggcgatggcctcaggctaaggagcacagggaggctcccctgactcaggcttgccccacacccagcatcctgcatgtctatccagaccacctttcttccccgtgytccacctaagtcatccttcagggtctgattcggccacgcctgcctcttccactgcaacctcccaaagccgcgacggcagaggccgttgccccgcctctactcctgcaccctgtgcaggatgcggtcttgagcctcacaggtttgtgacatgcatgtgtctccccagggcagtgatgagctgtctggacggcctcatgcccggcttgatgctggcaggacttctgaagcgttggtgggatggtgtgggatggtggaaaactagggccacttgggtcaggttctgatcttttgaagcccaag

SEQ ID NO: 174645 - DNA, 601 bp, Human
tgagcaagccacgcaacatagatttgagataatggtacatacagcacatctggcggagtaacacagatgtttctgacttaagatttttttgattctgcgatagtattcagtagaagctgtagtttgaattttgatcttttcctgggctagcgatgcacggtctgatcctccctcatgacgcagggagacagcagctcccacagctccccacaagccctgtgatcaaaaaggtgagcgatgacactctacagccaccgcgcgccaggtgctttcaccaaactgtaggtgtgttctgagcacrtttagggtcagccagcctaagccacgacgcttggcaggttagggggattaaaagcattttctacttccagtggatttttcgtcacgtaaccccttcgagggtgcagcagcatctgtacctgctcatatgaggcacatgactcaaggcgggggttgtggttggttacctagggtttaatacaactgaggctggccgagagggccaacattaggaagccatttttgaccaacaaatgatttattctacttagaaatgagtcttccacatgccattaacaacaaagagctttttcaggaaacg

SEQ ID NO: 174646 - DNA, 601 bp, Human
ctgtctcaaaatacaaaacaaaacaaaacaaacaaacaaaaaaagtgagcaagccacgcaacatagatttgagataatggtacatacagcacatctggcggagtaacacagatgtttctgacttaagatttttttgattctgcgatagtattcagtagaagctgtagtttgaattttgatcttttcctgggctagcgatgcacggtctgatcctccctcatgacgcagggagacagcagctcccacagctccccacaagccctgtgatcaaaaaggtgagcgatgacactctacagccacygcgcgccaggtgctttcaccaaactgtaggtgtgttctgagcacatttagggtcagccagcctaagccacgacgcttggcaggttagggggattaaaagcattttctacttccagtggatttttcgtcacgtaaccccttcgagggtgcagcagcatctgtacctgctcatatgaggcacatgactcaaggcgggggttgtggttggttacctagggtttaatacaactgaggctggccgagagggccaacattaggaagccatttttgaccaacaaatgatttattctacttagaaatg

SEQ ID NO: 174647 - DNA, 601 bp, Human
aggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggtggagaggaatgagaatctcaatttgagactgacccagctcttccaaagaccaggccccaccgggtcaacaaggcgagctgcccccatccccagtcaggctcaggggacaggggaggaaaaaakaatagaattgggggaattatgggactgtgaggaccaaagctttttcccccaagtgcccggtcacggcagacccaaggtgcctggggtcgcctgggaagggctgcagggctgggctctcctgcccctcaccacagcccacagcccacagcagatccgacatgtgacctttccactctgggcctcggggactcctggcgtgtgggcaggggctcagtgcctactgcccagcagagcctagtgagaaactggccccccgcctgccagggccacacacaagaggacacttccaggtccagcctc

SEQ ID NO: 174648 - DNA, 601 bp, Human
cagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggtggagaggaatgagaatctcaatttgagactgacccagctcttccaaagaccaggccccaccggrtcaacaaggcgagctgcccccatccccagtcaggctcaggggacaggggaggaaaaaataatagaattgggggaattatgggactgtgaggaccaaagctttttcccccaagtgcccggtcacggcagacccaaggtgcctggggtcgcctgggaagggctgcagggctgggctctcctgcccctcaccacagcccacagcccacagcagatccgacatgtgacctttccactctgggcctcggggactcctggcgtgtgggcaggggctcagtgcctactgcccagcagagcctagtga

SEQ ID NO: 174649 - DNA, 601 bp, Human
ccttcagtggggctcccttcaccggtctgtccagatggacacatggcctccaccagcctatgagagatgcaggaatccccaccccaccaccactacttagtgtagagaaaacacaagcctgctccccaactccccaagggcagcttcgttacagggaccccagtttgtcattaggaacactgagccacggaagcacagcttcatgtagccgaggctggagcttccgacccattttgcctaatggctctctgagcatggccacctctgcaatgagaaggcacctgcacaggtggcagcttcrcgccgggcctgaaagtcacacccgggtggccaagcttgtttttggacgggaagcagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggtggagaggaat

SEQ ID NO: 174650 - DNA, 601 bp, Human
ggtcaggatcccttcagtggggctcccttcaccggtctgtccagatggacacatggcctccaccagcctatgagagatgcaggaatccccaccccaccaccactacttagtgtagagaaaacacaagcctgctccccaactccccaagggcagcttcgttacagggaccccagtttgtcattaggaacactgagccacggaagcacagcttcatgtagccgaggctggagcttccgacccattttgcctaatggctctctgagcatggccacctctgcaatgagaaggcacctgcacaggyggcagcttcgcgccgggcctgaaagtcacacccgggtggccaagcttgtttttggacgggaagcagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggt

SEQ ID NO: 174651 - DNA, 601 bp, Human
tggctgtcctcgcctagggagatggcctccaggtcaggatcccttcagtggggctcccttcaccggtctgtccagatggacacatggcctccaccagcctatgagagatgcaggaatccccaccccaccaccactacttagtgtagagaaaacacaagcctgctccccaactccccaagggcagcttcgttacagggaccccagtttgtcattaggaacactgagccacggaagcacagcttcatgtagccgaggctggagcttccgacccattttgcctaatggctctctgagcatggcyacctctgcaatgagaaggcacctgcacaggtggcagcttcgcgccgggcctgaaagtcacacccgggtggccaagcttgtttttggacgggaagcagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctg

SEQ ID NO: 174652 - DNA, 601 bp, Human
gatcacacgaagagatacaaatcagaagtttccggccacaagtgaggttcgtgtttgtgccgccatatggttctactttgcctcttcctcttctccattagttattaatgttgaaaaaaattgttcaaccagaaaaagaaacttgagatgaacccttaaaaaaagcacaaaagccagagcagctcagacccacggagtctaacccacggcgcccttgtctttaagaagtgcacccttgtacctcggttttttaaaaaatggccaaatgaacacattccatcttttgatctgcctgttggcygagagcccaccaccagcaagataggaatcaaaaacagattctgcgtacttgggtgcactcagaggaaactgccacgccagaatgctgcagctgccgacgtccagcagagggctctgtgacaatttgttccttttatttttccagaaggcccaaaactttcttaaaaagataaaagagcatttcaagtggcacatacactcgtgtcagaaacaaaatatacagtgtggcattctgtaaaaacaccaacctcgaaaccgaacaggttcaaatcctcggtcagtcacttgctggctgagtgta

SEQ ID NO: 174653 - DNA, 601 bp, Human
ggcaacggcctcaggtgacacctgaataataatccgtggaaggaccaggtgatcgtaatagccctgccctgcgtggcaggcactatgctagcagctctccctgcccttccctatgatcctgacaatggctcttcacacagacacgcactccagtccttgttttaaagaaggggaaacagggccttagagaaataacttgaccggagccacgcagctacgggccaatgtctgaggaaggacatgcagttatatacagcacagctaggttcaaaaagaaactgcttttcccaaactgaacactttttttttttcttaaatcatccaacccaacagctgatcacacgaagagatacaaatcagaagtttccggccacaagtgaggttcgtgtttgtgccgccatatggttctactttgcctcttcctcttctccattagttattaatgttgaaaaaaattgttcaaccagaaaaagaaacttgagatgaacccttaaaaaaagcacaaaagccagagcagctcagacccacggagtctaacccacggcgcccttgtctttaagaagtgcacccttgtacctcggttttttaaaaaatggccaaa

SEQ ID NO: 174654 - DNA, 601 bp, Human
cttggagggaaggttcagataacaccaaaggtgtcagaccaatccaggctgttggggggatttaaacataattcccagtgacttggaataataaacactacactggtcaggacagtgcctgccgtctttctggtgggagttcagggctccaccagttcctctgctgccacaggagtgtgcccaccccagggagcaggagccacaagtccttcaccaccgatacttttgccgggctcggtggtacccaggaggccactggaaagacgggtggggagtgggtaaagtgaactagggcagggaraagaaaaaaccccagaaggtagaaggtaagggagagactaggatgccattggcaacggcctcaggtgacacctgaataataatccgtggaaggaccaggtgatcgtaatagccctgccctgcgtggcaggcactatgctagcagctctccctgcccttccctatgatcctgacaatggctcttcacacagacacgcactccagtccttgttttaaagaaggggaaacagggccttagagaaataacttgaccggagccacgcagctacgggccaatgtctgaggaaggacatgcagttat

SEQ ID NO: 174655 - DNA, 601 bp, Human
tcagcgcagcatcacgcccgctgcagcagggatcagtcaatgcatgctgattccatgtaagtggatattaatcctgtggtctgaggccatattacagaaccagaatgaaggcagtgtatctctgtaatctaaccagtccctacactcatctgaaccccggcccccgccccctactcatgtcgagtgcttagagcagtggaagaaatcacattaagtgtcacagaccatgggtttgtacagtgatttaaatgaaacgacaggtccaaacaaagccgagagttcactttggggtgcatgtggyactggctctgtcgcctccaaagccagggagggcctctgaggaggaggagcggtgctgacacgcggcagccggatggtttctgtctaaaccacccatctgaactgcctaacggccttggagggaaggttcagataacaccaaaggtgtcagaccaatccaggctgttggggggatttaaacataattcccagtgacttggaataataaacactacactggtcaggacagtgcctgccgtctttctggtgggagttcagggctccaccagttcctctgctgccacaggagtgtgcccacccc

SEQ ID NO: 174656 - DNA, 601 bp, Human
cagcctcagcgcagcatcacgcccgctgcagcagggatcagtcaatgcatgctgattccatgtaagtggatattaatcctgtggtctgaggccatattacagaaccagaatgaaggcagtgtatctctgtaatctaaccagtccctacactcatctgaaccccggcccccgccccctactcatgtcgagtgcttagagcagtggaagaaatcacattaagtgtcacagaccatgggtttgtacagtgatttaaatgaaacgacaggtccaaacaaagccgagagttcactttggggtgcaygtggcactggctctgtcgcctccaaagccagggagggcctctgaggaggaggagcggtgctgacacgcggcagccggatggtttctgtctaaaccacccatctgaactgcctaacggccttggagggaaggttcagataacaccaaaggtgtcagaccaatccaggctgttggggggatttaaacataattcccagtgacttggaataataaacactacactggtcaggacagtgcctgccgtctttctggtgggagttcagggctccaccagttcctctgctgccacaggagtgtgccc

SEQ ID NO: 174657 - DNA, 601 bp, Human
taaagatggggtttcaccacgttagccaggatggtctctatctcctaacctcatgatccacccacctcggccacccaaagtgctaggattacaggtgtgagccactgcgcctggccaggccatgtatttttatttgctaaatctgacagccaatccccactgctctcttaaatcttactgatccttcagggcctggcccaaactccaacttctttatcaagatgtcaaattcttcagaattcctgcagtaacactaatatcaactgaatcctaaatgctttggggatggctgttctaataytgccaatgactttcaccttactccttcctcaccacttagcatttttcattgtgaattgactccacacctacagaggccaagacaggccctccagcctcagcgcagcatcacgcccgctgcagcagggatcagtcaatgcatgctgattccatgtaagtggatattaatcctgtggtctgaggccatattacagaaccagaatgaaggcagtgtatctctgtaatctaaccagtccctacactcatctgaaccccggcccccgccccctactcatgtcgagtgcttagagcagtggaagaa

SEQ ID NO: 174658 - DNA, 601 bp, Human
tccctgaacatgcacgtgcattcccccacttaaacatcttccccattgagggttgctggataaaacagagggaggccagttcagtctgaatttcagatacacaatgaataacattttagtatgactacttcctaaaggttacatgggtcgtgtgttttttttttctcaatgagatggagtccagctctgtcacccaggctggagtgcagtggcgcgatctcggctcactgcaagctccgcctcccaggttcatgccattctcctgcctcagcctcccgagtagctgggattacaggtgtgygccaccacgcccagctaatttttctatttttagtaaagatggggtttcaccacgttagccaggatggtctctatctcctaacctcatgatccacccacctcggccacccaaagtgctaggattacaggtgtgagccactgcgcctggccaggccatgtatttttatttgctaaatctgacagccaatccccactgctctcttaaatcttactgatccttcagggcctggcccaaactccaacttctttatcaagatgtcaaattcttcagaattcctgcagtaacactaatatcaactga

SEQ ID NO: 174659 - DNA, 601 bp, Human
tacatggtgtgcccacagacttggaccacagcagctgcccaaaggtgcattagtcacgacctggcaccatcactgatcccgtctcatacccacgccgtccctccacctctgcccgaaactcctcaaacaaccacacggtcccattcaccactccctgaacatgcacgtgcattcccccacttaaacatcttccccattgagggttgctggataaaacagagggaggccagttcagtctgaatttcagatacacaatgaataacattttagtatgactacttcctaaaggttacatgggtcrtgtgttttttttttctcaatgagatggagtccagctctgtcacccaggctggagtgcagtggcgcgatctcggctcactgcaagctccgcctcccaggttcatgccattctcctgcctcagcctcccgagtagctgggattacaggtgtgtgccaccacgcccagctaatttttctatttttagtaaagatggggtttcaccacgttagccaggatggtctctatctcctaacctcatgatccacccacctcggccacccaaagtgctaggattacaggtgtgagccactgcgcctggcc

SEQ ID NO: 174660 - DNA, 601 bp, Human
aactaaatctgaatggatgctgatgacaagtttcctgtgtggttccaacccagcactctcagatatgaaccatggtatggtgggaaagcactgaacaaagagaaccggagctgtcatgaaagccctggcattttttattaacatatgacctcaaggagccacagcattggtggaaagagtgagaactaagagacctgggttctagcctctgctctgctgtgagctggccacggaaccttaggcaaagcccaagactgttcatttgtcaaacacagtagatgagctgcacggagacagaccrcccttgaagatctgtgatgggacttctgaaagccagtatgccaggtactaaccaaccccagaaaaacatacatttaaactggaactcaaaaactggcagtgcttgtcctacagtgaaaagcctctgggacttgatatggccaacggactccacccaagcaggcaccatttttgccttttggatcaactcttaagctgggccatagttttggccatatttccatcagcgctgtttcttttgatcaaagataatctgctctggaataataacattttcgttgtcatggggaatgagaaatgt

SEQ ID NO: 174661 - DNA, 601 bp, Human
agttccacctggagccagctgtttcccttctcctgccaggcacactgcttgcagctaagtcccctcaacgtaggaaagctcacaagaaaatagggtttggtataaaagaggcttgactctactcctatccaagagattcatctatgaatcgaaagcatctgagtaatctcttcctagcacttaacaccaggtggagtattttttcattgatcagttatctgtatccctcactagaatgtaagttttactggggcaaggacttcgatcttactcactgcaggattctcagtgcctgtggctrtgcctgacacacagcaaatgcttaatatatttgggaggaaggaaagaaaggagggaaagagggaggaaaggaggagttttacaacacggagcctcccaaactccaatcaactttactttaaaattaataaattggcaggtaataggaatctttagcaaaagcacttgtccagaactaaatctgaatggatgctgatgacaagtttcctgtgtggttccaacccagcactctcagatatgaaccatggtatggtgggaaagcactgaacaaagagaaccggagctgtcatgaaagccctgg

SEQ ID NO: 174662 - DNA, 601 bp, Human
accctgcctcataactcacagaaattctggccttggtgagatgatctgtttcttatacaggggacagtacccaaagagatagacatacaccaccaacccctgtgaacaatgtgctgggcttacaggtgtgagcccccaggcctggcctgtacctgtgcttgttttcagaattctttctccatgtgtatctgccctttcctaacaaacataataaaaatgggggctactttcaaagttggttttggtgataatatcatgcaccttaccatttccatgtgcctgccatgcaccacgcactatagtagagcatattgttgacttgaaagctcacacgcattctgcaaagtgggtatgcaaagccccattttacagattagagttgaggccgggagccataaagttacccaagggccacacaagaagcaagcagtggagacagaaaacaaaaccagggccagatgagtccaaagtccctactcctcctactctaactttggtttaatgtccagctaaggggaaggacagtgcatgctaaaggcaccctctggtggcaaacagccctctcctagccccagccctgcttagctgtggccacagagcc

SEQ ID NO: 174663 - DNA, 601 bp, Human
aaccctgcctcataactcacagaaattctggccttggtgagatgatctgtttcttatacaggggacagtacccaaagagatagacatacaccaccaacccctgtgaacaatgtgctgggcttacaggtgtgagcccccaggcctggcctgtacctgtgcttgttttcagaattctttctccatgtgtatctgccctttcctaacaaacataataaaaatgggggctactttcaaagttggttttggtgataatatcatgcaccttaccatttccatgtgcctgccatgcaccacgcactagggtagagcatattgttgacttgaaagctcacacgcattctgcaaagtgggtatgcaaagccccattttacagattagagttgaggccgggagccataaagttacccaagggccacacaagaagcaagcagtggagacagaaaacaaaaccagggccagatgagtccaaagtccctactcctcctactctaactttggtttaatgtccagctaaggggaaggacagtgcatgctaaaggcaccctctggtggcaaacagccctctcctagccccagccctgcttagctgtggccacagagc

SEQ ID NO: 174664 - DNA, 601 bp, Human
tcagcagacgggctgacagcgacagtggttcctgtgttcttccagaaggcccttgccaccatccaagagacaggcagggacagggagtcccaccaccacagggaccacccagcctccacgggctcctctgctgcccctccagggtgctttagaactcagcttggaaagcaacgcccagcacaactaaaggactgtaaccctgcctcataactcacagaaattctggccttggtgagatgatctgtttcttatacaggggacagtacccaaagagatagacatacaccaccaacccctgtgwacaatgtgctgggcttacaggtgtgagcccccaggcctggcctgtacctgtgcttgttttcagaattctttctccatgtgtatctgccctttcctaacaaacataataaaaatgggggctactttcaaagttggttttggtgataatatcatgcaccttaccatttccatgtgcctgccatgcaccacgcactatggtagagcatattgttgacttgaaagctcacacgcattctgcaaagtgggtatgcaaagccccattttacagattagagttgaggccgggagccataaagttacc

SEQ ID NO: 174665 - DNA, 601 bp, Human
cctgccagggggccgcctcaccaagaaagatgaccccgcggtcgggggctggcaggactcaaactctgggccaatgttgcgactctgacacaaggctctgcaagtaaccaggccactggcctcctcctcccaactcaaacatcaatttctaccaaaatatcccagaaagggatggcagcactttcagaaatggattccttcaggcctgagtcacttccacgctatattttcaatgtgctgacttatttgtttcatgggcctgggtttatgggggctccaccatatcgtttaccaggaaagygcctgccagttgcaccaataacccttcccagtggaaaaattccatcgtatggcaaagacaccagcagagcagctcagcagacgggctgacagcgacagtggttcctgtgttcttccagaaggcccttgccaccatccaagagacaggcagggacagggagtcccaccaccacagggaccacccagcctccacgggctcctctgctgcccctccagggtgctttagaactcagcttggaaagcaacgcccagcacaactaaaggactgtaaccctgcctcataactcacagaaattctggc

SEQ ID NO: 174666 - DNA, 601 bp, Human
tacactgccctccgcaggactgaatgcaattataatagaacagttgtttttgaacaacatccctctcccgttagactggaagatccatgaaggcagggggcctttggtccgctgctctatctctcatgcttgtgggtggcactcttcaaacgtctgctgcatgattggaataacagatggaacgatgagaagaatggggaggacaagagaagaaaggagaggagggcagggaacaaacggaaggaaagctgaatgggctgccagctgcccaagtccaaggtccccgtgctctgcagcaggyacctacggcagcccgcgtgtgcctgctgtgcctgctgcatccccggggcatgagctcacctataggagtccccatctctgttgtagtcacacaaaaggtaatcctttcccaccaccttgtctctggcaattttcagtggctggtcaacagaagacaggagatcctcacatagactggggacctggcagagagaaaggacaaggtcgaaacagaggttaaaacagcacaccaaactcaggtggctaacaatactgcagccatattgtggtcagtacctttaacatctggccctgggcactg

SEQ ID NO: 174667 - DNA, 601 bp, Human
tgtgtctcctatgctagacctggtgatcagacacccagggcagggactaatgtcaacttagttatttacagccttgggcgaggtgacggaaagagagaggagagttgtgtatctgacagagctgcgttcgtagatcccttaccacagagaccctcccagccctcaggatccccatcatatgcgcaccctgtacactgccctccgcaggactgaatgcaattataatagaacagttgtttttgaacaacatccctctcccgttagactggaagatccatgaaggcagggggcctttggtccrctgctctatctctcatgcttgtgggtggcactcttcaaacgtctgctgcatgattggaataacagatggaacgatgagaagaatggggaggacaagagaagaaaggagaggagggcagggaacaaacggaaggaaagctgaatgggctgccagctgcccaagtccaaggtccccgtgctctgcagcaggcacctacggcagcccgcgtgtgcctgctgtgcctgctgcatccccggggcatgagctcacctataggagtccccatctctgttgtagtcacacaaaaggtaatcctttccc

SEQ ID NO: 174668 - DNA, 601 bp, Human
agccaaggcaggaggatcatttgaggtcaggagttcaagaccagcctggccaacgtggtgaaaccctgtctgcactgaaaatacaaagactagctgggagcgatggcgtacacccgtaatcccagctacttgggaggctgaggcaggagaatctgcttgaacccaggagacagaggttgcagtgagctgagatcgtgccactgcactccaacctggacaacagagtgagactctgtctcaaaaaaaaaaaaaaaaaaaattagctgggcatggtgatacatgcctatggtcttgtgcaggkggccatgttcgcatcactgcactacagcctgggcgacagagcaagatgctcccaaggacagcacctggacgccatgctgtgaccagcagttccaggcacagaatgagcccttcaaggatgaatttgatcggcctcagggctgtatcaccatctatatgctgggacatctgcagccacatccccagcctaaacctctctcctggaactccacatggtacatccacagcctacctggtatctccactttgatctaatgggcctctcaagcttaaagtgtccctatgcctgctcctccccgag

SEQ ID NO: 174669 - DNA, 601 bp, Human
aaaaaaaaaggagagagaaaaagtcaaaaaaattagctggggctgggcgcagtggctcatgcctataatcctgacattttgggaagccaaggcaggaggatcatttgaggtcaggagttcaagaccagcctggccaacgtggtgaaaccctgtctgcactgaaaatacaaagactagctgggagcgatggcgtacacccgtaatcccagctacttgggaggctgaggcaggagaatctgcttgaacccaggagacagaggttgcagtgagctgagatcgtgccactgcactccaacctggrcaacagagtgagactctgtctcaaaaaaaaaaaaaaaaaaaattagctgggcatggtgatacatgcctatggtcttgtgcagggggccatgttcgcatcactgcactacagcctgggcgacagagcaagatgctcccaaggacagcacctggacgccatgctgtgaccagcagttccaggcacagaatgagcccttcaaggatgaatttgatcggcctcagggctgtatcaccatctatatgctgggacatctgcagccacatccccagcctaaacctctctcctggaactccacatggt

SEQ ID NO: 174670 - DNA, 601 bp, Human
taatgatgttgattaagcaagaccagttcaaggaacacctcctccaggaagcgttccctgaactgcatgccgggcgagaatacttctccctgcctgctccctggtctgtcagaccactcaccatcttcactggacttctctctctaagggctggtccacccacttcatcagtggctccctggctgggcaatgtggctcacacctgtaatcctagcaatttgggaagctgaagtgggaggactgcttgaacctaggagttcgaggccagcctgggcaacaaaatgaggcccccatctctacaaaaaaaaaaaaaaaaggagagagaaaaagtcaaaaaaattagctggggctgggcgcagtggctcatgcctataatcctgacattttgggaagccaaggcaggaggatcatttgaggtcaggagttcaagaccagcctggccaacgtggtgaaaccctgtctgcactgaaaatacaaagactagctgggagcgatggcgtacacccgtaatcccagctacttgggaggctgaggcaggagaatctgcttgaacccaggagacagaggttgcagtgagctgagatcgtgccactgcactcca

SEQ ID NO: 174671 - DNA, 601 bp, Human
cagtcaggatggaaatctgtggacagaatcagaagaccttgaagtttcatatcgagaagaggagaaagaaagacatactttctgcctccacaccccaggctcctctctaaaggcctgagatcccccagagctggtggtagggcctcaggaatgcaggtgggggacaaaggggtgacctggaagggctgcaggtaccaagtctcccgcagagcctggcctagccacggacctagacatgatcccgtccttccaccagctcctgcagaacagctgccttacacagtcaactggagtttttagrtggaaataataaatataataatgatgttgattaagcaagaccagttcaaggaacacctcctccaggaagcgttccctgaactgcatgccgggcgagaatacttctccctgcctgctccctggtctgtcagaccactcaccatcttcactggacttctctctctaagggctggtccacccacttcatcagtggctccctggctgggcaatgtggctcacacctgtaatcctagcaatttgggaagctgaagtgggaggactgcttgaacctaggagttcgaggccagcctgggcaacaaaa

SEQ ID NO: 174672 - DNA, 601 bp, Human
ctccgagaaggctttttgtttcagctaacaggtttcaaacggtgctgctggcaacggtcacaccataaggatcttatttaagcaaaccatcaaacacagtcaggatggaaatctgtggacagaatcagaagaccttgaagtttcatatcgagaagaggagaaagaaagacatactttctgcctccacaccccaggctcctctctaaaggcctgagatcccccagagctggtggtagggcctcaggaatgcaggtgggggacaaaggggtgacctggaagggctgcaggtaccaagtctccygcagagcctggcctagccacggacctagacatgatcccgtccttccaccagctcctgcagaacagctgccttacacagtcaactggagtttttaggtggaaataataaatataataatgatgttgattaagcaagaccagttcaaggaacacctcctccaggaagcgttccctgaactgcatgccgggcgagaatacttctccctgcctgctccctggtctgtcagaccactcaccatcttcactggacttctctctctaagggctggtccacccacttcatcagtggctccctggctgg

SEQ ID NO: 174673 - DNA, 601 bp, Human
ccctcaccctcgactgcaagaggtctttgacagcagagagcctgtgctgcctgcccttgtccccagtacccagccctgagttagtgccaagcagatgctgctggtggaccgaagcctcacagcccgggagaggaagaaaggggaattctgctggtgttccacttctccaaaccaagagatggagcagctttctggctttttcatgctggtcacgggcatggcgcccaggtgctgtccttcttgggagcatcttgctctgtcgcccaggctggagtgcagtgatgtgaacatggtccactgyacaggaccataggcatgtaccaccatgcccagctaattttttttttttttttttttttttttgagacagagtctcactctgttgcccaggttggagtgcagtggcatgatctcagctcactgcaacctgtgtctcctgggttcaagcagattctcctgcctcagcctcacctaagcactaaaaaacaaaaacaccaaatcaacaaaagcctctcatcagatctcagagacaaagatccaggtgaaaagatgctgtcgccatgatttatctataaacaaggcttggttcttctgctggccg

SEQ ID NO: 174674 - DNA, 601 bp, Human
agactccatctcggggaaacaaacaaaaaaaaatgaatgaattcttcttgtccaatcacagttgtaaataaataaaataaaaaagcatgaattcttgcacccccgcccccccaccacaacagaaccaaccactccctcctccctctcacacagatgttgatcctcatgcctgtcatatccttgcccttcttccctcaccctcgactgcaagaggtctttgacagcagagagcctgtgctgcctgcccttgtccccagtacccagccctgagttagtgccaagcagatgctgctggtggacygaagcctcacagcccgggagaggaagaaaggggaattctgctggtgttccacttctccaaaccaagagatggagcagctttctggctttttcatgctggtcacgggcatggcgcccaggtgctgtccttcttgggagcatcttgctctgtcgcccaggctggagtgcagtgatgtgaacatggtccactgtacaggaccataggcatgtaccaccatgcccagctaattttttttttttttttttttttttttgagacagagtctcactctgttgcccaggttggagtgcagtggcatga

SEQ ID NO: 174675 - DNA, 601 bp, Human
gtatgtaggggaagagttgctgtgcttggtgtccccaaagagtctccaggcaggaattacactcctgatcacctcaaagcagaaggagccttggaaatccttgtttccaagctgaccactttctgctgctcaccgcagttttggtagagactttgcaagaatggggtgagacaccccctgctgccccatgagcagcagccagctttcatggtcacactgggccatcgcacaccatgggaagcaaactgtcaacaagctgggaccccagatggctgggaagacaggcgtgccgcccacaatygatgcctcagttctcctgagaagccaagcgcgggctgacctgtcagttcttgtagcctgtcgctcctccctctgaaacggggctgcccaacagaacttcctgagacgatggagatgttctaaatctgtgctgtccaaaacaagtcactagccatgtgtagctacttgcatacttacaatgtgaccggtatgaccaagagactcaattcttaattttatttaatgggaatcaatttgaatgcagatagctcactctagaacctcagctaggagggggcaagagccttttctgtcatcttct

SEQ ID NO: 174676 - DNA, 601 bp, Human
agggctttctggaggtttggagaacaagggctctgatgcgggcagactggggcacacgcccgtgctccacctctcactggctgtgaatgctcagcaagtgtcccaactccctgagcctcacttttctcctgcgtaaaatgcggctgctacttgctccgcacacagggtcgtcatgagaaatgagacaagcagatcaagcgcccagcccagagcttgccagactgtcagtgttcaacaaatgctagttctttcttacccgctttctcagttttgtgttcaccacctatttttttttctttcttttttttttttttttaagacagagtctagctctgtcgcccaggctggagtgcagtggcgtgatcttggctcaccacaacctccgcctcctgggttcaggcgattctcgtgcctcagcctcctgagtagctggaattgcaggtgcaagccaccaggcccagctaatttttgtatttttagtagaggcggagtttggccgtgtcggccaggctggtctcaaactcctggcctcaagtaatctccctgcctcagcctcccaaagtgctgggattataggtgtgagccaccgcgcctggccatg

SEQ ID NO: 174677 - DNA, 601 bp, Human
aaatatgggttcaaatcctagcttttcacctccatgtcctgtggtcttgtgtgagtcatttaacctcttggaaccttggtctcatttgtaaaaggaggaacaaaaccatcttccccagaggttcttgttaaggagtaaagataatgtatataaaatattcgtatataatagaactacagactgggggccaagccccacccacctcaaagctcaagaggtgaattttacattttaaaggttcaacagaaaacaaaccaagaagcagcaacagagaccttatgtggcctgcaaagcctaaaaygtttaggatctggttcttgacagaaaaaagtctgccaacttgaattagtattgcctattttacagttttgctgtattttcagtatagagcttaattataaatgagattctgttgattatggctaactttctctggagcccttccttgtaagcctgaacaattaagtgacatgttggtgctgtggtgctgggaggcaggattagacggagcaggaagaaatctcaacagatctagcaaaacgctttttaaggaaggtgccgaggccacaaacaactcaggattcaggaagatgtttgctgc

SEQ ID NO: 174678 - DNA, 601 bp, Human
ccctggcacaaccagcccccctgcctggctggcttcctcaatgtcagacctcagtcaagtgtctcctcaagaggcctcatgggccactctacataacaagtcagctgctccctgttatcactagcagcaatgacttgttcactggtccactgtttgtttttccacaatggagtgtggtgagggcaggggcctcatctaccacgtacgaggtgcatccctggtactcagcaagcacccggctcatgggaggcactcaaatgtctgctgagtaaataaatcgatgttggactctggagctggrtaaggatggtttgatatcccagttccaccacttactagctctgtgaacctgggtaagttatatcacctttctgatctgtcagctcgtttgtaagagggggataaccctctctcatgggttcttgtgaagaccgaatgagacagagaatacctggaggcccacttgcatggccactggtaactgttatcatcaccatcgttattttattaccagtattatcactttaatattaaaccaattctacttgggcattcttgtttaatagctggattggcttcttaccaaatgggcaggtaaaag

SEQ ID NO: 174679 - DNA, 601 bp, Human
gagagagagctcttcagcacactccgatggcactgggtgagtcaaaattcatgcctctggtatcccggatggcagctccaactgctgtccctttggtggtctgcggtccctgtcacccaggaagagcctggccccactgcccctgcacatgcaaggtaaggaagggcctcctgcctctcctgcggggccactctcctccttcctcccgaggtgctgggaacagaacggcaccagcctggatcccactacacactgttgcagaccctcggggtctgggttatccagttcgacccccaactgrgggcaggatgctgtcgtcacccctctttcaactcccccgagtcagtttaccttcagagaggagtgtgtaggcaagtcaaaggcacacagaaatcaaaagccaccttacaaatacacatttcccagggaagggaaaggcttcaccagaggcagcgtgaagagtgaggccttagctatgactcccggctcctgtggttttctagctgtgttaaccagcttgagtacttatctgagcctcagcttcatcagctgccaaatggaataactcccacttgtcctatagtcactgtaaggattcagt

SEQ ID NO: 174680 - DNA, 601 bp, Human
tgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagccaagagccaaggacttcagagcattgggcgagatgtctggcgcagatgggagtaatcatctttggaagaaggcagtgccagccctttggtcagaacatctggtcccaggcagaacccggggccgacacaggccagggmcagacttgatgtgaaagctcgagcagggaaggtttcctatcttctccaggaacctgaaaaatcaaagtgttaatcttggggttcatggcagcccactggtcgctcacaccagcaagatgttcctctgacagctgctggtgcctgacctacagcaaagtctccacttctaagtctctcccaagaaagatcacttaggtcaaaagatgaggttttgtgactgatgagctagcctaggcttggacctaagaaagcagagtcggctctgctgagaaagagtgtcaaatgatcctccgagccagc

SEQ ID NO: 174681 - DNA, 601 bp, Human
cactctataaacttcttccagacaaggagggctgattggaaaagctaattaaagcttttgaagattatctcagaactgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagccaagagccaaggacttcagagcattgggcgagatgtctggcgcagatgggagtaatcatctktggaagaaggcagtgccagccctttggtcagaacatctggtcccaggcagaacccggggccgacacaggccagggccagacttgatgtgaaagctcgagcagggaaggtttcctatcttctccaggaacctgaaaaatcaaagtgttaatcttggggttcatggcagcccactggtcgctcacaccagcaagatgttcctctgacagctgctggtgcctgacctacagcaaagtctccacttctaagtctctcccaagaaagatcacttaggtcaaaagatgaggttttgtgactgatga

SEQ ID NO: 174682 - DNA, 601 bp, Human
gggccctgggactgccatgaggacgccagccttgtttcactctataaacttcttccagacaaggagggctgattggaaaagctaattaaagcttttgaagattatctcagaactgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagccaagagccaaggacttcagagcatkgggcgagatgtctggcgcagatgggagtaatcatctttggaagaaggcagtgccagccctttggtcagaacatctggtcccaggcagaacccggggccgacacaggccagggccagacttgatgtgaaagctcgagcagggaaggtttcctatcttctccaggaacctgaaaaatcaaagtgttaatcttggggttcatggcagcccactggtcgctcacaccagcaagatgttcctctgacagctgctggtgcctgacctacagcaaagtctccacttctaagtctctcccaagaaaga

SEQ ID NO: 174683 - DNA, 601 bp, Human
cactctttccctggaaaatctccccctaccgcctgcagttcctccacactcacgtcccgaggaaggggtgccctgaggggtctggggctgggaacctgcagtttcaaggaccccggaaatcaggtgcaaacatttctcacatgtgaacatggacatcctgcccttcctgggccaatgttcctcaaacatcaaatggcgggaaggagcaggaacaactgcagttctgaaatggcccagagaggggacaggtgctggggagcccaggccggggggtggggcccatccacccagctcctggctkctccactcctggagaggcccttgggccctgggactgccatgaggacgccagccttgtttcactctataaacttcttccagacaaggagggctgattggaaaagctaattaaagcttttgaagattatctcagaactgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagcca

SEQ ID NO: 174684 - DNA, 601 bp, Human
accctgatgatgtggattgagcaggaatcattaattccatttttgagacagagatttcctggaggccttgctgtgggaggtggtggaagagccccatcccgaaactacggccttctcgcatgatcacgaagcctgctaccccatcaggtccgccacccaaatggtcccgtatctgtgatcataaacgcacagaatgtaagatgcaggtacagaatgtaagatgcacgtacagatacctgctgcacaattagaagagccctgtcacccagcagcctggaaggtgctggctggacgcaaggcrtgagtgcagcaggggtctgacgcacagtgtgtcactgagtgacgcctcagcccacagcatgggtaaggaaacggaggctcagagaggttaactcactcgcccagtcagtcagcaagaaaagacaaagagagaatccagtccaaagctctttaaagccaaggtcctctccattccgtggctgggcctcagacgccatgggtgagggtcagaggcttttggtgggaggtggtggtgccttctgcctgggaagccccccagcacctcagctgcccgctcacacttctgcactctttccctgga

SEQ ID NO: 174685 - DNA, 601 bp, Human
ccgtttccagcggtggaaaaagcccccggggcacctggaactgcagagttcactcagccagagcaaaggaagcagccctccactctagctgagctgtcaggcccttcctgctcctggcctctccaatccagcctccacactacttccgaggaacttctttggatgcacatcagagctgtcctacccttggaaccttccagacctttcccaaggctcccagaatgacacccagagcccgcaccccacaggcctgtgcgcctctccccactgccctgtcctgttccggcctccactcactgcycacgaccactgggaatcccttcagggcgtggcccaggcggttcccactgctcagggcactgtccttgtcctctcccatcacagtacagggctgtgcccgggatccccagaccacccgaggctccataattcgctacaaggactcacggaatgtggcacaaagttgccctcggggccaagggttattgaagggaacagagcaaaggaggctgagggagaaggcgctggggctggggtcctgagaaaccaggcaccagctttcaacgtcctgctccatgacgtcacacaggacgtgatacac

SEQ ID NO: 174686 - DNA, 601 bp, Human
gccagatgaaaggggaccccaggacagggggcaacatgcaagcctgtctagatccactctttagggacttgataactgtagcagacacccccactaggagcagtggtcacgaaagagctgaaacgcactgcgagagcaggaagcaggctcagctgtacccctccaaagctgtgaggtttctccagacctttctctctgctctgtgaaaacaacacaatagaggtgggcttgggtttccccattaagtgcttctggcactttctcacaagccccaggcagtggcaagccggtgtcccacagsaggcagggcgggttctcagaggccctgtgcgcacatggctgaagacacaaacatgttcaaacccaagtgctaattacactgtggacatgccagaagccagagacggcctggctccaccctgctgtcccgagtgcaagatgagtggcaagcggtgcccgtcacgggatccctctggaggcctttacatctggggaaaggtcctacctctaggcaaggaaatgagaacacagacctcgctgaagggacagggagtgaagggggatgtccccaaccaaaccgtccctgcagctccaggatgtt

SEQ ID NO: 174687 - DNA, 601 bp, Human
caggatgggggagcttgaccaagggagggagctggtccctgcttccagcagcagagtttcactccaacatgtgcaacggcccaaaccaaagagtgactgtgtgccatctggttagaggaacccaagaattctagaggcatcagagtccctgatgctgacgtggggatcatgttcataagcaaacttgttttctgcacactcctgttttccatttaactttctttcagcagatgaaaatcagactgcacatgccaagcaaccagacactggcctgcagccttgggatgccagatgaaagggraccccaggacagggggcaacatgcaagcctgtctagatccactctttagggacttgataactgtagcagacacccccactaggagcagtggtcacgaaagagctgaaacgcactgcgagagcaggaagcaggctcagctgtacccctccaaagctgtgaggtttctccagacctttctctctgctctgtgaaaacaacacaatagaggtgggcttgggtttccccattaagtgcttctggcactttctcacaagccccaggcagtggcaagccggtgtcccacagcaggcagggcgggtt

SEQ ID NO: 174688 - DNA, 601 bp, Human
gagcaaagtgctggagtcacctgtttgcttgcgtccactgaagagctaactctttcaactgagtgccatcagttttaccaacggtcccggcgccttttaagactttcctaacacagattaacatcttgttttgttttttgagacagggtcttgctttgatgcccaggctggagtgtggtggtgcgatcaccgctcactgcagcctcgacttcctgggttcaagtgatcctccttccccagcctcccaagcagctgggaccacaggcatgcaccaccatgcatggctaattaaaaaaaaaattttttttttttttttttttttttagagacagggtcttgctatgttgcccaggctggtctcaagccgtttatcagcacagccaattacaattaaacatctggttgggtttttgtctatcgtcaccttggtccctaaacgtggatcagctaaaagcctaatgtgtcagtaattctcttcttctcagagttttaggtcgtttctccctgaaaatcactcttccagttgaataatgtcatagtcacggatatagattctatgtccgtaacttttcaaccacaggacttctggggggaaggagaa

SEQ ID NO: 174689 - DNA, 601 bp, Human
aagggatctccagggactggagcagccacaagtctcaacctgacattccgagacaaagggagcagaggactgcatggttagaaaggcctgtttcagaattgcccagaagcaccagcctctcctgcgagtgccatcagggcgctccggcaccttcaggagggaggtgactgcagggcgcacagacagcgcccccgctacatggtttatggctttgctctgcgcgtgaagcattaattaaagggggaccacaacacgtttttgaaaatttatttcttacctactgtactttgatcataatgayatgaaacaaggaaaaaataatttttatgtggtttgcatttatgagtttttacataaaggcttttgtgggtattttaagaatgtgctaaaacgttgtctgaaaccacataaagccatctgaggagtcgcccgccagaattaacagcacatacatggaagcagtttaactggtctttgtatatttaatgagtcaaatagtattaatattgtttaaatgctaacatgctatttcaataaggtggctctaccatcgccagcgactcactctcaggccttgtacttccatgtgagtgaatgatca

SEQ ID NO: 174690 - DNA, 601 bp, Human
ttttgcaattttacagtaagtcataccattccaaactaaaaagcttttgtgaaaaatcagtacacgaatacaccggagtgtaatgtaactaagagaccaccagaccaagaaagcaaggcatcctcccaggagaatgagggtgccctggctggtctgccctcactccaacccgcagacctgcggagcatccagggggccgatactcaggtgggctacccttggccccctgcccagggctccctcaggcaggctgcggccagcccctgcggcaggaccacatcctgtcccattcccctctccrgcactacccactatgattaagctctcaaaccgagtacaccatggtgtgtccacgggtgagtctacaggagggcagatgagggcagggctgtctggctaaccaagtgtcactcagggaacacctgtcggatggaggtgtcaggtgtcagatgctgagcccatcgctggtcaaactgcgcagggtggggaagggtctggctctggccaggtgcagcacaggcatcctttcctacgagaggaaaaggaccactggatgaacagacacacctgtgaggcccagagctcactgctggcagaggtg

SEQ ID NO: 174691 - DNA, 601 bp, Human
ttttgccatgttggccaggctggtctcaaaaccctgacctcaagtgatccacccgcctcagcctcccaaagtgctgggattacaggcatgagccactgcgcctggcccagaaacatttctaattataatcaaatggaagagggatttctaattacgatcaaatggaagagggaacgaaaaggttagatgagaaatgggaatcagcctgggatcccaaacccaacagacccaggtcaactactgtggctcactgggactgccgtgagcagaggcgaggggtggagtcagctgatgggaaccrcaaatgctgttgataaccaacaaaaactatgcgaaatctcatttcttgtggcgaaagtctgtagcctctccgaccccaattaagccccaaagagagaaatctcatctctcgtggtgagcacatctttatcagaaagtctggggcctctctgacacctattaagccccaaagccacggtgtggcaggtgcattctgggagcaccctgccctcagccctggacagctgggaaggtgggccgcagagtgcactgggtgggtacaggcttgggagtcagacagacccaatgacagctctagcac

SEQ ID NO: 174692 - DNA, 601 bp, Human
aatttctgtatttttagtagagatggggttttgccatgttggccaggctggtctcaaaaccctgacctcaagtgatccacccgcctcagcctcccaaagtgctgggattacaggcatgagccactgcgcctggcccagaaacatttctaattataatcaaatggaagagggatttctaattacgatcaaatggaagagggaacgaaaaggttagatgagaaatgggaatcagcctgggatcccaaacccaacagacccaggtcaactactgtggctcactgggactgccgtgagcagaggygaggggtggagtcagctgatgggaaccacaaatgctgttgataaccaacaaaaactatgcgaaatctcatttcttgtggcgaaagtctgtagcctctccgaccccaattaagccccaaagagagaaatctcatctctcgtggtgagcacatctttatcagaaagtctggggcctctctgacacctattaagccccaaagccacggtgtggcaggtgcattctgggagcaccctgccctcagccctggacagctgggaaggtgggccgcagagtgcactgggtgggtacaggcttgggagt

SEQ ID NO: 174693 - DNA, 601 bp, Human
tcaaacgattctcctgcctcaacctcctgagtagctgggatcacaggtgtgcaccactgcacttggctaatttctgtatttttagtagagatggggttttgccatgttggccaggctggtctcaaaaccctgacctcaagtgatccacccgcctcagcctcccaaagtgctgggattacaggcatgagccactgcgcctggcccagaaacatttctaattataatcaaatggaagagggatttctaattacgatcaaatggaagagggaacgaaaaggttagatgagaaatgggaatcagyctgggatcccaaacccaacagacccaggtcaactactgtggctcactgggactgccgtgagcagaggcgaggggtggagtcagctgatgggaaccacaaatgctgttgataaccaacaaaaactatgcgaaatctcatttcttgtggcgaaagtctgtagcctctccgaccccaattaagccccaaagagagaaatctcatctctcgtggtgagcacatctttatcagaaagtctggggcctctctgacacctattaagccccaaagccacggtgtggcaggtgcattctgggagcaccc

SEQ ID NO: 174694 - DNA, 601 bp, Human
gaaaacagagatcctgatatgctaggtctgggtgggacctgatatttctgcctttctgacaagctctttggtgatgctgatgctggtccttggactactctgagggcagcaaggtgcagacactctgagctcaggtaagctgctcccagagagctggcctgactgatgggctgggcatggccacagagacggcaaacagggcacagggccaagcaccacttctcacagcacaacatgagctgaagcatggggatgtgcggggccctgaggggtaaggaggagccacagccagcacccggcytccctcagcaggaggccagcagagtgccagcagctgtgggcaaccttgcacagcccagagagcttttatttgaaaatgcaaagccctacttagatggtggatttatagctggctgaacatgcttaccctaaatggggcacctgctcactcatctctgcaggtcagcactgaggccagcacctgtgggcactggcaagtggctatgagcgggtaactctacctgtctggtaaggctgcctccgaggttcatggtgccagagccagatttgttggtctgcagccacagcatcaccgtggagg

SEQ ID NO: 174695 - DNA, 601 bp, Human
ctggaaccgagaacggaagggcatccttgcagaaagtggcgccccgctgaggctctcaaggctgtgccgtttctgccaataccgacttctccgaaggcaaagaggggtccttgtgaaacccagttgtgcttggtctatgctttctcttccccctttacgccaagcatcttgtggcactgcactggcacaggtttaaggccttctcttgggatgggaatgtaaagggtcctgaacatggacctttatacaaggttcttaaacccacccagatgcttatgggagcatctaaggtagaagggcrggcaagtttgctcaggggaggcagtaccttccagtccaagtccaagtttgccttagacagaacctgggaacaacatcgtggagaagggttgctagtgatacccaaacaaaagatggataagagagaggtatccagtagggcacttctgaaatttcaatgtgcacacattacctgggcaattttgtgaaaacagagatcctgatatgctaggtctgggtgggacctgatatttctgcctttctgacaagctctttggtgatgctgatgctggtccttggactactctgagggcagcaaggt

SEQ ID NO: 174696 - DNA, 601 bp, Human
gagagtcaggctgcaggggagctggctgcctgggggtttggctgtttctccctagccaatggcccctggaagataggagtccacttccacgcaaaaaggctaagtgccccccgtgtgcactagtgagtagtcctgggatgggactgtgacatccctgcccagaggccaaaaagaggaccgcaacatcccttctggcctccagcccctctgacacaggagaggcagtggagcttctataggtggagggagggtcccaggtatgacggctgacattcaccttgcgccactattttttcaatgmatgtagatgttgttgtaactagtagaatgcaaattcacttaaaagatttactacactgggccgggtgtggtggcttatgcctgtaatcccaacactttgggagaccgaggtgggcggatcacttgaggtcaggagttcaagaccagcctggccaacatggtgaaatcccatctctactaaaaatacaaaaaatgagctgggcgtggtggtgcacgcttgtaatcccagctactcgggaggctgaggcaggagaatcgctcgaacccgggaggcagagattgcagtgaaccgagatcacac

SEQ ID NO: 174697 - DNA, 601 bp, Human
gctgaggacaggcactcatcaggcctgggtttagcttggcaggagacactgctcacggcaagccggaaccagactctggccatgggctgacagctctgatttaaactattaggagggctgaggattaaatatttgtccaggtcactgtaaaccgggtggaattatcaacagcctggagtggtaagtgatacaggaagcagtctctggatacagattcaggattttccacccactccccaggtggcaggatgtgggagagtcaggctgcaggggagctggctgcctgggggtttggctgttyctccctagccaatggcccctggaagataggagtccacttccacgcaaaaaggctaagtgccccccgtgtgcactagtgagtagtcctgggatgggactgtgacatccctgcccagaggccaaaaagaggaccgcaacatcccttctggcctccagcccctctgacacaggagaggcagtggagcttctataggtggagggagggtcccaggtatgacggctgacattcaccttgcgccactattttttcaatgaatgtagatgttgttgtaactagtagaatgcaaattcacttaaaaga

SEQ ID NO: 174698 - DNA, 601 bp, Human
cacctcaaatgaatgatgtggtgatcggccgttagaatgatggcagagcattaatttcctcattaaagcccccagagcaaaaggcaacgcaaacaaagtccgaagccctggccaaggtgtgctgaggacaggcactcatcaggcctgggtttagcttggcaggagacactgctcacggcaagccggaaccagactctggccatgggctgacagctctgatttaaactattaggagggctgaggattaaatatttgtccaggtcactgtaaaccgggtggaattatcaacagcctggagtgktaagtgatacaggaagcagtctctggatacagattcaggattttccacccactccccaggtggcaggatgtgggagagtcaggctgcaggggagctggctgcctgggggtttggctgtttctccctagccaatggcccctggaagataggagtccacttccacgcaaaaaggctaagtgccccccgtgtgcactagtgagtagtcctgggatgggactgtgacatccctgcccagaggccaaaaagaggaccgcaacatcccttctggcctccagcccctctgacacaggagaggcagtg

SEQ ID NO: 174699 - DNA, 601 bp, Human
ggcttccagcaggagatcatcctgaaagacaaaggcacacctgcgggaggggcccagagggcagcgctgctcagcacacacctggggagccttgacgccgtgtgcggctctgcagggttgatcctgcttgcggggcctgcttgctcctgaggctacaggtccactgcagctgctcatgccggctgctgagacagagtcctgtctacactgagctgactgctccatgcacttccatctgactatttagcagtcaccgaatggcaggcacagaggacgaattaagaccaaaacagttgtggcrtggtagaaagtagcatatttttttctcaccaggcaaatctgggttcacatcccagctttgcttcttactggttaaattatatgggcaaattatttaagtttgaacttcagtttcctcacctgttaaatgagaataacttgaccttggttacaatctaatccaaggggacagcctgcaaaccatgcatgttcatgctcactgagctgctcacttctcccagaacccttcgcctcccatccaaacaagcacaggcgtttttccaaggctcctctgggacccgtagccaagctctgcaaccct

SEQ ID NO: 174700 - DNA, 601 bp, Human
tagtgaacacaccccagtggccaagtggcttccagcaggagatcatcctgaaagacaaaggcacacctgcgggaggggcccagagggcagcgctgctcagcacacacctggggagccttgacgccgtgtgcggctctgcagggttgatcctgcttgcggggcctgcttgctcctgaggctacaggtccactgcagctgctcatgccggctgctgagacagagtcctgtctacactgagctgactgctccatgcacttccatctgactatttagcagtcaccgaatggcaggcacagaggaygaattaagaccaaaacagttgtggcgtggtagaaagtagcatatttttttctcaccaggcaaatctgggttcacatcccagctttgcttcttactggttaaattatatgggcaaattatttaagtttgaacttcagtttcctcacctgttaaatgagaataacttgaccttggttacaatctaatccaaggggacagcctgcaaaccatgcatgttcatgctcactgagctgctcacttctcccagaacccttcgcctcccatccaaacaagcacaggcgtttttccaaggctcctctgg

SEQ ID NO: 174701 - DNA, 601 bp, Human
gaggaaaaacccaggcccaggttgctgtaaggactgtgtaaggaggaactcgagggaggggctctcatctgacccccacctcacatcttggtcgtccagcccctgaccacgccacgccagaatgccccccagcctgcccctcttcccctgcccttctgtttctgcccttgccacctcatgcctcagactgacactagcttcttcactgacctctctgctgcagggctgtcccctctgaccctcccagggctgcctgatccaggcccttgtcatctctctccttgatgactgtaacagcttycccctgaccacccatcccccaagcccactggcagagccaccttctgaaaacacagatccaatcagatcattggactccctagaaacctcaaagccctcctgacagcctctagtagtgaacacaccccagtggccaagtggcttccagcaggagatcatcctgaaagacaaaggcacacctgcgggaggggcccagagggcagcgctgctcagcacacacctggggagccttgacgccgtgtgcggctctgcagggttgatcctgcttgcggggcctgcttgctcctgaggctacaggtcc

SEQ ID NO: 174702 - DNA, 601 bp, Human
acgtccctgagaaacatcttttggtggttggaggtgggagaagtaaaagccgaaaatgatggaggcagggctaggtggaggcagcatcgcctggtctggctgtgttctggctggctggcaggccacgtgcccaggagagtggcgctctgccccggccactggcctaccaccagccgcctacactggggcacgagtgggcacagggcatagcctgatgtgcccacggaagggacccctgcgaggtgccagcaagccaaagctggcggccttctccagatgggccgtgggaaacaggaagacragggtgcgcccggggccacacacagggaagggcagctgccgctgctgccggggtgaggcaggctgggccacaggaccctgggaaagctgaggacccatggggccttgctgagggtgctgatgctggctgggatggctcttggggctagggcctggcactgtgggcctggggagacagctccaaaaccaagcagccttccttcctgacacacgtggggcaagggcatgtgagcgtgggtgacctggatgaggccaggtttccagaggaaaaacccaggcccaggttgctgtaaggactgtg

SEQ ID NO: 174703 - DNA, 601 bp, Human
ctcagccgcctcctgccagggatctccggtcccttcgtctcctgtttccgcccttcacagcacgggatggttgtggggagcctgtctcaggccagctttccttctcagccaggcactggtcactccaccccaggtcatctggcaaaaacccagccgccccttgaagctgcgctgctcaagcatctccacccctgaacccaggcaaccccacaggacacgaggagcgggtgtgcagctgcagccaggcctccccagcgagcgtgcactcctggaactgccaagctgggcccggcccaccctytgttccctgcatctggaagggcaatgggcttcttccctgtgacaaaaatatactgcctggcctaactgccaaacgcaagtcaaagaggatgttcctgctaggatacacaggcaagtgcctctactggggatttactgcctgaagatatattgggggtgtctctgctgagtggggagagactgctcactagccaatgacctgcctgatctccccactcaacaaaacattccaccttcatttctaaatatttagaagctgagaaaatatcaaacgaacatctgcagggcccttccccggatg

SEQ ID NO: 174704 - DNA, 601 bp, Human
aaagttcctgagctaggatctgaatcaaggtctgggtgattctgaaacctgcttccttttatgagatctctctgctggctcaatttcacatacatcctttaccagaaaactgaaggacaaaccacaatccagggctcagaaaacctgagcagggtccatccctgcctcagccgcctcctgccagggatctccggtcccttcgtctcctgtttccgcccttcacagcacgggatggttgtggggagcctgtctcaggccagctttccttctcagccaggcactggtcactccaccccaggtmatctggcaaaaacccagccgccccttgaagctgcgctgctcaagcatctccacccctgaacccaggcaaccccacaggacacgaggagcgggtgtgcagctgcagccaggcctccccagcgagcgtgcactcctggaactgccaagctgggcccggcccaccctctgttccctgcatctggaagggcaatgggcttcttccctgtgacaaaaatatactgcctggcctaactgccaaacgcaagtcaaagaggatgttcctgctaggatacacaggcaagtgcctctactggggatttac

SEQ ID NO: 174705 - DNA, 601 bp, Human
cgaactcctgacctcgtgatccacctgccttggcctcccaaagtgctgggattacaggcatgagccactgcacccgatctttccattttttttttttaataaaatttgtttattatgttttttagagacagggtcttgctctgctgcccaggctggaatgcaatggtgcaatcatagctcactataacctcaaactcctgggctcaagtgatcctcccatctcagactcccaagaagctaggaccacagatgccaccctacccagataactttttgttttgttgggaggggtgaaggggtrgggggcagtgcaactgttgcccaggttggtcttgaacccctggccaaacaatcttcttgcctcagcctctcaaagtgctggaactattatctttcaaaatgggcattatcaacactgagtttcaaagaggtggaggtctgtctaggtcacacagctggaaagttcctgagctaggatctgaatcaaggtctgggtgattctgaaacctgcttccttttatgagatctctctgctggctcaatttcacatacatcctttaccagaaaactgaaggacaaaccacaatccagggctcagaaa

SEQ ID NO: 174706 - DNA, 601 bp, Human
ttcctttttttttttttgagatggagtcttgctctgtcgcccaggctggagtgcaatggcgcgatcttggctcactgcaacctctgcctcccgggttcaagtgattctcctgcctcagcctcctgagtagctgagattacaggtgcatgccaccacacccagctaatttttgtatttttagtacagatggggtttcaccgtgttggtcaggctgatctcgaactcctgacctcgtgatccacctgccttggcctcccaaagtgctgggattacaggcatgagccactgcacccgatctttscattttttttttttaataaaatttgtttattatgttttttagagacagggtcttgctctgctgcccaggctggaatgcaatggtgcaatcatagctcactataacctcaaactcctgggctcaagtgatcctcccatctcagactcccaagaagctaggaccacagatgccaccctacccagataactttttgttttgttgggaggggtgaaggggtagggggcagtgcaactgttgcccaggttggtcttgaacccctggccaaacaatcttcttgcctcagcctctcaaagtgctgga

SEQ ID NO: 174707 - DNA, 601 bp, Human
ctttcccccagaggggatgtattacacctcccactgccacgtggcatcttctagcgcgacccgcagggcgtggccctaaggcatgggccccactcaccggcgctgaggccccgcagctcctgtgctgcagcccgagaggaaagggcctgggcttgtctaggcctccatgtctttgccttcacctcgcactaaataaacaaatgtacacaaaaggcctagagcgggacttgccagaatggcagctctcaccgattgtcaaagcacagctccatccccagcactcttctggcctctggcatcmtcctggtcaccacactgtgctgtgggttggaggtcaggacccggcgtgcagccaggccagaagatggtggtcagacggcttcccagggaaagttacggttgcccagtttaggaaaattttgaatctagaattgtacatattcaaaaagcctctccttgcaagatatatggtagtagcagtaaaagttattgtttttatttttatttttgagacagggtctggctgtgttgcccaggctggagcacagtgttgtcaccacggctcactgcaacctcggcctcccaggttcaggccatcctc

SEQ ID NO: 174708 - DNA, 601 bp, Human
gccggagcctggcccgtgtgtccccagcaggcgcctctcctcctccccatggccctaacacaggcaagtgtttggaagctggcagcctttcccccagaggggatgtattacacctcccactgccacgtggcatcttctagcgcgacccgcagggcgtggccctaaggcatgggccccactcaccggcgctgaggccccgcagctcctgtgctgcagcccgagaggaaagggcctgggcttgtctaggcctccatgtctttgccttcacctcgcactaaataaacaaatgtacacaaaaggcctagagcgggacttgccagaatggcagctctcaccgattgtcaaagcacagctccatccccagcactcttctggcctctggcatcctcctggtcaccacactgtgctgtgggttggaggtcaggacccggcgtgcagccaggccagaagatggtggtcagacggcttcccagggaaagttacggttgcccagtttaggaaaattttgaatctagaattgtacatattcaaaaagcctctccttgcaagatatatggtagtagcagtaaaagttattgtttttatttttatttttgagaca

SEQ ID NO: 174709 - DNA, 601 bp, Human
gctctggcaagtcatcctgaggaatctcgaccctcagaccccagggggtctccataaaacaggagtagtgagagtgcccatgagcttgagagtcacagttctcatttcaggtctaataaacacaccaacctcggcagcactggagcgtctgctggaacatcatctttatctgccactagcaaaaccctggtgccaagacgacggggtgggctgtctgctcaacaggagctggggagcaccctcaggagggagggggctccatccacccagcttcaaaaagaacttttgcatgctggccccyggggactgtgtgttctcccagacgtgaaggtggttactgtgcctaggctcagggctgggtggagtcagctcggcaggcagggaagcctgggggttggatggaaatgaatgaggtccttccagcaaatcagagtctctcctcctccccggctccatgtggacggcagattcccggccaccctagggaagggatgagggttttgagctcactgtgggccccattttaaatgggcaccaacagcccaaagagaggccgcggccatcggcaaaggtcctgggtcacctgggcaagtccagtcac

SEQ ID NO: 174710 - DNA, 601 bp, Human
ggggggtctaggtgagggcaacagtccagaacctgctgcctcccaagtcataacagtaaatatctgcagaaaaaagacatctggttctggcaaggctgttttactgaggactagtggaaaagagggagagaaatgctagaaagaccggcttctctgctcccatctgtcttggcatgctctggcaagtcatcctgaggaatctcgaccctcagaccccagggggtctccataaaacaggagtagtgagagtgcccatgagcttgagagtcacagttctcatttcaggtctaataaacacacyaacctcggcagcactggagcgtctgctggaacatcatctttatctgccactagcaaaaccctggtgccaagacgacggggtgggctgtctgctcaacaggagctggggagcaccctcaggagggagggggctccatccacccagcttcaaaaagaacttttgcatgctggcccccggggactgtgtgttctcccagacgtgaaggtggttactgtgcctaggctcagggctgggtggagtcagctcggcaggcagggaagcctgggggttggatggaaatgaatgaggtccttccagcaa

SEQ ID NO: 174711 - DNA, 601 bp, Human
gctggcaacaccgacccaccaaaaatagaaccatttgtgcactgcatacattatgtggcaccctgtagcagtctctgcctgcccttggtcaacttgtttgtccaggacttaagtaaaggcccagctgagagaacgaccagcttcctatcgacagtgtcaagggttgagatggtcacagggttaatacggaacccggaaacctgggctagctacagaacgagagcagcaacttggaatggagccaggcggcagccacctttttccatctcagcttcctaggaaccctgttttaaacccaagraaaccgaagcttaaagaagcaagaatcatacagcactgttagattccgacgcctttgctcctcctacttcaccacgccagttaaatgtaccagggcaaatgcaagccagatatttaggctcaagggtgcatttcatgcagtacaaaatggggaactgctgacttgcaaacagttcctatgaagagacttgtggtttttagataatttcaagtttgacaaggatgagatgtcgctactaggaaagcttttgtgcaactttaaggtgcacagatgacactattccttgtgcccagataaggg

SEQ ID NO: 174712 - DNA, 601 bp, Human
aactacttaaatagggtcgcatccttctggcaagttcccatctaccatcctgcacctgtggctgagaggaagggcaggatggagcctctgccgataggggtagggacctggccacatttccacagccccccacccactcccctccacacctggtcagggtcagctcgctggcaacaccgacccaccaaaaatagaaccatttgtgcactgcatacattatgtggcaccctgtagcagtctctgcctgcccttggtcaacttgtttgtccaggacttaagtaaaggcccagctgagagaacraccagcttcctatcgacagtgtcaagggttgagatggtcacagggttaatacggaacccggaaacctgggctagctacagaacgagagcagcaacttggaatggagccaggcggcagccacctttttccatctcagcttcctaggaaccctgttttaaacccaaggaaaccgaagcttaaagaagcaagaatcatacagcactgttagattccgacgcctttgctcctcctacttcaccacgccagttaaatgtaccagggcaaatgcaagccagatatttaggctcaagggtgcatttc

SEQ ID NO: 174713 - DNA, 601 bp, Human
ccagccaggctcactgtgaacaagccctgcacgagagcacttcttttcctgttttggtggggatgctgggctggaagaaaacacaactacttaaatagggtcgcatccttctggcaagttcccatctaccatcctgcacctgtggctgagaggaagggcaggatggagcctctgccgataggggtagggacctggccacatttccacagccccccacccactcccctccacacctggtcagggtcagctcgctggcaacaccgacccaccaaaaatagaaccatttgtgcactgcatacaytatgtggcaccctgtagcagtctctgcctgcccttggtcaacttgtttgtccaggacttaagtaaaggcccagctgagagaacgaccagcttcctatcgacagtgtcaagggttgagatggtcacagggttaatacggaacccggaaacctgggctagctacagaacgagagcagcaacttggaatggagccaggcggcagccacctttttccatctcagcttcctaggaaccctgttttaaacccaaggaaaccgaagcttaaagaagcaagaatcatacagcactgttagattccgac

SEQ ID NO: 174714 - DNA, 601 bp, Human
ggtgagcagagggcaggagagaaccaagccactttaaacgaccaggcttccagggtcgggcaaaaccgacctgtgattgaaatccttgacactgggggcggcagcactgacccgacttttgtcttttttttttttttttttttttgagacggagtttcgctcttgtcgcccaggctggagtgcaatggtgcaatcttggctcactgcaacctctgcctcctgggttcaagtgattctcctgcctcagcctccccagtagctgggattacaggtgcccaccaccacgtccggcttttttttwtttttatttttattttttatttttagtagagacagggttttgccatgttggccaggctggtcttgaacttctgacctcaggtgatccacctgcctcagcctcccgaagtgctgggattacaagtatgagccactgcacctggccgacccaacttttgtcaaaaaaggaagaatggcctctgcaaggaaacgctagctcgaaactgatccagacaacaatttttgatgggatcgttaaaatcatctgctggcacattttaaactcagagatcatgaggagccagccaggctcactgtgaac

SEQ ID NO: 174715 - DNA, 601 bp, Human
tctttggaaccaggagaacagggtggagtctggggggagatactgtctcagagggtacgggctctgttgcttctcacctatttctacatctcctcatcagggagactgactttcaggctgtgaaaggtggaaccaacctggttaagagcggggtgagcagagggcaggagagaaccaagccactttaaacgaccaggcttccagggtcgggcaaaaccgacctgtgattgaaatccttgacactgggggcggcagcactgacccgacttttgtcttttttttttttttttttttttgagayggagtttcgctcttgtcgcccaggctggagtgcaatggtgcaatcttggctcactgcaacctctgcctcctgggttcaagtgattctcctgcctcagcctccccagtagctgggattacaggtgcccaccaccacgtccggcttttttttatttttatttttattttttatttttagtagagacagggttttgccatgttggccaggctggtcttgaacttctgacctcaggtgatccacctgcctcagcctcccgaagtgctgggattacaagtatgagccactgcacctggccgaccc

SEQ ID NO: 174716 - DNA, 601 bp, Human
aaaaaccagcaaaaggtgggttcctctctttggaaccaggagaacagggtggagtctggggggagatactgtctcagagggtacgggctctgttgcttctcacctatttctacatctcctcatcagggagactgactttcaggctgtgaaaggtggaaccaacctggttaagagcggggtgagcagagggcaggagagaaccaagccactttaaacgaccaggcttccagggtcgggcaaaaccgacctgtgattgaaatccttgacactgggggcggcagcactgacccgacttttgtcttttttttttttttttttttttgagacggagtttcgctcttgtcgcccaggctggagtgcaatggtgcaatcttggctcactgcaacctctgcctcctgggttcaagtgattctcctgcctcagcctccccagtagctgggattacaggtgcccaccaccacgtccggcttttttttatttttatttttattttttatttttagtagagacagggttttgccatgttggccaggctggtcttgaacttctgacctcaggtgatccacctgcctcagcctcccgaagtgctgggattacaag

SEQ ID NO: 174717 - DNA, 601 bp, Human
aagctgaaataaataatcaagaaagaggaagaaaagaacagcatcagaaagggtagagtagaaaccatgcaagaagtggccatcaaattataatacaaaaatgcagtactctaaggctaagcatttattgttgagattctaaatctgcttagacattatttataatttttgaagctttattaaaataaaataaaatttgtgagagaagctaaaaaaaaaaaaaaaaaaaaaaaaaagaaagggtagagttcaaaatgagaccaggcccacagaagaaaaaccagcaaaaggtgggttcctytctttggaaccaggagaacagggtggagtctggggggagatactgtctcagagggtacgggctctgttgcttctcacctatttctacatctcctcatcagggagactgactttcaggctgtgaaaggtggaaccaacctggttaagagcggggtgagcagagggcaggagagaaccaagccactttaaacgaccaggcttccagggtcgggcaaaaccgacctgtgattgaaatccttgacactgggggcggcagcactgacccgacttttgtcttttttttttttttttttttttgaga

SEQ ID NO: 174718 - DNA, 601 bp, Human
gctgggccatccaccccaggttcagggcctgacactgcaggggaagcttctgtgctgctgctgcgccctggcgctcccaaatggtggctttggggtgccatctgctgcagtctcgcagggagggacagacaacctctgacggagacttcaggccagagggattcagtggctcaccctagtcatgcaggtggcaatggcagagcctgggtcaaacccttcctcgcaccagggcctgttcgttctactctgcgaggagagtttgagcaagagagtctcaatatagactctgaggttatgaggkgggcagcagcactcaagccccatctcctcttcccaagcccaggaagagctggctctgacccaatcatctcaactcggaggagggaggaaatggaggcaggttagggtagaaggaattcggcactttcccccgaattttttcttatctgaagccttatttccctgacaagaatataaattctttcaggagagatgtgcctgcctcataacgcacagggtacctggaagagtgctaggaacataaatgctcaacgttactacactgaaaacaggaatacgcagctacgatgactaatgttgt

SEQ ID NO: 174719 - DNA, 601 bp, Human
tcactcggtttgtcttcaggcctctactggcaggcccaggcccacgctgggccatccaccccaggttcagggcctgacactgcaggggaagcttctgtgctgctgctgcgccctggcgctcccaaatggtggctttggggtgccatctgctgcagtctcgcagggagggacagacaacctctgacggagacttcaggccagagggattcagtggctcaccctagtcatgcaggtggcaatggcagagcctgggtcaaacccttcctcgcaccagggcctgttcgttctactctgcgaggaragtttgagcaagagagtctcaatatagactctgaggttatgaggggggcagcagcactcaagccccatctcctcttcccaagcccaggaagagctggctctgacccaatcatctcaactcggaggagggaggaaatggaggcaggttagggtagaaggaattcggcactttcccccgaattttttcttatctgaagccttatttccctgacaagaatataaattctttcaggagagatgtgcctgcctcataacgcacagggtacctggaagagtgctaggaacataaatgctcaacgtt

SEQ ID NO: 174720 - DNA, 601 bp, Human
ttactgcccccagctgggctctggcctcatgtcagaggcctgcctcctgctctgtccgccgtggacctggagggtccagagagcgcccggcttttgtttgggctgacactgcagagctgagggcacgaggtgggaaggatggtgcaggacactggccactggcagcagagccctggcagaggacgtcagagaggctggggccccctgagaacgcccaggctgagggccctgcctgcatgtggcgtcagggaggctgggggcctgagaaggcccggactgagggccctgcctgcacgttgcrctctgctgtctcggagagcaggccagccagaggcagccgggctgcccggaatgtggtgtcatggctcccctaggcccaggctggagggtggggagatttttgagcggggactgacaaactgcagggctgaggaggctccgggggcaagggcaccaatggctgttagggtgaacatgccccagaaaacaaatggtgcagatagggaccgacagctgctacggagagtgcagatgacacatcaggactttactttccaaaatcaacataatgatcatcccagaagaggggcactgcagccta

SEQ ID NO: 174721 - DNA, 601 bp, Human
gcagcggggaggcttatgtggcttctgggatccctgcaccagcatcagaggctcctctgaagcatgggggggtggacggcaggcagatccctgccctggggacagtcaggccggtgcacacaagtggctgctgctggagaggcagcatccgtcccttggcctgggcttcttcagaagcaaaagccaaaaaatcagccgtcttccccacacccagcctccacccagagtggaaagcacacacacgtgataggtgccgtgttacatggggccgaggctacacgggaatgtggctgtgcaccgrccgggagcacacgtgggggttagtggtggtttaaatggccgcggagcagcagccggaccggcagggtctcggcgggttggtgagtcctgttttagtggggagggtctcgcggctctcaggcagggtacctggatcggcttaattatcaggctggatgtagatctggcgctgggtcagcacttgagagagctccctctgcaactgcttaaacttttggttgtcagggatagcatcaatagatctacagagagtgttcaagatgagtggagtgggagggaagagaacgacgagaagccagga

SEQ ID NO: 174722 - DNA, 601 bp, Human
ctttccattagcgaaacctgtttaaaggaacagctgcagctcgttaggggcggaaggttatgctggttgtggccgagtcggcactgggcgtccaggcagctccagcagagcatctgggccagccagggtggagtccagccctgactctgccctccaaccccagagactcagagatcagagagtgaggtcaccccttccaagccagctagccctggacaggcaatgtgccgctgagcagcggggaggcttatgtggcttctgggatccctgcaccagcatcagaggctcctctgaagcatgkgggggtggacggcaggcagatccctgccctggggacagtcaggccggtgcacacaagtggctgctgctggagaggcagcatccgtcccttggcctgggcttcttcagaagcaaaagccaaaaaatcagccgtcttccccacacccagcctccacccagagtggaaagcacacacacgtgataggtgccgtgttacatggggccgaggctacacgggaatgtggctgtgcaccggccgggagcacacgtgggggttagtggtggtttaaatggccgcggagcagcagccggaccggcaggg

SEQ ID NO: 174723 - DNA, 601 bp, Human
atgcccccctagcaattctttaatcattttgtcaaatttacccaacatattggttaggcaaagacttcctaaatgtaggttttataacagtttagaagcagtggaaagagtgggtagagggctgctcaagaagagtgctacggagagtgcactcagccggactctcacgtttgattcacaccagccatgggaaggaagaatcagaaaaatcaatccccagaagcaaaaatgggcaaatggaagtgaagcagggcccaggagaagcaacagcacccagactgagttctggctaccgaatccytacaagtcacaggaagagccctcaaaatactcagcaggtgccataagacaagacctggaagcaagctgcatacaactgaaaaaactcccaggagaaacgcagacatttggttcatgctggggaaatacacgtttctgagtatcttcccaggactgtccctggctctgcggcggccaaaggcatcagcccccacggcccccaggctccaaatctcagccgattccccaggggcttcttgccaagctcacagcgggaggtcaacatggccagcgggagatgcggcgggcaaagcagcagcgc

SEQ ID NO: 174724 - DNA, 601 bp, Human
cgaagtcaaggcttaaaaaagaaaaaagctatcaacccaatttacagatgaggaaactgaggctcagaggaatgcccccctagcaattctttaatcattttgtcaaatttacccaacatattggttaggcaaagacttcctaaatgtaggttttataacagtttagaagcagtggaaagagtgggtagagggctgctcaagaagagtgctacggagagtgcactcagccggactctcacgtttgattcacaccagccatgggaaggaagaatcagaaaaatcaatccccagaagcaaaaakgggcaaatggaagtgaagcagggcccaggagaagcaacagcacccagactgagttctggctaccgaatccctacaagtcacaggaagagccctcaaaatactcagcaggtgccataagacaagacctggaagcaagctgcatacaactgaaaaaactcccaggagaaacgcagacatttggttcatgctggggaaatacacgtttctgagtatcttcccaggactgtccctggctctgcggcggccaaaggcatcagcccccacggcccccaggctccaaatctcagccgattccccagg

SEQ ID NO: 174725 - DNA, 601 bp, Human
gggagtgggtaagaaccagtgtctctgcgtgtctgagcacactgtgtttatggcccacgcagcaggtgctttcaggcctctgctgtgaggcaccatccgctgttaacttggcccagaaaacccctcagcccggattgcaaagggcggcacaggacagccaagtgcccctgggatccctgctgtcaaattctggatttgtggggaaacgttcagggcgaccgcattcacgtatgtgtggggacgctcatcaacaaagccagaaacaatgaaggcttatggagatttcacagtttacaaaacrcctttcacatatattatctcatttaattttcacgggcatcctggggaagtctcaactatcaacccggccggatgtggtggctcaagcctgtaatcccagcactttgggaggccaaggcaggaggatcatttaaggccaggagttcaagaccagcctgggcaacatagtgagaccccatctctacaacgacaacaacaaaaagcgaagtcaaggcttaaaaaagaaaaaagctatcaacccaatttacagatgaggaaactgaggctcagaggaatgcccccctagcaattctttaatcat

SEQ ID NO: 174726 - DNA, 601 bp, Human
agcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctgtgaggcaccatccgctgttaacttggcccagaaaacccctcagcccggattgcaaagggcggcacaggacagccaagtgcccctgggatccctgctgtcaaattctggatttgtggggaaacgttcagggcgaccgcattcacgtatgtgtggggacgctcatcarcaaagccagaaacaatgaaggcttatggagatttcacagtttacaaaacgcctttcacatatattatctcatttaattttcacgggcatcctggggaagtctcaactatcaacccggccggatgtggtggctcaagcctgtaatcccagcactttgggaggccaaggcaggaggatcatttaaggccaggagttcaagaccagcctgggcaacatagtgagaccccatctctacaacgacaacaacaaaaagcgaagtcaaggcttaaaaaagaaaaaagctatcaacccaatttacaga

SEQ ID NO: 174727 - DNA, 601 bp, Human
aacagctaccctgggttgctggctggggactcaggccaggggctaagaggggaggactccggggccatgcgggttcctctataaaagcttctcccttgcccaggccctgcccagcagaagagcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctgtgaggcaccatccgctgttaacttggcccagaaaacccctcagccyggattgcaaagggcggcacaggacagccaagtgcccctgggatccctgctgtcaaattctggatttgtggggaaacgttcagggcgaccgcattcacgtatgtgtggggacgctcatcaacaaagccagaaacaatgaaggcttatggagatttcacagtttacaaaacgcctttcacatatattatctcatttaattttcacgggcatcctggggaagtctcaactatcaacccggccggatgtggtggctcaagcctgtaatcccagcactttgggaggccaaggcaggaggatcatt

SEQ ID NO: 174728 - DNA, 601 bp, Human
ctgcaccctctgcaccttgccaggccctgtgggggtggcatatggcttacatggacaggtgctcatctctgcccctggccaccggtgacccggccatagtccctagaaccctaagttcactcctctgtgtgtaggtccctatgtcaccctaagccacaaggtggcttctgggcttccaaacacaatggaacaaagcccctctgcttcagaacagctaccctgggttgctggctggggactcaggccaggggctaagaggggaggactccggggccatgcgggttcctctataaaagcttcycccttgcccaggccctgcccagcagaagagcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctgtgaggcaccatccgctgttaacttggcccagaaaacccctcagcccggattgcaaagggcggcacaggacagccaagtgcccctgggatccctgctgtcaaattctggatttgtggggaaacgttcagggcgaccgc

SEQ ID NO: 174729 - DNA, 601 bp, Human
cggtggaggcctgggggccaccatgccagtgcctggctgatttgctgcatggacccgcttcctggggtgaggctctgggtcactgggctgggcatctgcccctctcagaaaggggcaaaggggtacatggccgagacctgcaccctctgcaccttgccaggccctgtgggggtggcatatggcttacatggacaggtgctcatctctgcccctggccaccggtgacccggccatagtccctagaaccctaagttcactcctctgtgtgtaggtccctatgtcaccctaagccacaaggtgrcttctgggcttccaaacacaatggaacaaagcccctctgcttcagaacagctaccctgggttgctggctggggactcaggccaggggctaagaggggaggactccggggccatgcgggttcctctataaaagcttctcccttgcccaggccctgcccagcagaagagcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctg

SEQ ID NO: 174730 - DNA, 601 bp, Human
cagggcaggccaagggaggctactggccaagacagagggaatgcactggaagcagaaatgcttcttgggaaagtgggttttggagaaaagccaagagctggggagacagggggaagccctggaggtgggaggcatgagccccaggtctaggtccagctcttgcatgacttgctgtgtgaccccgggcaaagtccttgagctctctgggctctgtctcatcctctgggaaatgggggagctgcttcttcctcaagctccccaggggtgtagatgaggccagtggtggcctgtgtctaccacytcacctcactgaatcctgagagtcctgggaaggccaagcccacctgtctcacaagtagcaagctgcttcatgccgtgccttgtagttagggcatctggccccaggccagaaaggacttggaaagatgaagtgtgggaggacagtgaggcagaatgtgtgtcctatcccagccatggggaaactgaggccaagagctcatgggctctaaaaaaataatgggctctaaaaacaacctcactagctagaggcctcatttctagcatctcctgctcactcagtttctaagaatttaatgaacaa

SEQ ID NO: 174731 - DNA, 601 bp, Human
gggagaagagaccttgatatgtgggagaccctgcacaaggcgcttctcttttctaggcctgaaagctcccttctagctgcgacttctgttttaccatttaaagcctgaagattttgttgggtagctagaggggcggtgggtgatgggaactgtagggactggcaagggcagattcccaagcgtgggaggggagggcctacagggacaaggaacagggccaggtaagaggtgcttttctgtgccagaggctacagcaggcattacagaaggatgtcatgtagccctttgctgtggcatcatwcccatttgacagataggaaagttgaggctaagagaggaaggtgacttgtctagagtctccatgtcatagaactaggccttctgaacctcagtggctggctctttttgtgacactaagactgtcatgatccaggggtttgggcatggactgggtgcctcatgagggaaggacaggaagggacagtggaaggggtgggggcatgcccgtggctctccctccatgactgtctgcaccaggactcactagagggcagaggagagaagagatttctgaccatgggcataggcagggctggcaggc

SEQ ID NO: 174732 - DNA, 601 bp, Human
ctcaccttgtccagtccacaagtcagtgtcacccccagcagtcaggttacactgactgaggccacactgcagggctacagccgctccacactggggaggaggtgggggaaatcctgggcaggagagagggcagatcctgctcacatgacagggacaggagcatgacccaggtgtgtctgaacttagcggacacaggaagaaagggagttggaagcaagtttctgtggggagcaggaggaggttgcctggtgttccttcggaggaagctttttggggtccattcctggagtgtatggctcayagccagtcccagtgtgcccccacccccagacctcattggcctaagtagctggagtaggtgacaggcagcccagggccctccacgatgtgggggacagcttgatgccttggaacaaggtgccaagaaaccagagagccagccagatgccaaagggccctgccatgtgccggtgccctttccctctccatttgcccagccacacagtgggctggggttgcacgtgtgtttgctgacaggccacatctctaactgtgggccatgtggaccttaggcctgaccagaccctcatgtcatcctcct

SEQ ID NO: 174733 - DNA, 601 bp, Human
ctttagaatttcctaggtgggggcctgggaaccaacaggggctcaaggaaccaaggtgtccccacagtgagtggcactgtcaggtctaggatgggggtctcgggacccctggtcctggttctttccactgaattcagacacttgtatttgcctaagtatgagcaaaccacatacacatgtgcccatgtggccagggagaccagtgcgctgaagctgaggcccagagtacacctggcctgtgtcctgagtgttcacacacccaccaagcatccaggggcaactcctggtgcctcagccatcrggggctgtcccttccctgaggcccaggcccctccatctccctccaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtgaatgggcggcctgggacccctccgggaacagcctcgcctgccagcagccactgaccccgcccccacccatctgtaggtactggcatggggacgacctgccgtttgat

SEQ ID NO: 174734 - DNA, 601 bp, Human
aaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttraccccagccttccagtcaaggttcccaccagtttgggacacctgcaagtgtcacatcccactgggtgaaactctaagatcccttttagaggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttc

SEQ ID NO: 174735 - DNA, 601 bp, Human
ccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtkagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttgaccccagccttccagtcaaggttcccaccagtttgggacacctgcaagtgtcacatcccactgggtgaaactctaagatcccttttagaggatcccattcgctccctccctt

SEQ ID NO: 174736 - DNA, 601 bp, Human
ggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccrtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgag

SEQ ID NO: 174737 - DNA, 601 bp, Human
agtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaycttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttca

SEQ ID NO: 174738 - DNA, 601 bp, Human
ctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaagkttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagttt

SEQ ID NO: 174739 - DNA, 601 bp, Human
tttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcrtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcag

SEQ ID NO: 174740 - DNA, 601 bp, Human
cccctgggctcagttccagtcctggctgtaagactgggaaagccactgcttgagtcaggacctcagtggctatttttgtccgtgagaagtcctctacaccacgacttgggaggcagcctgggagaaagagaaattagtcgtggctcctttaaggggtccgcggaggcgcgcccggccttttgtttgagcggcggcgcgcgcgtcagcgtcaacgccagcgcctgcgcactgagggcggcctggtcgtcgtctgcggcggcggcggcggctgaggagcccggctgaggcgccagtacccggyccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtagcccggggcgcgttctcgccctccccgggctcggccccgcgggagccccggggcgggcccatgcgccgagagcgcgcgtctccattca

SEQ ID NO: 174741 - DNA, 601 bp, Human
tacccagtgcctccatgcgccatctgtggagctgtcttgggaaggcatctgcatttactaagagtgtgtgtcactgttctgccattaacagacagctgtatttaccaagccggagtcatggagctttgaggaccctaacagatccccaagtccagcaccttgattttatattcaggaaacctgggtcccaagagggtgaaggctggttcagaggaaagccaggaaggcaagcccagtttcctaagttctgaaggggctttggggggcatctaggagactcagagccctgcagggcctgcarggtagtcataggggggagtattgtcaatttcttttaaaaaacctaatggaaactctacatttaccatgatactggatgatactgacacacaagccaaataacatagaggggtctgtgccctctatgtggaaagcgagtgacttgctgtgtctgctcttctctcagcgttcagtagccctggttgttgattacagtcactgctgaaaatggagaaacattttatttaatactatgcctgggtctcacacctataatcctagcactttgggaggcccaggcaggagaatcacttgaacccag

SEQ ID NO: 174742 - DNA, 601 bp, Human
ccgtgggtgtgtcgccataatcatcttccatgcagcccaagtggcgggtggtggtcccagctcccactcccctctggggctttcactgcttgcttcctggagcacatccatcccatagcacttcatcctggcagccagtgtgctagagcccatgtgcatgtccctgctcctggtggcctgcgtgtgcctggggcttgctaggtacactagtgaaactagtgggctttgggtcacggcagctctgtgcagggtgaaagggtgctcttcagacactctgggggctctgtgggagacactcccwtggagacatttgggtgtggacacagcatgtccttgggcaggtggcaaaactgcttcccacgtgacaatggcgccttgtagagagctgccctgggcctgggtgtgtctgtgagcatgtgcgcgatgcttcgtagtctgccctgtttgtttgtgtctgtaggtgctgctgtggttttgtccactgcgggaaagtagtggttcttttaatgcaggagccggagcttctttttgatctgctgctatgacatttccactcacttgcttaaaacagtttcctttttgttccccctcctcccctagc

SEQ ID NO: 174743 - DNA, 601 bp, Human
tggctttggctggctccacactactcagtcagcccaataaggggacttatggcaccctccccatcctgtcatcggacaatttgagcagaggctgggtgccctctctcagggatgctgggattgcaatggaaggaaggttgtttttctttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctygcccggctaattttttgtatttttagtagagacggggtttcaccgtgttagccaggatggtcttgatctcctgacctcgtgatccgcccgcctcggcctcccaaagtgctgggattacaggcgtgagccaccgggcccggcctgtttttttttattattattattttttttgagacggagtttcgctctgtcgcccaggctggagtgcagtggcgccatcttggctcactgcaagctccgcctcccaggttcacaccattctcctgcctcagcctcccgagtagctggaactacaggtgt

SEQ ID NO: 174744 - DNA, 601 bp, Human
tagtagagacggggtttcaccatgttggccaggctggtctcgaactcctgacctcaggtgatccgtccgcctcggcctcccaaagtgtcggggttacaggtgtgaaccaccacacctggccagaaggttgaattttatggcttagatttgcagattctgtgtatggctgagcatgttactcacattcactgtgtctagtgacacttgcattgtccacttgagttgatagctagacctggaaatgagaacttgctactgagatagggcaggatgagggggcaggggctcagcccaggctcttacgtatccagtcagaaaagaggaggtggtcaagatctgtggtttgcaaatacaggctcagctgcctggaaatcacccgtggaagctgcaaagaacacatcttcttgggcccttcctcagaggtgggaagtcactccacctgggtggggctcaggaatgtgcttcttaaaattttgcattctgggtttgggtgttgtagctcacacctgtactctcagcactttgggaggccaaggtgggaggattgcttgagcccaggagtttgagaccagcctgggcaacatagtgagaccccaccatc

SEQ ID NO: 174745 - DNA, 601 bp, Human
atatgagctgacagtcacaggttttggggattaagttgtagatgtcttcggggtctgttttttacctctgtggcccagacttcctcagctgccctcaccccctcagcctcatgctgcctgaagacctctccatctcggcgcgtggagatccagccctctccttgctcaggctgtaggtttctttcccaaggcctgccttttcctcacacagcaagtccagtctctccaggttctcccctgggactgcctcagacagccccccactgctctccctggggtctctagcagcccctacctcccytccctgctgccttctcagctctgcagctggtgtggcctctgctccaggcagatcatgtcacctctccacgcagaatcctccaggctccccatcaccctcggagcagaagcaggagttctcactggggtgccaggcccaacctggcctggtgctgccaccgctgcactctgccccactcaccctgcctcaggcctgagaacgtcctcattgctgtcagacctcccagagctcctgccctgcagttgcctctgctgaggtttagccccgttctccctcctcccctctttcctttcctccttc

SEQ ID NO: 174746 - DNA, 601 bp, Human
ctgcagcatccctgcccctttccctgtctgtttcccagcgcattcatgcctggcactcagctcacttttctctgtcttccatctacctcccaaggtcactgggggcctttcgcagccctctccatgctcccagacgcccttaggtgtcctgtgtcctccagctccatttcaccaacctgcctgccggactcttccctctttatcttcccaaagtactccattgcttggaatcctcctgggactccctcagggcagtggccagtttgcatagcctgagggaagaactgtgggtgcttcgacrcccgctagctttgcagcatccctgaccactgctcctcacggaatctgtgctctgtggtctgtttgtacgtcctcagcagttcctccattcacctgccttggccttgctagaatatttcctcttctggaaatgcccttctcctttcccatagccttccatgaaagtcctgccaaatttcaggcttaaatatcccttcacaggatgtctgggtgttgttccaacactgcccaggtcgattctattgcagacagactggtgcttgttatttatggccccaactgtccccattagaccgtggcc

SEQ ID NO: 174747 - DNA, 601 bp, Human
ccgctagctttgcagcatccctgaccactgctcctcacggaatctgtgctctgtggtctgtttgtacgtcctcagcagttcctccattcacctgccttggccttgctagaatatttcctcttctggaaatgcccttctcctttcccatagccttccatgaaagtcctgccaaatttcaggcttaaatatcccttcacaggatgtctgggtgttgttccaacactgcccaggtcgattctattgcagacagactggtgcttgttatttatggccccaactgtccccattagaccgtggcccygggacccctgctagcctcgtctgctgcctcagctgttagctgacaagcggccatcttccccagatgggtttgcagaggcctgctgtgcagagagagaggctgaaaatttgcatacctagggctccggccccctcgctgactgttgcttccatttcactttcagctttgatgaccatgacccagctgtgatccatgagaacgcatctcagcccgaggtgctggtccccatccggctggacatggagatcgatgggcagaagctgcgagacgccttcacctggaacatgaatggtacaaggc

SEQ ID NO: 174748 - DNA, 601 bp, Human
tgctcacaccagtgccaggcctgagtccaaaggcctctgctcagccctgagaagaaggcctgagagccatgtgccgggtgcttgtcccgtaggtcccacaggtcagctggtgaggggggacgccagtgggaggagacatgggtgagggaggacactggcaagagactccgggaggttgtattgagtgtagatggggacaggtacagttcactggtcatgccccagaacagggacaggacagcccatggggaccaggccaccagtgctgcacaatgcctgttatctctgccaagctccccgyttatctctgctggcccacatcatagttatttgttaattcttttctctccctctccatttcaaccctttaaggtcaggggccttgtttttcattgccgtttttcttcttttttttgagatggagtttcactcttgttgcccaggctggtgtgcaatggcgtgatctcagctcaccacaacttccgcctcccaggttcaagtgattctcctgcctcagcctcccgagtagctgggattacaggcatgcgccaccatgcctggctaattttgtatttttagtggagacgggatttcaccatat

SEQ ID NO: 174749 - DNA, 601 bp, Human
gacactggcaagagactccgggaggttgtattgagtgtagatggggacaggtacagttcactggtcatgccccagaacagggacaggacagcccatggggaccaggccaccagtgctgcacaatgcctgttatctctgccaagctccccgtttatctctgctggcccacatcatagttatttgttaattcttttctctccctctccatttcaaccctttaaggtcaggggccttgtttttcattgccgtttttcttcttttttttgagatggagtttcactcttgttgcccaggctggtgwgcaatggcgtgatctcagctcaccacaacttccgcctcccaggttcaagtgattctcctgcctcagcctcccgagtagctgggattacaggcatgcgccaccatgcctggctaattttgtatttttagtggagacgggatttcaccatattggtcaagctggtctcaaactcctgacctcaggtgatccgcccgccttggcctcccaaagtgctgggattacaggcgtgagccaccgcgcccggctgctgtttctcttaacatagaatctagcccagcataggaacttagtgttccaatt

SEQ ID NO: 174750 - DNA, 601 bp, Human
ggtgtgcaatggcgtgatctcagctcaccacaacttccgcctcccaggttcaagtgattctcctgcctcagcctcccgagtagctgggattacaggcatgcgccaccatgcctggctaattttgtatttttagtggagacgggatttcaccatattggtcaagctggtctcaaactcctgacctcaggtgatccgcccgccttggcctcccaaagtgctgggattacaggcgtgagccaccgcgcccggctgctgtttctcttaacatagaatctagcccagcataggaacttagtgttcmaattggatcagtccatgctctgtctcgttacctttctttgggcaacacatagaaagttctggtttgtttatacccccgccctgttccagaaaggatgcaaggaagcttaccataagtacactgggcccaaatgactaaagcaaatgaaaacggagtggttaggaaaaactggataaagaggaaatgttcaagttgaagagggagctcgtactcagcttttatttggtgaacgttgctgggagttgggcgtggctctgggcctttttagaaccaggcagaatgagacgtgaaaatcatttg

SEQ ID NO: 174751 - DNA, 601 bp, Human
tgagccaccgcgcccggctgctgtttctcttaacatagaatctagcccagcataggaacttagtgttccaattggatcagtccatgctctgtctcgttacctttctttgggcaacacatagaaagttctggtttgtttatacccccgccctgttccagaaaggatgcaaggaagcttaccataagtacactgggcccaaatgactaaagcaaatgaaaacggagtggttaggaaaaactggataaagaggaaatgttcaagttgaagagggagctcgtactcagcttttatttggtgaacrttgctgggagttgggcgtggctctgggcctttttagaaccaggcagaatgagacgtgaaaatcatttgcatactcagtgtggtcaaggttagcagcagcctgtggctctgaagaagtagaatcacacgtggtcctggaatctgagatttcctacagccctcaggaagagggcacagtatagtaaggaagaccaggatcgtccatgaactccacagtgagtttcactgggctgttcctcctaggagttctaatgtaaaatatgatgcccactgaaagtaatttagaacaaagtcttaacca

SEQ ID NO: 174752 - DNA, 601 bp, Human
tctgaaaaggacttgaagtagtgcttctctgaatcactggtgatgtatggtgtcacctggcttaacagcctgctgagggagggaagtattaaaatcctccagaaaagatgagttgcctaaccagaacacatgtggacatagatgccatcttcacccagaaggggaacaaggggatcccctcaggaagagttttggaatctgtcttggcacacaggcaaaggagtgattagggccctgagtgtctacacttggctacagaaggcaagtttttagagatttatatccacatgcttgttttggkctctaaaaaagttaaatgaggctgagcacagttgctcacgcctgaggctgaggtgggcagatcactttaccccgggagttcaagaccagcctgggtgtcacggtgaaaccccatttctacaaaaattcaccagatgtggtagcacgtgcctgtgatctcagctacttgggaggctgaggtgggaggatagcttgagcccgggaggttgaggcttcagtgagccgtgattgagccactgcactccagcctgggcaacagagtgagaccctgtctcaaaaactttttttttaaagttaaaaa

SEQ ID NO: 174753 - DNA, 601 bp, Human
atccacatgcttgttttgggctctaaaaaagttaaatgaggctgagcacagttgctcacgcctgaggctgaggtgggcagatcactttaccccgggagttcaagaccagcctgggtgtcacggtgaaaccccatttctacaaaaattcaccagatgtggtagcacgtgcctgtgatctcagctacttgggaggctgaggtgggaggatagcttgagcccgggaggttgaggcttcagtgagccgtgattgagccactgcactccagcctgggcaacagagtgagaccctgtctcaaaaacwttttttttaaagttaaaaaaaaaaatcaaatgatagattcaggaagccaagtgaagcccaacatgattaacccaaagcaatccatgccaagacacatcataattaaacttctggaaactcaacacaaagaaaaaaatcttgagagcaatcagagaaaaaggacaacttacctgtagggaaaagacaataagaatggtggtagatttctttttttttcttttttttttttttgagatggagtcttgctctgtcgcccaggctggagtgcagtggcatgatctcggctcactgcaagctccg

SEQ ID NO: 174754 - DNA, 601 bp, Human
cgggaggttgaggcttcagtgagccgtgattgagccactgcactccagcctgggcaacagagtgagaccctgtctcaaaaactttttttttaaagttaaaaaaaaaaatcaaatgatagattcaggaagccaagtgaagcccaacatgattaacccaaagcaatccatgccaagacacatcataattaaacttctggaaactcaacacaaagaaaaaaatcttgagagcaatcagagaaaaaggacaacttacctgtagggaaaagacaataagaatggtggtagatttctttttttttcttttttttttttttgagatggagtcttgctctgtcgcccaggctggagtgcagtggcatgatctcggctcactgcaagctccgcctcctgggttcacgccattctcctgcctcagtctcccgagtagctgggactacaggtgcccaccaccacacccggctaattttttttttttttttttgagacggagtctgtcgctcaggctggagtacagtggtgcgatctcagttcactgcaagctccgcctcccgggttcatgccattctcctgcctcagcctcccgagtagctgggactacagg

SEQ ID NO: 174755 - DNA, 601 bp, Human
agagtgagaccctgtctcaaaaactttttttttaaagttaaaaaaaaaaatcaaatgatagattcaggaagccaagtgaagcccaacatgattaacccaaagcaatccatgccaagacacatcataattaaacttctggaaactcaacacaaagaaaaaaatcttgagagcaatcagagaaaaaggacaacttacctgtagggaaaagacaataagaatggtggtagatttctttttttttcttttttttttttttgagatggagtcttgctctgtcgcccaggctggagtgcagtggcawgatctcggctcactgcaagctccgcctcctgggttcacgccattctcctgcctcagtctcccgagtagctgggactacaggtgcccaccaccacacccggctaattttttttttttttttttgagacggagtctgtcgctcaggctggagtacagtggtgcgatctcagttcactgcaagctccgcctcccgggttcatgccattctcctgcctcagcctcccgagtagctgggactacaggcgcctaccaccaggcccggctaattttttgtatttttttttttgaaacggagtctctg

SEQ ID NO: 174756 - DNA, 601 bp, Human
gtttccgctcttgttgcccaggctggagtgcagttgcacagtctcagctcatcacaacctctacctcccgggttcaagtgattctcctgcctcagcctcctgagtagctgggattacaggcatgtgccaccatacccggttaatttttgtatttttagtagagaggggtttctccatgttggtcaggctggccttgaactcccacctcaggtgatccacccaccctcggcctcctaaagtgctgggattacaggcgtgagccactgtgctcggccaattttttgtattttttagtagagayggggtttcaccgtgttagccaggatggtctcgatctcctgacctcatgatctgcccgccttggcctcccaaagtgctgggattacagacgtgagccaccgcgcccagccaaatgatggtagatttctcgtgagaaactggacgctagagcaagtggcaggatatttttcaagtactgaaagaaaagaactgttaatctagaatcctgtacccagtgacaatattgttcaggaatgaacgatattggacattctttttttttttttttttgagacggagtttctgctcttgttgcccaggc

SEQ ID NO: 174757 - DNA, 601 bp, Human
tacctcccgggttcaagtgattctcctgcctcagcctcctgagtagctgggattacaggcatgtgccaccatacccggttaatttttgtatttttagtagagaggggtttctccatgttggtcaggctggccttgaactcccacctcaggtgatccacccaccctcggcctcctaaagtgctgggattacaggcgtgagccactgtgctcggccaattttttgtattttttagtagagatggggtttcaccgtgttagccaggatggtctcgatctcctgacctcatgatctgcccgcctyggcctcccaaagtgctgggattacagacgtgagccaccgcgcccagccaaatgatggtagatttctcgtgagaaactggacgctagagcaagtggcaggatatttttcaagtactgaaagaaaagaactgttaatctagaatcctgtacccagtgacaatattgttcaggaatgaacgatattggacattctttttttttttttttttgagacggagtttctgctcttgttgcccaggctggagtgcagttgcacagtctcagctcatcacaacctctacctcccgggttcaagtgattc

SEQ ID NO: 174758 - DNA, 601 bp, Human
taaataaaatagactttcctctcctcttgggtttaacaaattatgtttgacagttgaagcaaaaattgtaacagtatctgatacggttctaaaggtatgtagaaagatttaaggctttaaggctgggcatggtggcttatgcctgtaatcgcggcattttgggaggccgaggcaggcggatcacctgaggtcaggagttcaagaccagcctggctaacatggcaaaaccctgtctctactaaaaatacaaaaattagctgggtgtggtggcgggcgcctgtaatcccagctactcgggaaygggaagctgtggcagggataattgcttgaacccgggaggtggaggttgtgttgagctgagatgacaccattgcactccagcctgggcgacagagcaagactgtgtctcaaaaaaaaaaaaagatggataaagataaaacgttaatcaaaggaaagcaggagtgacaatgttagtatcagtaaggcagacttcaaagaaaatgaccagagacagagaaggacattaaataatggtaaaaagataagttcatcaagacatagcaatcctaaatatgtatgcagcaaacgacagagctggaaa

SEQ ID NO: 174759 - DNA, 601 bp, Human
aaaatccttagcaaaatattgcgaaatagaattcagcaatatatagaaataattatatactgtgaccaagtgggatttattgcagggatggaaggctgggtcaatatttgaagctcaatcaatgtaatccaccatattaacacactaatgaagaaaaatcacaggatcagatcagttgatacagaaaaagcattttgtagaactcaacacctgatgataaaaatgctcagaaaaataatagcaggaaacttcctccatttagtaaagagcatctatttagtacaaaaagtcctgttgctatttttttttttttttttttagacggagtattgctctgttgtctaggctggagtgcagtggcatgatctcagctcactgcaaactctgcctcctggattcacaccattctcctgcctcagcctccctgatagctgggactacaggtgccctgccaccacacccagctaactttttgtatttttagtagagacggggtttcacagtgttagccaggaatgtctcgatctcctgaccatgtgatccacccgcctcggcctcccaaagtgctgggattacaggcgtgagccacagagcctggcct

SEQ ID NO: 174760 - DNA, 601 bp, Human
ctgtgaccaagtgggatttattgcagggatggaaggctgggtcaatatttgaagctcaatcaatgtaatccaccatattaacacactaatgaagaaaaatcacaggatcagatcagttgatacagaaaaagcattttgtagaactcaacacctgatgataaaaatgctcagaaaaataatagcaggaaacttcctccatttagtaaagagcatctatttagtacaaaaagtcctgttgctatttttttttttttttttttagacggagtattgctctgttgtctaggctggagtgcagtgscatgatctcagctcactgcaaactctgcctcctggattcacaccattctcctgcctcagcctccctgatagctgggactacaggtgccctgccaccacacccagctaactttttgtatttttagtagagacggggtttcacagtgttagccaggaatgtctcgatctcctgaccatgtgatccacccgcctcggcctcccaaagtgctgggattacaggcgtgagccacagagcctggccttctgttgctagcatttaatagtgaaaggttgcatgctttctgccagagaccaggaacaa

SEQ ID NO: 174761 - DNA, 601 bp, Human
gtgttagccaggaatgtctcgatctcctgaccatgtgatccacccgcctcggcctcccaaagtgctgggattacaggcgtgagccacagagcctggccttctgttgctagcatttaatagtgaaaggttgcatgctttctgccagagaccaggaacaagccaaatatgtctgctgtcactattcttattcaacatagtgttggaagttctagctaatccagtaagctgagaaaaggaaataaaagacgtgtagattggaaaggaagaaataaaatcctatttgcagatgacatgattgtcyatgtagaaaatcccaagggatctacagaaaacttggagaactaataactgaattccccaaggtcacaagatacaagggatacaaggtaaacatgcagaaatccattttatttctatatgccattaatgagtacctagacacaaattaaaaatacattaccatttatcatcactcaataaaaaaaggaatacttaggtataaatccaacaaaacatttacaggacttatataccaaaaactataaaacactgacgaaagtaatgaaggaagacctaaataagtagacatatcatattcatg

SEQ ID NO: 174762 - DNA, 601 bp, Human
tggaaatgatctagatagccttcagtgagtgaatagttaaagtgaggccccttcgtaccacagaatgtcacttggcagtaaaaggaagtgacaatctggatgaatcactggatacagatacagtcctctatcttgtcttttttggaggaaactgggcgcagtgtgcatggaatttctctgtgttgtttcttgcatctgtacatgaatctacaattacttaaaaattttaaaatgctctgggcagtgtattcactgggtgtttaccccgtgcacctgaggttcctgctgttgctgccccgcrggctgttaggatgctggtctccagcgtgtctttagggcagggaggagatagtggggctgtggtctgttaggccgacctgcttcttgatgatggaatcctactgtctgctctgagggaatttttcttggctttttcagcttattcctgcaaggcgtcttgtcagtaaggtctgggtggagcagggagagaatgttgactgagaggaccttgctgaggtctggctggccacagatggtccctgtgagctcccatctggtacaattccttttccaggatccgggatctgtagggacctccacg

SEQ ID NO: 174763 - DNA, 601 bp, Human
gatacagtcctctatcttgtcttttttggaggaaactgggcgcagtgtgcatggaatttctctgtgttgtttcttgcatctgtacatgaatctacaattacttaaaaattttaaaatgctctgggcagtgtattcactgggtgtttaccccgtgcacctgaggttcctgctgttgctgccccgcgggctgttaggatgctggtctccagcgtgtctttagggcagggaggagatagtggggctgtggtctgttaggccgacctgcttcttgatgatggaatcctactgtctgctctgaggsaatttttcttggctttttcagcttattcctgcaaggcgtcttgtcagtaaggtctgggtggagcagggagagaatgttgactgagaggaccttgctgaggtctggctggccacagatggtccctgtgagctcccatctggtacaattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtg

SEQ ID NO: 174764 - DNA, 601 bp, Human
atggaatttctctgtgttgtttcttgcatctgtacatgaatctacaattacttaaaaattttaaaatgctctgggcagtgtattcactgggtgtttaccccgtgcacctgaggttcctgctgttgctgccccgcgggctgttaggatgctggtctccagcgtgtctttagggcagggaggagatagtggggctgtggtctgttaggccgacctgcttcttgatgatggaatcctactgtctgctctgagggaatttttcttggctttttcagcttattcctgcaaggcgtcttgtcagtamggtctgggtggagcagggagagaatgttgactgagaggaccttgctgaggtctggctggccacagatggtccctgtgagctcccatctggtacaattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtgccatcacatctgccaccagttcagcacagaggggagtagagagatggcac

SEQ ID NO: 174765 - DNA, 601 bp, Human
cttggctttttcagcttattcctgcaaggcgtcttgtcagtaaggtctgggtggagcagggagagaatgttgactgagaggaccttgctgaggtctggctggccacagatggtccctgtgagctcccatctggtacaattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtgccatcacrtctgccaccagttcagcacagaggggagtagagagatggcacgcaagctttgatgtgcctttgctggcctcgcctggatcatctcattagttgggataatctcatgcgcccacccagctatgactggaatgaggggagtgtttatggccatgaccacccccagggcatggagcaggaggtctgtgcaggatgagggctgggggcctgctagtcatgtgcttcctccttccactcccagtttccaggaaggccacccccagtgccctggttgtcctctcctgcatccggagatgtttggct

SEQ ID NO: 174766 - DNA, 601 bp, Human
cccatctggtacaattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtgccatcacatctgccaccagttcagcacagaggggagtagagagatggcacgcaagctttgatgtgcctttgctggcctcgcctggatcatctcattagttgggataatctcatgcgcccacccagctatgastggaatgaggggagtgtttatggccatgaccacccccagggcatggagcaggaggtctgtgcaggatgagggctgggggcctgctagtcatgtgcttcctccttccactcccagtttccaggaaggccacccccagtgccctggttgtcctctcctgcatccggagatgtttggcttcaaagaagaaggggtgagggaggccggtccatgcccaagcatggtgcaatctcttggcatcccttccctctcctgatttcagagaagttgatgacgcctgagatgttttcagaaatcctctgt

SEQ ID NO: 174767 - DNA, 601 bp, Human
aattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtgccatcacatctgccaccagttcagcacagaggggagtagagagatggcacgcaagctttgatgtgcctttgctggcctcgcctggatcatctcattagttgggataatctcatgcgcccacccagctatgactggaatgagggragtgtttatggccatgaccacccccagggcatggagcaggaggtctgtgcaggatgagggctgggggcctgctagtcatgtgcttcctccttccactcccagtttccaggaaggccacccccagtgccctggttgtcctctcctgcatccggagatgtttggcttcaaagaagaaggggtgagggaggccggtccatgcccaagcatggtgcaatctcttggcatcccttccctctcctgatttcagagaagttgatgacgcctgagatgttttcagaaatcctctgtgacgatctggat

SEQ ID NO: 174768 - DNA, 601 bp, Human
gagtagagagatggcacgcaagctttgatgtgcctttgctggcctcgcctggatcatctcattagttgggataatctcatgcgcccacccagctatgactggaatgaggggagtgtttatggccatgaccacccccagggcatggagcaggaggtctgtgcaggatgagggctgggggcctgctagtcatgtgcttcctccttccactcccagtttccaggaaggccacccccagtgccctggttgtcctctcctgcatccggagatgtttggcttcaaagaagaaggggtgagggaggcmggtccatgcccaagcatggtgcaatctcttggcatcccttccctctcctgatttcagagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaaggtaggtgacttctcacccagcactggagccttcctggccctcagggtgggtgtcatcatggagcactgagggtaca

SEQ ID NO: 174769 - DNA, 601 bp, Human
ttccatatcatctggaaagtcataacacctggctttgctccctgcaatcccccaggaagggcataggctgagttctcttagtaaagtgttatattccggacacattcagggggtgtctctgaggcactgccaggctctgagcaaagcccggaggtctagaggaggtgaaggcagctgattggctgggccaggctgagtgctccagggtggcctagtaacccaataagatgctgccttagtggccatattacaggtgaagaggtgggcacgtggagagctgagatcacctgcggaagttgcmaactggccagttgagaaatggtgaggctggcgattgggcgcaggcctgcaccctgcagagcctatagcataatccttgctgtgctgagccgccactgccagactatgccttgagggtgaggggagctttgaaaataggaagatatgagaagtaggtgaaattggcacatgtgatgaccctaaaaaggtcagtggtttggttagatctgatgctgtgcctttggcttccattttaggaaaacattgatgtataaaaataagagccatgttacaaagggttcctgaaaatagtctttggggt

SEQ ID NO: 174770 - DNA, 601 bp, Human
atattccggacacattcagggggtgtctctgaggcactgccaggctctgagcaaagcccggaggtctagaggaggtgaaggcagctgattggctgggccaggctgagtgctccagggtggcctagtaacccaataagatgctgccttagtggccatattacaggtgaagaggtgggcacgtggagagctgagatcacctgcggaagttgcaaactggccagttgagaaatggtgaggctggcgattgggcgcaggcctgcaccctgcagagcctatagcataatccttgctgtgctgagcygccactgccagactatgccttgagggtgaggggagctttgaaaataggaagatatgagaagtaggtgaaattggcacatgtgatgaccctaaaaaggtcagtggtttggttagatctgatgctgtgcctttggcttccattttaggaaaacattgatgtataaaaataagagccatgttacaaagggttcctgaaaatagtctttggggtcgaggagcctcgggagggatgcctcctgtgactgagggatgcctctgccccgtgcaccagatggagcctgggccgacttcttcccactgt

SEQ ID NO: 174771 - DNA, 601 bp, Human
tgatgctgtgcctttggcttccattttaggaaaacattgatgtataaaaataagagccatgttacaaagggttcctgaaaatagtctttggggtcgaggagcctcgggagggatgcctcctgtgactgagggatgcctctgccccgtgcaccagatggagcctgggccgacttcttcccactgtggttctccgtggcactttactaagattttggaaaataacgtgggggaatcaccagcaacttcctctgtggtcccccaagtaacaaacaactaaatatcttatcttatttagttagtyaagacagtctcactgtgtcgcccaggctggagtgcagtggcacgatcttgactcattgcaacctccacctcccgggttcaagcaattctcctgtctcagcctcctgagtagctaggattacagttgcccgccactaagccaggctaatttttgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgt

SEQ ID NO: 174772 - DNA, 601 bp, Human
ccatgttacaaagggttcctgaaaatagtctttggggtcgaggagcctcgggagggatgcctcctgtgactgagggatgcctctgccccgtgcaccagatggagcctgggccgacttcttcccactgtggttctccgtggcactttactaagattttggaaaataacgtgggggaatcaccagcaacttcctctgtggtcccccaagtaacaaacaactaaatatcttatcttatttagttagtcaagacagtctcactgtgtcgcccaggctggagtgcagtggcacgatcttgactcaytgcaacctccacctcccgggttcaagcaattctcctgtctcagcctcctgagtagctaggattacagttgcccgccactaagccaggctaatttttgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgtgtgtgtgtgtgtgtgtgtcgcagtctcactctgtcgcccaggctggcttgcagtgt

SEQ ID NO: 174773 - DNA, 601 bp, Human
gagggatgcctcctgtgactgagggatgcctctgccccgtgcaccagatggagcctgggccgacttcttcccactgtggttctccgtggcactttactaagattttggaaaataacgtgggggaatcaccagcaacttcctctgtggtcccccaagtaacaaacaactaaatatcttatcttatttagttagtcaagacagtctcactgtgtcgcccaggctggagtgcagtggcacgatcttgactcattgcaacctccacctcccgggttcaagcaattctcctgtctcagcctcctgrgtagctaggattacagttgcccgccactaagccaggctaatttttgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgtgtgtgtgtgtgtgtgtgtcgcagtctcactctgtcgcccaggctggcttgcagtgtgcgatctcagctcactgcaagctccgcctcctgggttcacaccattctcct

SEQ ID NO: 174774 - DNA, 601 bp, Human
tctgccccgtgcaccagatggagcctgggccgacttcttcccactgtggttctccgtggcactttactaagattttggaaaataacgtgggggaatcaccagcaacttcctctgtggtcccccaagtaacaaacaactaaatatcttatcttatttagttagtcaagacagtctcactgtgtcgcccaggctggagtgcagtggcacgatcttgactcattgcaacctccacctcccgggttcaagcaattctcctgtctcagcctcctgagtagctaggattacagttgcccgccactawgccaggctaatttttgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgtgtgtgtgtgtgtgtgtgtcgcagtctcactctgtcgcccaggctggcttgcagtgtgcgatctcagctcactgcaagctccgcctcctgggttcacaccattctcctacctcagcctcccaagtagctgggactaca

SEQ ID NO: 174775 - DNA, 601 bp, Human
tgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgtgtgtgtgtgtgtgtgtgtcgcagtctcactctgtcgcccaggctggcttgcagtgtgcgatctcagctcactgcaagctccgcctcctgggttcacaccattctcctacctcagcctcccaagtagctgggactacaggcgcttgccaccaygcctggctaattttttgtattttttatagcagagactgggtttcaccgcgttagccaggatggtctcgatctctggacctcgtgatctgcccacctcgacctcccagagtgctgggattacaggcatgagccaccacacctggccaatactttgttttcttgattaatattttaaaattgtggtaacattcataacataaaatttaccattttaaccacttaagtgtaaattcagtggcagtatattcacatccatggctgtgtaattatcaccaccatccatctccagaattctatcat

SEQ ID NO: 174776 - DNA, 601 bp, Human
ttagccaggatggtctcgatctctggacctcgtgatctgcccacctcgacctcccagagtgctgggattacaggcatgagccaccacacctggccaatactttgttttcttgattaatattttaaaattgtggtaacattcataacataaaatttaccattttaaccacttaagtgtaaattcagtggcagtatattcacatccatggctgtgtaattatcaccaccatccatctccagaattctatcatcatgtaaaactgaaactgtccatcaaacactaactccccattccccctccscccacccctggcaagcaccattctgctttctgtctctatgaatttgactactcgaggtgtctcatttacattcctaagggaatcatgcagtatttgtccttttgtgactggcttatttcacttagcagaatgtcttcaaggttcatttatgttgcaccatgtcagaatttccttccctttttaaaatgtatttatttttagacagggtcttactctgttgcccaggctggagtgcagtggcgcagttatggctcactgcaacctctgcttcctgggctcaagtgatccacccggtgcagc

SEQ ID NO: 174777 - DNA, 601 bp, Human
acacttgggttgcttccacattttggctattgtgaataatgctgctatgaacctgggtgtgcagatatctgttggtgtccctgttttcatttattcattcattcattcattcattcatttagatggagtctcactctgttgctcaggctggagtgcagtggcgcgatcttggctcatggcactcctgcctcccaggttcaagcaatctcctgcttcagcttcctgagtagctgggattactggcacccaccaccatgcccagctaatttttttggatttttaatagagaccgggtttcacyatgttggccagcctggtctcaaactccgcctcagcctcccaaactcaaatgatctgcccacctcggcctcctaaagtgctgggattataggtgtgagcccctgtgtctggcccctgctttcatttcttttgggtgtatacctagaaatggaattcctggatcgtacagtaattccatgtttagttttttgaggatccactatactgcctttctcggtggctgcacccttttatattcctaccagcaatgcgcaggggttccagtttctccacatcctcactcacacttgttagtttttct

SEQ ID NO: 174778 - DNA, 601 bp, Human
tgggcaacatggtgaaaccctgtctctactaaaaatataaaaaattagctgggcgtggtggcacgttcctgtaatcccagctactctggaggctgaggcatgagaattgcttgaacctgggaggcggaggttgcagtgagccaagattgcgccactacactccagcctgggcaacaggctcttcccatctcactgactctgtctcaaaaaaaaaaaaaagaaaaaagagaaaatggagtctcactttgttgtccaggctggtctcgaactcctgggctcaagcaactcttccaccttggcytcccaaactgctgggattacagacatgaaccactgtgcctggccagagctgggtgtttctgtaaggacgtcctttgtcttgatcctggaacatgactgaaggaaaacaagaatctttggagccatggcacatgaggaccatctctctcctcagaaagagtgccttaggttagagcagcatcttccagatattcttggcaatgctgggaccaaagcccaggcctggctgcccttgccagggcacctggcccaagtcggctttgcccagttccagcaggggttggggggcaggggaggaagc

SEQ ID NO: 174779 - DNA, 601 bp, Human
ccagctactctggaggctgaggcatgagaattgcttgaacctgggaggcggaggttgcagtgagccaagattgcgccactacactccagcctgggcaacaggctcttcccatctcactgactctgtctcaaaaaaaaaaaaaagaaaaaagagaaaatggagtctcactttgttgtccaggctggtctcgaactcctgggctcaagcaactcttccaccttggcctcccaaactgctgggattacagacatgaaccactgtgcctggccagagctgggtgtttctgtaaggacgtcctttktcttgatcctggaacatgactgaaggaaaacaagaatctttggagccatggcacatgaggaccatctctctcctcagaaagagtgccttaggttagagcagcatcttccagatattcttggcaatgctgggaccaaagcccaggcctggctgcccttgccagggcacctggcccaagtcggctttgcccagttccagcaggggttggggggcaggggaggaagctggggacatggtgctgctgcagtttgagccatcagaccctgtggcactgtccaggccccgtccggagagtgcatgg

SEQ ID NO: 174780 - DNA, 601 bp, Human
caacaggctcttcccatctcactgactctgtctcaaaaaaaaaaaaaagaaaaaagagaaaatggagtctcactttgttgtccaggctggtctcgaactcctgggctcaagcaactcttccaccttggcctcccaaactgctgggattacagacatgaaccactgtgcctggccagagctgggtgtttctgtaaggacgtcctttgtcttgatcctggaacatgactgaaggaaaacaagaatctttggagccatggcacatgaggaccatctctctcctcagaaagagtgccttaggttrgagcagcatcttccagatattcttggcaatgctgggaccaaagcccaggcctggctgcccttgccagggcacctggcccaagtcggctttgcccagttccagcaggggttggggggcaggggaggaagctggggacatggtgctgctgcagtttgagccatcagaccctgtggcactgtccaggccccgtccggagagtgcatggggtgagatgtgagtcagggctggggaggtgggcaggggcctggccctgctgtgcacctgcttgggagtcctggccccgtcttagctctgtgagtc

SEQ ID NO: 174781 - DNA, 601 bp, Human
gacatgaaccactgtgcctggccagagctgggtgtttctgtaaggacgtcctttgtcttgatcctggaacatgactgaaggaaaacaagaatctttggagccatggcacatgaggaccatctctctcctcagaaagagtgccttaggttagagcagcatcttccagatattcttggcaatgctgggaccaaagcccaggcctggctgcccttgccagggcacctggcccaagtcggctttgcccagttccagcaggggttggggggcaggggaggaagctggggacatggtgctgctgcartttgagccatcagaccctgtggcactgtccaggccccgtccggagagtgcatggggtgagatgtgagtcagggctggggaggtgggcaggggcctggccctgctgtgcacctgcttgggagtcctggccccgtcttagctctgtgagtccacctggagtccagcactcctcactaccccaccaaggccactgccagatggctcccttcctccctccccgccttccagtagaggtctcagcatggcagctcagcccatgtctcttgtctgcccaaaataccgcagaagcttcccacatccc

SEQ ID NO: 174782 - DNA, 601 bp, Human
cttcctggcctcctgacttctgaggccagcctggactttctccccctccctccctttcctccctggcactcccgtgctttctggcacaccacatgctcacttaacctacttagtgtctgtcagtgcccccaccagcatagctttttttttttttttttttttttttttttttttttttttttgacacagagtctcgctgtgttgcccaggctggactcaaacacctgagctccagtgatcttcccacctcagcctcccaagtaactgagactacagacatgtaccacctcacctttctcaraacagccttttgaatgtttgtctctcttgtgcctctccttggtagacacacagtctagactttggaataaatgaatgtgttagtgactgaatggcaggggacaggcaactccatccatgagcccagggcagggagggcttgctgggtgggagccatgtgcctatggtcctatggggtcctgttgggtggttccatgggctgtctgctgctgcacgttctttttggacccagcacccacgtggtttgcttggcattagattccagttgggaagggccagtgcctccgattccattcatcat

SEQ ID NO: 174783 - DNA, 601 bp, Human
cgctgtgttgcccaggctggactcaaacacctgagctccagtgatcttcccacctcagcctcccaagtaactgagactacagacatgtaccacctcacctttctcagaacagccttttgaatgtttgtctctcttgtgcctctccttggtagacacacagtctagactttggaataaatgaatgtgttagtgactgaatggcaggggacaggcaactccatccatgagcccagggcagggagggcttgctgggtgggagccatgtgcctatggtcctatggggtcctgttgggtggttccmtgggctgtctgctgctgcacgttctttttggacccagcacccacgtggtttgcttggcattagattccagttgggaagggccagtgcctccgattccattcatcatcaggcgtgggcgtatgtggagatagcaaaggacatgggggcccgactgcagtccccattgcctggctgcatgccgtgtacaggacactgcagctctgccctcggcttcctccctctgcgtgaggattccttcattcccagaacaaatacaccctgcctgtgctagaattcctggaggcaaatgattcagattgt

SEQ ID NO: 174784 - DNA, 601 bp, Human
tgacagcacacccggggcctgggccctctggctgtgagtcacgtgctgcagggagtcctctggggaatgtggaggagctggcccagcactgtgatccctgcaggcttccctgtcccctcaccgtgttgacccagagtggggtgcatctgtgaacacgctaggcagggttttccgagaggggcaagctctgtaaagggcatagacattggctcaagacagggcttagggatgccttagctgagccctgcctttctggtgtagtcacgtaagaccgatggcagcaggagcgaagggcagaaargaaggtccccaccagcacagggcacaggggagatgggatgaaggtaaggtgggactcaggtgcccccggggtcacttcagggcctcccgagggtgactgtgctgggccctgagccagagcccctcatggcagacagggttgtggggtcagccttgttttggggatggggaactggaaggacaaggaccacctgcagttctcagctggtggaccctggtgggcagggcccaccccaggcctggcagggccccgctcctcgcggcctccctgggctgcaaaagctctaacttgtgtcctttg

SEQ ID NO: 174785 - DNA, 601 bp, Human
gtggaggagctggcccagcactgtgatccctgcaggcttccctgtcccctcaccgtgttgacccagagtggggtgcatctgtgaacacgctaggcagggttttccgagaggggcaagctctgtaaagggcatagacattggctcaagacagggcttagggatgccttagctgagccctgcctttctggtgtagtcacgtaagaccgatggcagcaggagcgaagggcagaaaggaaggtccccaccagcacagggcacaggggagatgggatgaaggtaaggtgggactcaggtgcccccrgggtcacttcagggcctcccgagggtgactgtgctgggccctgagccagagcccctcatggcagacagggttgtggggtcagccttgttttggggatggggaactggaaggacaaggaccacctgcagttctcagctggtggaccctggtgggcagggcccaccccaggcctggcagggccccgctcctcgcggcctccctgggctgcaaaagctctaacttgtgtcctttggttgttgcctcagctgaacatccatgtgggaaacatttccctggtggaccagtttgagtgggacatgt

SEQ ID NO: 174786 - DNA, 601 bp, Human
actgtgatccctgcaggcttccctgtcccctcaccgtgttgacccagagtggggtgcatctgtgaacacgctaggcagggttttccgagaggggcaagctctgtaaagggcatagacattggctcaagacagggcttagggatgccttagctgagccctgcctttctggtgtagtcacgtaagaccgatggcagcaggagcgaagggcagaaaggaaggtccccaccagcacagggcacaggggagatgggatgaaggtaaggtgggactcaggtgcccccggggtcacttcagggcctcycgagggtgactgtgctgggccctgagccagagcccctcatggcagacagggttgtggggtcagccttgttttggggatggggaactggaaggacaaggaccacctgcagttctcagctggtggaccctggtgggcagggcccaccccaggcctggcagggccccgctcctcgcggcctccctgggctgcaaaagctctaacttgtgtcctttggttgttgcctcagctgaacatccatgtgggaaacatttccctggtggaccagtttgagtgggacatgtcagagaaggagaactcacc

SEQ ID NO: 174787 - DNA, 601 bp, Human
tttgtgtctaacttgttttcccagacatcccaagagacagctttctatgacttcccataaatctgagcaaggaagaaggaatgagagccacccacggggctcaagggcccgggcctgggaaacagctgagtccctgcctgagcgccatggtgctgagatcctgtgacctgccccccagcagccctgccagtcacatggttctgcttcacagacagggcagcccagagaggaggctggggggctggtgtctgatgcctccctgttccctcggggtgttgcctgggagtgcagctgtagcgtscattcaccctgcacagagccaagccctatggccggagagccagtcaagggtggcctccctccaccagagttgactctgaggccccgggaggcagtcatgttgcgcgcatcaacactgagcacctcctcccgcagaggctgatccagtcagaaccctcgtcttgggctcacaggtgcaggtggtaggctggctgcccccagcatccagcccctacggtgttgaccttcacctagtcctgcagccgctgccagtgcccacagtccagggtcaggaactgaagtccccggggcctcttgacag

SEQ ID NO: 174788 - DNA, 601 bp, Human
agggcagcccagagaggaggctggggggctggtgtctgatgcctccctgttccctcggggtgttgcctgggagtgcagctgtagcgtccattcaccctgcacagagccaagccctatggccggagagccagtcaagggtggcctccctccaccagagttgactctgaggccccgggaggcagtcatgttgcgcgcatcaacactgagcacctcctcccgcagaggctgatccagtcagaaccctcgtcttgggctcacaggtgcaggtggtaggctggctgcccccagcatccagcccctrcggtgttgaccttcacctagtcctgcagccgctgccagtgcccacagtccagggtcaggaactgaagtccccggggcctcttgacaggtccttgcaacatcccttctttcagccaccatggcaccatccctcctgctctgacccgaaggtgacctgagcctaaattcctttccaagttccgggccctctgcagtttgcagagtggctccagagcagaccccctggggagtccctggtggtggcaggtcaggatttagaggcagaggcgggccccttctttatctcatcgaccacttagtg

SEQ ID NO: 174789 - DNA, 601 bp, Human
ctacggtgttgaccttcacctagtcctgcagccgctgccagtgcccacagtccagggtcaggaactgaagtccccggggcctcttgacaggtccttgcaacatcccttctttcagccaccatggcaccatccctcctgctctgacccgaaggtgacctgagcctaaattcctttccaagttccgggccctctgcagtttgcagagtggctccagagcagaccccctggggagtccctggtggtggcaggtcaggatttagaggcagaggcgggccccttctttatctcatcgaccacttastgcattccagttgcagggcctgggggcatcacagaccccctgctccctgctctctcttatgctgagaatgcaggtttcaaatctttggggttaaaggcaaaggccatcccgctgggaccaaggtgagcacacgtccctatcacagcagccagatggagaggcggcctgcctggggaactgggaagtgtcctgagtgggcttttagcatcaggagggctgcgtgtgtcttcccagtccccacactggaagacagctgcaaggataggacagggccttagggttgggctgtcatccctgact

SEQ ID NO: 174790 - DNA, 601 bp, Human
ccacagtccagggtcaggaactgaagtccccggggcctcttgacaggtccttgcaacatcccttctttcagccaccatggcaccatccctcctgctctgacccgaaggtgacctgagcctaaattcctttccaagttccgggccctctgcagtttgcagagtggctccagagcagaccccctggggagtccctggtggtggcaggtcaggatttagaggcagaggcgggccccttctttatctcatcgaccacttagtgcattccagttgcagggcctgggggcatcacagaccccctgcyccctgctctctcttatgctgagaatgcaggtttcaaatctttggggttaaaggcaaaggccatcccgctgggaccaaggtgagcacacgtccctatcacagcagccagatggagaggcggcctgcctggggaactgggaagtgtcctgagtgggcttttagcatcaggagggctgcgtgtgtcttcccagtccccacactggaagacagctgcaaggataggacagggccttagggttgggctgtcatccctgactccaactcgcgttccccccactgtaccaccccaccccatgggatc

SEQ ID NO: 174791 - DNA, 601 bp, Human
ggagacaagcatgaaggggaaacaggggcatgtgacaaactggtcagaagccctaggctcctagaggacagactgggaccagagtgacacaggcgtctcagagccagtggagtgggatgaagggccagcgaaaggagggagacagggctcaaggggaaggaggctgggctaggcagagcctctgaggagagctgatcctgcgaagttactggcacctcccctgggccagccctgtgttcctggccagggacgggaggagacagtgccctgtctggcagaggaaacagattcatgtgcatgrctatcagtgtgccatggccacagaaagcaccggaggctgtgggcatgaggaagggcagttgggggcatagaacctggggtgaggatggccagggcaggtgctgatgggggactgcagcaggaaggaccgagaggagaccagggacaggcaggtgcttgagaaggaaggtgggccctgtggatcaggcagggtatctgccccagggggctctgcacaccagcagtcctacacgtacagggtggggatgaaaagagactaagggtcagggagcttggtagctgggcctgcatgagggacaga

SEQ ID NO: 174792 - DNA, 601 bp, Human
aggagggagacagggctcaaggggaaggaggctgggctaggcagagcctctgaggagagctgatcctgcgaagttactggcacctcccctgggccagccctgtgttcctggccagggacgggaggagacagtgccctgtctggcagaggaaacagattcatgtgcatgactatcagtgtgccatggccacagaaagcaccggaggctgtgggcatgaggaagggcagttgggggcatagaacctggggtgaggatggccagggcaggtgctgatgggggactgcagcaggaaggaccgagrggagaccagggacaggcaggtgcttgagaaggaaggtgggccctgtggatcaggcagggtatctgccccagggggctctgcacaccagcagtcctacacgtacagggtggggatgaaaagagactaagggtcagggagcttggtagctgggcctgcatgagggacagagaggcagtgtccctctgatggcacagcatcaggaattaggctggggtatgtcaggtacacgttgggctggttgagcgtaagcctcaggttccttccgaagctctgcccgccagccctggcctgatgtcaggt

SEQ ID NO: 174793 - DNA, 601 bp, Human
tccatgttgtagcatcttttatcaggacttcattcttttttatgattgaatattatctcattgcatggatataccacattttattcattcatcagcagattgacttttgggttgtttccatttttcagctattgtgagtactgctgctgagaacatttgtgtatgagtttttgtgtgaacatctgttttcaattttcttggatatatacccaggagtagaattgctgggtcacgtgacaactcagtggttagcattttgaagaatttctagactgttttccaaagtggctgcaccattttrcattcccaccagaagcgtgcgattcccgtttctctggatcctgctggcatttgctgttctctttttgatcgtagccgtctgaggaggtgtgaagtaattgtggttttgatttgcatttttctaatgactgatgatattgagcatctttgcatgtatttctggctgtttgtgtatcttctttggagaaagtgctttgctagtttcttaattgggttttattttattgttgagttgtaattgttctttatatattctacatagaagtccctcatcagatagatacatgatttgaagatattt

SEQ ID NO: 174794 - DNA, 601 bp, Human
gctgagaacatttgtgtatgagtttttgtgtgaacatctgttttcaattttcttggatatatacccaggagtagaattgctgggtcacgtgacaactcagtggttagcattttgaagaatttctagactgttttccaaagtggctgcaccattttgcattcccaccagaagcgtgcgattcccgtttctctggatcctgctggcatttgctgttctctttttgatcgtagccgtctgaggaggtgtgaagtaattgtggttttgatttgcatttttctaatgactgatgatattgagcatstttgcatgtatttctggctgtttgtgtatcttctttggagaaagtgctttgctagtttcttaattgggttttattttattgttgagttgtaattgttctttatatattctacatagaagtccctcatcagatagatacatgatttgaagatattttctctcatttggaggattgccttttcactttcttgatagtgttctttgaagcacaaaagttttcattttgatgtagtccaatttatcttttttttttttttttgagacagtctcgctgtgtcaccaggctggagtgtagtgctgt

SEQ ID NO: 174795 - DNA, 601 bp, Human
actttcttgatagtgttctttgaagcacaaaagttttcattttgatgtagtccaatttatcttttttttttttttttgagacagtctcgctgtgtcaccaggctggagtgtagtgctgtgatcttggctcactgcatcctccgcctcctgagttcaagtgattctcctacctcagcctcccaagtagctgggactacaggcacctgccaccacacccagctaattttttgtttttagtagagacggggtttcaccatgttggccaggatggtctccatctcttgacctcataatccgcccrcctcggcctcccaaagtgctgggattacaggtgtgagccactgcacccggcctgtaatttatatattgttttagtttgttgctagtgcttttggtttcatatctaagaatccattgtcaatccagagtcatgttgccccagcaccatgttgaaaactgctcttcctccattgagtggacttggcacccttctaaaaatcatttgaggctcctggcggcctcggaggtgtgaattgcaaacataagggtgacaccaagttttggcatctccccttcctggtcgagtggctgtggacaggtc

SEQ ID NO: 174796 - DNA, 601 bp, Human
acagcatctccatgcccacatgcccccaaaacccaaggcaggctagtgctggctctaggcccgttcttacatggttggtgcgagcatttcttactttagaacaaacccactggagtggaatattcccagcatcaaggggaggtaaacaaaggaccctctgggacccactcgccagctcttgtttaagaggaaaacatgttttgctcccctcgttgtgggcttggtacctttcacgtctgccctccaaggaaggctgctgggagccctcacggtgaggaatgatgtttggggtctgaggctrgggtggtccctagactgctaaaccacccggtgctggccagggaccagctgtcaggagctgctgaggatgggtcagccccagagggtgggggtgccgacattgcctctggccctgcctctgcgtcaccagtacgagcttgagcttctgcgactcatgagcatggacctggtgggctgagcttcagctgtgaggggtcaggcctgctgcagggagagccagctgcagccagtgccctgcgctgtgcccacagtccctgagaccccaggctgaggagagcagcactgagcccaacctgaaacg

SEQ ID NO: 174797 - DNA, 601 bp, Human
ggctggggtggtccctagactgctaaaccacccggtgctggccagggaccagctgtcaggagctgctgaggatgggtcagccccagagggtgggggtgccgacattgcctctggccctgcctctgcgtcaccagtacgagcttgagcttctgcgactcatgagcatggacctggtgggctgagcttcagctgtgaggggtcaggcctgctgcagggagagccagctgcagccagtgccctgcgctgtgcccacagtccctgagaccccaggctgaggagagcagcactgagcccaacctgraacgggctcacggctactggagctgggtgtgtgctcactggtgtggatgtgcagagccgggactcgctctgcaagcaggctggtcccacaaccttgagcacccgctacagggaggctgtgagaaggtccctggcccctaggaagctccctcagtggagatgttttggctgctttaataacagtcatccttccaaagcccttcacagcaataaatgtttccatattccagatgaggtttgcagggacctgtcctctctatcagtgtccacctggcgcctcccccgagtccggcctgccctt

SEQ ID NO: 174798 - DNA, 601 bp, Human
ggctggggacttctgggagactcctttgctcccattcgccatccatcccctttccctgatcagtgggccctggctctggacactgagtggagcagacagtcctcctgcccctataggttccacctcctgactggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttmtggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacagga

SEQ ID NO: 174799 - DNA, 601 bp, Human
gttttacttcaacatgtaattgatgtaaaaaaaaaatgagatattttacattctgtctttgtactatctttgaaattctgtgtattttacacttacagcacatctggattcagactagccacatttcaagtgctcagtagtcacatgtggttaataactactttattgtgcaatgtaagactaacccatagttgagctttagatcttatcttaaacttgctcagatgttttcaacttgaaaagcacgaatcaaatattttctgttggaaagcagtcatggcttatactggtcatgtattgyccttggcttctttgagctttgacactgtttatctcttcacactacagccaaggaagatcagcacctaccataatgtttaatatagatgccgtgaacccatcacagaaaaacatatgcagggtttcaaatgtgtttgggtggggtctttgattacatgcttgccagtttctcggccttgcattttcacaaggagttatacccagagaaaattttactttcttggggctctgttttgaaaatagttaatgatttttaatgattttatataaccctgatttttttttctctatatttaagtca

SEQ ID NO: 174800 - DNA, 601 bp, Human
aagacttcctcttttaagtccatattgattctgcatgccctcctgtacctttgtatttattttattttacactgtctccttccttggttgtattaaggagttgctgaaaaatcaaatatgtgaggttttattttctctattacctctggtaatcttattcctgatgatggggaatcttcatcatcttagacccagccttggcccagaagatgttagcatctacctaaaactacagatccatcagtattttggtttggtttggtttggtttggtttggtttggtttggtttggtttggtttgtttgagacagagtcttgctctgttgcctcggctggagtgcagtggcatgatctcggtgcactgcaacctctgcctcccaggttcaagctattctcctgcctcagcctcctgagcagctgagactgcaggtatgcaccagcatgcccagctaatttttgtatttttagtagaaacagggtttcaccatgttggccagtctggtctctttaactcctgacctcgagtgatccacccggctcggcctcccaaagtgctgggattacaggcgtgagccaccacgcccggccccgtcagtgtttt

SEQ ID NO: 174801 - DNA, 601 bp, Human
tgtgtgtgtgtgtgtgtgtgtcagccttactctgtcacccaggctggaatgcagtggtgtgatctcggctcactgcagcctctgcctcctgggttcaagtgattctcctgcctcagcctcctgagtagctgggattacagatatccaccaccatgcctggctaatttttgccttcttagtagagagggggttttgccatgtttgccaggctggtctcgaaccctgacatcaagtgatccgtcaccctcgtccttccaaagcattgggattgcaggcgtgagccactactcccagccttttwtggtttgtttgtttgtttgtttgttttttgagacagagtcttgctcttttgcccaggctggagtacagtggtgtgcaacttcggctcactgcaacctctgccccttgggttcaagcaattctcctacctcagcctcccaagtaactgggattgcagacatgtaccaccatgcaccactaacttttgtatttttagtagagattgggttttgccgtgttggtcaggctggtctcgaattcctgacttcagcctctcatagtgctggcattacaggtgtgagccaacatgcccggcccactt

SEQ ID NO: 174802 - DNA, 601 bp, Human
ctgaggtgggcggatcacctgaggtcaggagtttgagaccagcctggccaacacggagaaaccccatctctactaaaaatacaaaattagccaggcatggtggtgtgcgcctgttaattccagctacttgggagtctgagacacgagaatcgcttgaactcggggggcggaggttgcagtgagccaagattgtgctattgcacttcagcctgggcaacaagagggaaactccatctcaaaaggaaaaaaactcagtctaggcaacatggtgaaactccatctctacaaaaaatacaaacarttagctggtgtggtggcacgcacctgtagtcccagctactcaggaggctgagggagaatcacctaagcccaggaagtcaaggctgcagtgagccatgctcatgccactgcactgtagcctgggcaacgggagtgagatgtgcatttcccatttgttactctttttaaacaaggataggaaatcgtcagaaagcatactgttatctctgtcttctctgttcttcctttcccacattcattaaaaaacaattatggctaattaaccacttgagaattgttttggctgctatagattgaaacg

SEQ ID NO: 174803 - DNA, 601 bp, Human
aaaattagccaggcatggtggtgtgcgcctgttaattccagctacttgggagtctgagacacgagaatcgcttgaactcggggggcggaggttgcagtgagccaagattgtgctattgcacttcagcctgggcaacaagagggaaactccatctcaaaaggaaaaaaactcagtctaggcaacatggtgaaactccatctctacaaaaaatacaaacaattagctggtgtggtggcacgcacctgtagtcccagctactcaggaggctgagggagaatcacctaagcccaggaagtcaagrctgcagtgagccatgctcatgccactgcactgtagcctgggcaacgggagtgagatgtgcatttcccatttgttactctttttaaacaaggataggaaatcgtcagaaagcatactgttatctctgtcttctctgttcttcctttcccacattcattaaaaaacaattatggctaattaaccacttgagaattgttttggctgctatagattgaaacgttgctgctcccaaggtccagtgatcctgttgctcttgttcccacaggcatagaatgtcaagctaaccaggcgtccgctactt

SEQ ID NO: 174804 - DNA, 601 bp, Human
gaagtatattgggctctttgccctttctggcatacagacatatactaagaaccatgttcctttatgtggaaagaaaagagagtgaacatccccttaaatttggctaaggagagattctctgagagagcctgccgtagaagagagccagcatggtgtggcagaaggctctggattagtcctgggttctagttctgggtcttctacaaaccagctccatgaattaggcaagtcacttgtctgggtttcagtttcctgtctgtaaaatgaagataaaaatatctgtcatgcttgcctgccaggsttgatgtgaggcctcaaatgaggtaatacatgtcaacatcttctgtaaactgtcaagtactataaatttatcttctgtaaattgtactttgaccgctaaatatatccattaatacatcttagtaaatgttcaggggtgctgtcacctccctgacacctcctttacagcccccttttccccagcgcgtggtatgctctgacttagttgggctctaccaggacaccgtactgctgcaaagtgctcagtgggtgaggtgggagagggagaagctgtcgaatacccttcggtgagcccgacccc

SEQ ID NO: 174805 - DNA, 601 bp, Human
tgggggatggagacatgatacatgccttgttttttttaaaactagtttttggttacttaagctaggacttatctatatggaaaatgcacaaaggattagccaacattagacatttgcagcctagggtttcccaacctttttttttttttttttttttttgagacggagtctcgctttgttgcccaggctggagtgcagtggtgctatcttggctcactgcaacgtccacctcccagattcaagcgatcctcccacctcagcctagcaagtggctgggattacaagtgtgtgccaccatgcrcagctaatttttgtatttttcgtagagattgggtttcaccatgttggccaggctggtcttgaactcctgatctcaactgatctgcctgcctcggtctcccaaagtgctgggattacaggtgtgagccaccgtgcccggcaggtttcccaaccttctacggtctgtgaaagtagaaaatgtgataatctatgaactcttaaatatttccagaattacatcctaatgaggctccatggactacctaatgtcaggtagctttgggctagacttgtatccacttatcatatttcactggtttat

SEQ ID NO: 174806 - DNA, 601 bp, Human; identical to SEQ ID NO: 28031

SEQ ID NO: 174807 - DNA, 601 bp, Human; identical to SEQ ID NO: 28032

SEQ ID NO: 174808 - DNA, 601 bp, Human; identical to SEQ ID NO: 28033

SEQ ID NO: 174809 - DNA, 601 bp, Human; identical to SEQ ID NO: 28034

SEQ ID NO: 174810 - DNA, 601 bp, Human; identical to SEQ ID NO: 28035

SEQ ID NO: 174811 - DNA, 601 bp, Human; identical to SEQ ID NO: 28036

SEQ ID NO: 174812 - DNA, 601 bp, Human; identical to SEQ ID NO: 28037

SEQ ID NO: 174813 - DNA, 601 bp, Human; identical to SEQ ID NO: 28038

SEQ ID NO: 174814 - DNA, 601 bp, Human; identical to SEQ ID NO: 28039

SEQ ID NO: 174815 - DNA, 601 bp, Human; identical to SEQ ID NO: 28040

SEQ ID NO: 174816 - DNA, 601 bp, Human; identical to SEQ ID NO: 28041

SEQ ID NO: 174817 - DNA, 601 bp, Human; identical to SEQ ID NO: 28042

SEQ ID NO: 174818 - DNA, 601 bp, Human; identical to SEQ ID NO: 28043

SEQ ID NO: 174819 - DNA, 601 bp, Human; identical to SEQ ID NO: 28044

SEQ ID NO: 174820 - DNA, 601 bp, Human; identical to SEQ ID NO: 28045

SEQ ID NO: 174821 - DNA, 601 bp, Human; identical to SEQ ID NO: 28046

SEQ ID NO: 174822 - DNA, 601 bp, Human; identical to SEQ ID NO: 28047

SEQ ID NO: 174823 - DNA, 601 bp, Human; identical to SEQ ID NO: 28048

SEQ ID NO: 174824 - DNA, 601 bp, Human; identical to SEQ ID NO: 28049

SEQ ID NO: 174825 - DNA, 601 bp, Human; identical to SEQ ID NO: 28050

SEQ ID NO: 174826 - DNA, 601 bp, Human
ctctcctaacaagatacggtaggatggtctcctggttaaagtgtggctccggagtcaggctacagatgctggctacagagctacatgactttgggcaagacacttaacctctgtggtcatcaggttcctcatttgtaaaatgagaatcatattgcagcagtgccatatgacttttgtaaggattaaataagatattgcgcattgcagtacactgagctccacagagacagcgccggggcaagtgagagccggacgggcactgggcgactgtgcctcgctgaggaaaaataactaaacatgrgcaaaggagatcctaagaagctgagaggcaaaatgtcatcacatgcattttttgggcaaacttgtcgggaggcgcataagaagaagcacccagatgcttcagtcaacctctcagagttttctaagaagtgctcagagaggtggaagaccatgtctgctaaagagaaaggaaaatttgaagatatggcaaaggcggacaaggcccattacgaaagagaaatgaaaacctatatccctcccaaaggggagacaaaaaagaagttcaaggatccgaatgcacccaagaggactccttcggcct

SEQ ID NO: 174827 - DNA, 601 bp, Human
tactgaggagtgtgcaggactgccatgtaagattatgcaggttgcgcactgcccaacagtaggagggtgccatttacacagaccctgcccactggatgaggcagttctgcaggagatccttagaatccagtgttggatctaaaaatgtccctcccagccgtaaattgaaagccaacatcacccgcctaaagtagaaggtaactgtaaaaataaacataatgttttaatgctattaatttttagctaaatagtcttgctgctaagcatgtggcctgatcattttttgtaaaaaaaaaaaaaattaaaaaacaaaaaagagagtgagagagagagattagtgagacacagagaggtgttaaggacacactaataacacaccaagactttctagaccagtgtcattcagtggacctgtctgcaatgatggagatgttctacatctacaccatccatttcagagccactggccagatgtgaccattgaggatttgaaaggtagccagcatgagtagagaactgaatcttgtttaatcttaatttatttaagtttaaatttaattagctacatatggccagtggctaccatattagatagaaggtt

SEQ ID NO: 174828 - DNA, 601 bp, Human
tagctaccatattggatagaaggttgtagaagtttggaaagtagataggagatttggagtcacttaatgctacacctgtgagtgccacctgaggtcatcttgggtgatttttgcacatctcatgctttagtaaatactcttttagcttctgatttgtgcaggtggggaatgggggtcagatgggaacagaggctttctaggggtatgtccagcaggctgacagactcagccagtaagcagacaatgagcttggatagattcagacagtttattacttatacagacagtaaaggcaaggtgyagcctcctgtgtcccttgtcctactggacgacaccaaaacaaagggggctgaatgacaggcattaggaatggtaggaaccccgtggctgaagagctgcttccatgcttcaacgatagcttgctgctgtcgcctgtggggaggcgaggtggaaagccccacatctcagagtggccagagaggcagatgaggggctgcctcgtggcagcctcccacaagagagggaggaaaatgagagatggccatgcggtcgctccttgcaagactgcccgtctcccacaccctggcaggatcacggggaa

SEQ ID NO: 174829 - DNA, 601 bp, Human
gatgaggggctgcctcgtggcagcctcccacaagagagggaggaaaatgagagatggccatgcggtcgctccttgcaagactgcccgtctcccacaccctggcaggatcacggggaattccaccaaggtgagatcagtctgtgatcagctttgcctccttggcctctgtggacacggacggaggagcaaggttgtcagggcacctgtgtgaagcagtttccctacctatgggacacacagcaagtgaggtctagagctgggttcctcaactctggcgctactgatgtttcgggctggatcrtcctttgcagggaaggctggcctgtgcattatgggatgtttagtggtatccctggcctctacccgatagatggccttcgcagtccctcccctagtcgtgacaaccaaaaatgtctccagccatcgtcaagtgtttcctgggggcacagtcacccctgaatggttgtgactgtgaccgttctagacccaattgctggtctagaatgcagggtgagggggacgcttacctcctgcacgctctaccctctgtctgcaggtgggtgggcttcgagcatgctggcttccaagggcagcagtacat

SEQ ID NO: 174830 - DNA, 601 bp, Human
gcagtttccctacctatgggacacacagcaagtgaggtctagagctgggttcctcaactctggcgctactgatgtttcgggctggatcatcctttgcagggaaggctggcctgtgcattatgggatgtttagtggtatccctggcctctacccgatagatggccttcgcagtccctcccctagtcgtgacaaccaaaaatgtctccagccatcgtcaagtgtttcctgggggcacagtcacccctgaatggttgtgactgtgaccgttctagacccaattgctggtctagaatgcagggtragggggacgcttacctcctgcacgctctaccctctgtctgcaggtgggtgggcttcgagcatgctggcttccaagggcagcagtacattctggaacgaggcgaatatccaagctgggatgcctggggcggcaacacggcctaccccgccgagaggctcacctccttccggcctgcggcctgtgctgtaagttctaccactgctgcatcccggggaggcccaagcccctcatgtgggcacttcggaatcaaaggttccagagttgaaattctcatgtcgccacttcaagctgtgtgacaag

SEQ ID NO: 174831 - DNA, 601 bp, Human
acagcaagtgaggtctagagctgggttcctcaactctggcgctactgatgtttcgggctggatcatcctttgcagggaaggctggcctgtgcattatgggatgtttagtggtatccctggcctctacccgatagatggccttcgcagtccctcccctagtcgtgacaaccaaaaatgtctccagccatcgtcaagtgtttcctgggggcacagtcacccctgaatggttgtgactgtgaccgttctagacccaattgctggtctagaatgcagggtgagggggacgcttacctcctgcacrctctaccctctgtctgcaggtgggtgggcttcgagcatgctggcttccaagggcagcagtacattctggaacgaggcgaatatccaagctgggatgcctggggcggcaacacggcctaccccgccgagaggctcacctccttccggcctgcggcctgtgctgtaagttctaccactgctgcatcccggggaggcccaagcccctcatgtgggcacttcggaatcaaaggttccagagttgaaattctcatgtcgccacttcaagctgtgtgacaagggctgttcagtctctttcctctcc

SEQ ID NO: 174832 - DNA, 601 bp, Human
actctggcgctactgatgtttcgggctggatcatcctttgcagggaaggctggcctgtgcattatgggatgtttagtggtatccctggcctctacccgatagatggccttcgcagtccctcccctagtcgtgacaaccaaaaatgtctccagccatcgtcaagtgtttcctgggggcacagtcacccctgaatggttgtgactgtgaccgttctagacccaattgctggtctagaatgcagggtgagggggacgcttacctcctgcacgctctaccctctgtctgcaggtgggtgggcttygagcatgctggcttccaagggcagcagtacattctggaacgaggcgaatatccaagctgggatgcctggggcggcaacacggcctaccccgccgagaggctcacctccttccggcctgcggcctgtgctgtaagttctaccactgctgcatcccggggaggcccaagcccctcatgtgggcacttcggaatcaaaggttccagagttgaaattctcatgtcgccacttcaagctgtgtgacaagggctgttcagtctctttcctctccaagcctcggtttcttcatcttgaaatggggca

SEQ ID NO: 174833 - DNA, 601 bp, Human
ggcacttcggaatcaaaggttccagagttgaaattctcatgtcgccacttcaagctgtgtgacaagggctgttcagtctctttcctctccaagcctcggtttcttcatcttgaaatggggcaatagtaccaatgttcttgggaagaagaacgtataacatctgaccagagcctgccttaaactctctgctcacagcaaccctggttgtgataggagcccctgccagttttgtgcccttttttttttgtgattcagggaccctgagagaatctgggtaccagggatggtagggccaagtggrgaggaaaggtttcatttcttgctcctaattcagcatcagtgctcctgatcttacattttactgctgtttttggagtgtgggtggaggtgggcattattattcccatctcaccaatgaaaacattgaggctcagaaaggtgtattttaggctgggcatggtggctcacacctgtaatcccagcactttgggaggccaaggcgggtagatcacttgaggccaggagttcaagatcagcttggccaacatggtgaaaccctgtctctactgaaaatacaaaaaaattagttgagtgtggtggc

SEQ ID NO: 174834 - DNA, 601 bp, Human
tttccaactgggagcctgctggtctgactgtgttccctgttcctgtagaaccaccgtgactcgaggctgacaatcttcgagcaagagaacttcctgggcaagaaaggagagctgagcgatgactatccttccctccaggccatgggatgggaaggcaatgaagtagggtccttccacgtccactctggggcgtaagtgtattcaaggctctacctggcaggggaggggctactgggaggggtaggtgtacctcctgtgaaaactgtgtgctggggacttttgtgctctgatgcccacattycagaggagaacactgaggcacagggaggtatcaggcagaatttgagggactgaaacccagatcaaactggtttgagcccagaagatatttatcagcccctgtaattagcttcaagcatagctggatccaggtactacagcaggtatctctctccccccacaacccccaacctgttgccctgcctgcctctgtgtgactatattcttagacaagctcttcctgtgtgaaggcaaaggtggcggcttcatcgttacatccagccctagggaaagacagtgtccaggctcagtgattctatta

SEQ ID NO: 174835 - DNA, 601 bp, Human
catgaactaggggttgcaaaatggcctacttctgtgacctgaggttgaaaccacaccaaaccaaatcccaggggactggacaccttgctccacaggatgcctttcagcccagaccacctcgagcaattttgagggtctgaggccatcctgctgccccagtgagcctccaaggacagctggttccctgctgctaagccagcccacttccttttcttctttttttttcttgctttcgataaactctaagcatgtgcgtgtgcaggtgtagcctgattgccaggtgtcccttcagctgtgaagyggtatggtttggttgttgttattgcacaactcaactataggtcccctttttctttctattcttttctttttttttttgatggagtctccctctgttgcccaggctggagtgcagtggcatgatctcagctcactgcaacctccgcctcctgggttcaagtgattctcctgcctcagcctcccaagtagctgggattacaggcgcccaccactacgcctggctaatttttgtatttttagtagagacagggtttcaccatgttggccaggctggtctcgaactcctgacctcaggtgatcc

SEQ ID NO: 174836 - DNA, 601 bp, Human
gccttctctgattgccccttcctccatcggccttggttgagcatcccccactgtcctctccccattagcagcacaactaacccaccacacagtcactgctgttttgctttggggtctccctctctctctgcactccctctctcccattacccagcccctccaaagaccaaggactcctccagggcagggcctgaggttgatcaatttctgtatctccagccccagccccagtacctgccacagagctgatgctcaggagacacttgcaaatccaaccctccacaacataggggaaaacttkagctaatcttctctcctcactaagcctcatgtttggttccttgtccacttgctgttccaagttgggacaacgttgccattcacatggaccaaggcacaattttctgccttctttgagcctcagtttccccagctgtaagaggaggggaggttcatataaccatgacccagcacttccacttctacctttggttgcccaagagaaactcctgtatgtgtgccccgggatgttgcgggaagtcagggaccccaaacggaggaactggctgaagccatggcagaagaacgtggattgtgaaga

SEQ ID NO: 174837 - DNA, 601 bp, Human
tgccacttaccaataggtgaccttgggtaagagactcaccccctctgagcctcagtctttccatctgtcaagtgggcataagaatagcctctgcctcctacagcactgtgaatcatctaggtgtggtcccgagtcagtgcctggcacctggtgggtgtgccacagatgcttatcattactcccaggcagctggacgcccaggagaggggacagcgagtggacacttcactctttgacctctctcagccctcggtaatgggctagagtttgttttttttttttttgttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccgggctagagttt

SEQ ID NO: 174838 - DNA, 601 bp, Human
atcaacctgagttgaatcctggctgtgccacttaccaataggtgaccttgggtaagagactcaccccctctgagcctcagtctttccatctgtcaagtgggcataagaatagcctctgcctcctacagcactgtgaatcatctaggtgtggtcccgagtcagtgcctggcacctggtgggtgtgccacagatgcttatcattactcccaggcagctggacgcccaggagaggggacagcgagtggacacttcactctttgacctctctcagccctcggtaatgggctagagtttgtttttkttttttttgttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcgtgatccacccgcctcggcctcccaaagtgctgggattacaggcgtgagcc

SEQ ID NO: 174839 - DNA, 601 bp, Human
gcacacgtcagacaccagctgcatctttgtttgaggagaaatactctgggtttgagtcactggtaccaaaaaaagcctgaaaacccatgctggccacatccggtagcttctgcttccagctgggttttggggctgagggtggagctgaggctgcgttgaccacactgagggtgcaggaggtagaaatggtcccgggtagcctccaggataagttggctaaattcaccgggcagggaggtgggtacgtgaccatcagagtcacctgccatgtttgggtgcccacaaggtaacaggcccatgytgtatgatctccctcagacctcagcataatcctgtgaggagtggtgagggccatccttctccccatttcaaagatggggaaactgaggcttgcacactgaacaaggcaaacaggggaagtcaggactcaaacccaggcttgtctgacctcaaagctcatctcggaatgggctcagaatacaggatgactggaacccttgcaggctttcaaagtgggggagacaagagcaaacgagctgcgtggatcttgtcctggggctgcccctccaccctgacctcagcacacacaggctggacatag

SEQ ID NO: 174840 - DNA, 601 bp, Human
gaatgcatggaacagatacagcacagagtaagcctccaaattaatactgttcctgattaaagggagaaggaaactggaggtctaggcttctggaaaaacagacactgatgtggtcttgccaccatgcccaaggtccccctaaaatctcccctatcttcttcagcaggaccagtgaggatctaaattttaaatgtttatatctatgccttttcttatctcccatggctcatttcaacccgcaagcagggagagagggtagggcaggaattttaatttataagatatggaaactgaggctaaraggggttaagtccccagcctaaggtcacatgatggtgttgggtgtcaggctgcagtctcctgggtttcaggcaggcaggcctcctcactttccccatgcctacctcaccctcttcattctttttttcccatggccctgccagcgcccacacagacccaggcccccggaccacaggcccgtttccatgcccatcaggcacggctccaaggcacacgtcagacaccagctgcatctttgtttgaggagaaatactctgggtttgagtcactggtaccaaaaaaagcctgaaaacccatgctg

SEQ ID NO: 174841 - DNA, 601 bp, Human
tttgttgcatctaccttgttgggagattatgagggcctaaaagagggaatgcatggaacagatacagcacagagtaagcctccaaattaatactgttcctgattaaagggagaaggaaactggaggtctaggcttctggaaaaacagacactgatgtggtcttgccaccatgcccaaggtccccctaaaatctcccctatcttcttcagcaggaccagtgaggatctaaattttaaatgtttatatctatgccttttcttatctcccatggctcatttcaacccgcaagcagggagagagsgtagggcaggaattttaatttataagatatggaaactgaggctaagaggggttaagtccccagcctaaggtcacatgatggtgttgggtgtcaggctgcagtctcctgggtttcaggcaggcaggcctcctcactttccccatgcctacctcaccctcttcattctttttttcccatggccctgccagcgcccacacagacccaggcccccggaccacaggcccgtttccatgcccatcaggcacggctccaaggcacacgtcagacaccagctgcatctttgtttgaggagaaatactc

SEQ ID NO: 174842 - DNA, 601 bp, Human
catctactttgttgcatctaccttgttgggagattatgagggcctaaaagagggaatgcatggaacagatacagcacagagtaagcctccaaattaatactgttcctgattaaagggagaaggaaactggaggtctaggcttctggaaaaacagacactgatgtggtcttgccaccatgcccaaggtccccctaaaatctcccctatcttcttcagcaggaccagtgaggatctaaattttaaatgtttatatctatgccttttcttatctcccatggctcatttcaacccgcaagcaggragagagggtagggcaggaattttaatttataagatatggaaactgaggctaagaggggttaagtccccagcctaaggtcacatgatggtgttgggtgtcaggctgcagtctcctgggtttcaggcaggcaggcctcctcactttccccatgcctacctcaccctcttcattctttttttcccatggccctgccagcgcccacacagacccaggcccccggaccacaggcccgtttccatgcccatcaggcacggctccaaggcacacgtcagacaccagctgcatctttgtttgaggaga

SEQ ID NO: 174843 - DNA, 601 bp, Human
tcagacttacacctgccctgccccgcctggctgattctccagccccagccggagagccactcaccattttgatgggccggaaggacatgagccgatcactgcggtagctgctcgaccatgtgttccagcgagggtactcgcccttctccaggatgaacatctccccgcggaagttggactgctcaaaggcgacccagctggatacaagaaggaccatgaggcagacaggagacatatggttagtagaagcccccactccctacttgcctttctctctcccctggcaaggcagccctgaggmcagtaggaaagtccaaagggggctgaacatgtctgggtttgattttaggctctgacacttacaggctgtgtgactatgggcaagtgactttacctctctgagcctttgtttctcatctacactcatatgcctgtttccttggagttggtgaaggattaagtgagataaatgtgtgtgattatctgagcacactgtttctctagatgtaaggttcatacatgcttcaagtactatcaggacttggagccaaggaacacatagacatttgaaacttgacgccagctaggagaaaggctcgtt

SEQ ID NO: 174844 - DNA, 601 bp, Human
gctttgaatgtggcccaacacaaatttgtgaactttcttaaaacattatgagattttttttgcaattgttttaaagctcatccgctatcgttagtgatagtgtattttatgtgtagcccaagacaattcttccagcgtgggccagggaagccaaaatattgggcacccctgaattagatggttggatctcagccctggctgcacagacggactacttagagggcatagaaaagatagcagtgccggagttccagccctagagattcagaattaattggtctggggtggggtctaggctttragatttctaaacatttctaataacatattttatttaaacaaatatacctaaaatattataatttcaatatgtaaccaatataatgatatcaatgcattgttgacattctttaaaattttttttactatgtattcaaaacctaatatgtattttacacttatgacacatctccatttagccaaaattcaagtgtccaatggccacatatggctactgcctattatgttgaatagcaagcttctagaagctactggaaatgccctggttgatcactcttccaaacaaaccccttaacatagg

SEQ ID NO: 174845 - DNA, 601 bp, Human
gcagaggttgcagtgagccaagattgtgtcactgcactccagcctgggtgacagagcaagactctgtctcaaaaaacaaacaaacaaacaaccaggcccacccttgaatgtgggcacatgattcagttctggcttgcacttatttttaatgctttcatgaccctgtatcttgtttttaaagttcgtctgttatttctgagggcagggatcatccatcttttcaaaagtcatcatgcactgttttaggcccaagggtttgaagagccaaagagatgaacaggaaatagcagagtgatgccgracctcagtgtctaggttcaaacccacagaccttggttcaaatcccagccccagcaactcccagctgtgtggccttaggccagtcattttctacttctgagtctcagtttccttgcttttaaaatgcatgttatcatagcctgtagcataggacagttgtagggattatgtaaaaggcaggtaatatacccagtacgtagttggtgcttaaaaatggatgctgtgattatctactgttattatctactgttattcaccaccactaggaggaagaggagcccagaacgtaagtgcatccttc

SEQ ID NO: 174846 - DNA, 601 bp, Human
ccaacctgggcaacagagcgagactccgtctcaaaaaaaaaaaaaaaaaaacaaaaaacaaatcctgcctctgacatttatgcactggtgatcttggacattttactctgcctccttcagagcctcagtttgttcatctgtagaatggggttattgccaggcatggtggctcacatctgtaatcccagcactttgggaggccgagacaggtagatcacctgaggtcaggagtccaagaccagcctggccaacatggtgaaaccccatctctactaaaaatgcaaaaattagccaggtgcartcacatgtgcctgtaatcccagctactcgggaggctgaggcaggagagtcacttgaacctgggaggtggaggttgcagtgaggcgagatcacaccactgcactccagcctgggcgacagagcaagactgtctcaaacaacaacaacaaaaaagaatggggttactattgcttcgtgggattgtcatggctactcaactcacggttcagtccaactataaaacaggcctggccgggcgcggtggctcacgcctgtaatcccagcactttaggaggccaagatgggtgggatcacaaggtca

SEQ ID NO: 174847 - DNA, 601 bp, Human
gccgggtgccatggctcatgtctgtaattccagcactttgagaggcccaggtgggaggactgcttgaggccaagggttcaagaccagcctgggcaacatagcaagatcctgtctctcaaaaaaataattttttttttaatttgccaggcatggtggtgcatgcctgtagtctcagctacttggaaggctgaggcaggaggattgcttgagcccaggaagttgaggctgcagcgagatatgattacaccactgcactccagcctgggtgacagagcaagaccctgtctcaaaaaaaaaaaaagtatttattatttttaaaattatgatcagggacaaaaaggctcagagaggtcaagcttattgatcaacatcacacagccagggaggggcagaacctttcagagaaacacttcattcctaagcagtgtccctgtgccatcaggagtttaaccaattgcccttttgtaaatgcttcttacaaaccaggtgaaacgtggaacattggtggaacacagatctaggttcaaatcctgcctctaggccgggtgcgatggctcactcctataatcccagcactttgggaggccgaggcgggcagatc

SEQ ID NO: 174848 - DNA, 601 bp, Human
ccacaagggcatccgcgagcagggccggtacctcaacagccggccctccatccagaagcccgaggtcttcttcctgcccgacctgcccaccacgccctatttctcccgggacgcacagaaacatgatgtggaagtgctggaacggaacttccagaccatcctgtgtgagtttgagaccctctacaaagctttctcaaactgcagcctcccgcaaggatggaaaatgaacagcacccccagcggggagtggttcaccttttacttggtcaatcagggggtttgtgttcccaggaactgtagraagtgcccacggacgtaccgcttgctcggaagccttcggacctgtattgggaacaatgtttttgggaacgcgtgcatctctgtgctgagccctgggactgtgataacggagcactatggacccaccaacatccgcatccgatgccatttaggtatgttgcagggacaggggtctcccggcatgcacatttgcaagctcagcccctctccatcaaaacatcgcgaaagctcaaatggtcagaattgcgccttttcgcattgttcacttttagcaaaaactgatgaattgcatgtaaacaat

SEQ ID NO: 174849 - DNA, 601 bp, Human
gaaacttgtctcctgtaactgaggaactaaattttaatttaatttaaatagcagtgacacatacggctagtggctaccgtatggggacagtgtcgttctagagccaaagacttgttaaaatgattaccgagcttcataatgatgtccaggaggctgtgaaagatacttaagcatctttgcagtcatcaaggatgaaatgatccttggtgataagcttgttttactccgattctgagaaaattggtcgtatgcgtactgtgtgtgcggctgtggttttgcaaacaaagactggagttagacrgcctttgtttgcatcttggccccaccacgagctgtgctactgtaggcaagtcatttcacctctctgagcctcaatttcactatttgggaagtggaggtaaaaagatcttctcctaaagagttattctgaggatccaatcagataatgtgtattgtatgtatgcacacagagcctaaaatagagcaagtattcaataaaagtaggcttaaaacaacttaatcatggaggtattagttccccagaatgccttattcctggtgagtggcgataaaaagctcgtctctgggatggtggcatcac

SEQ ID NO: 174850 - DNA, 601 bp, Human
gggaggtggcctgaattcctggtcagcagtcagccgtgagactttgagcaggtcactgagtctctctctgcctcagttcttcatctgtaaaatggggagatggtacttacttcacaggattgttgagaggattcaatgagtggcatcttacatggccccttggcaggattcctggcacgtgacagcatttgatgaatgggagctagtagctattatcaaggactgtgttggaccatgtgaaaaatgatccataagacatagaccctgcccccaggaaacagtgggaaaggaacaggcttcrgaagcaaacagatctggactcaggtcctggcctcgccccatttgctgagtgaccttgggcagggctctgaacctccttaagcctccgttttatcttctctaaaacagagatgacgattcccacttgctggctgttttgaggagtgggaagtaatatgtgtaaaatgcttggcaggtagagggcagtggacagtaagctaatctaagtgatgggatgataatccaggtgatggtcattagcaaaactgctgtgcgaggccccaagcctcacttggctgcagacggggtgccctggggaggt

SEQ ID NO: 174851 - DNA, 601 bp, Human
cagtagtgtgggctgaggttggacaggtcaggtgggagcaaacctcagaggcccttgatgccaggcttgagaatggaggccgtgggcaatggggagtgatgctcttcttttgaaaggtttgcctttatgtattgttttaaaacttcagaatgacatctggggaagggcatttgaggactgatgtggtagaatttcaaagaggtgtgagtaggaagtgatggtagcaaggaaaatctggggtttgctttctgtagattaacacttgttgttcatctgtatgatatgcatgcatgtgtgtgtrtgtgtgtgtgtgtgtaaaacatgcccacgctggctcacactgtggcctgtggcctgtcattcctttctcagcccagctaggtacttgccagaaaaagtaggccctccatgttcctgtagatagcaggaaaccttcttggaagacgtcccactgtggcgtggcttgttctccacggccaaggcgagctccctggttgggttttctcagcgtttccttctttacactatcatgcccacattaatatccacccaggaaggaaacaaaggtgtgtcggatttatgtgaccttgtgtgttgacag

SEQ ID NO: 174852 - DNA, 601 bp, Human
acaggtcaggtgggagcaaacctcagaggcccttgatgccaggcttgagaatggaggccgtgggcaatggggagtgatgctcttcttttgaaaggtttgcctttatgtattgttttaaaacttcagaatgacatctggggaagggcatttgaggactgatgtggtagaatttcaaagaggtgtgagtaggaagtgatggtagcaaggaaaatctggggtttgctttctgtagattaacacttgttgttcatctgtatgatatgcatgcatgtgtgtgtgtgtgtgtgtgtgtgtaaaacawgcccacgctggctcacactgtggcctgtggcctgtcattcctttctcagcccagctaggtacttgccagaaaaagtaggccctccatgttcctgtagatagcaggaaaccttcttggaagacgtcccactgtggcgtggcttgttctccacggccaaggcgagctccctggttgggttttctcagcgtttccttctttacactatcatgcccacattaatatccacccaggaaggaaacaaaggtgtgtcggatttatgtgaccttgtgtgttgacagagagggagtccagagaatgagg

SEQ ID NO: 174853 - DNA, 601 bp, Human
tggcctgtggcctgtcattcctttctcagcccagctaggtacttgccagaaaaagtaggccctccatgttcctgtagatagcaggaaaccttcttggaagacgtcccactgtggcgtggcttgttctccacggccaaggcgagctccctggttgggttttctcagcgtttccttctttacactatcatgcccacattaatatccacccaggaaggaaacaaaggtgtgtcggatttatgtgaccttgtgtgttgacagagagggagtccagagaatgaggtcagaagcaggataagcctgstgcgtacctggtggccacacctctgctggttacctggctgaaggtagaggcacctgcagttccagaaccgtgctcttgaaatgccaatgcttgcttttcttctgccttctgcctgagctgtgactgatggaattgtccctgtggaccactgaagacccagccactgctcctcactaacacagcccatttgttcgagacatatttgctgagccctgctgtgagctacttctagaggtggcatcacctagtcccgacttcatatgggaccacaggacagcttcaggcccaccccctactcag

SEQ ID NO: 174854 - DNA, 601 bp, Human
tcagcccagctaggtacttgccagaaaaagtaggccctccatgttcctgtagatagcaggaaaccttcttggaagacgtcccactgtggcgtggcttgttctccacggccaaggcgagctccctggttgggttttctcagcgtttccttctttacactatcatgcccacattaatatccacccaggaaggaaacaaaggtgtgtcggatttatgtgaccttgtgtgttgacagagagggagtccagagaatgaggtcagaagcaggataagcctggtgcgtacctggtggccacacctctrctggttacctggctgaaggtagaggcacctgcagttccagaaccgtgctcttgaaatgccaatgcttgcttttcttctgccttctgcctgagctgtgactgatggaattgtccctgtggaccactgaagacccagccactgctcctcactaacacagcccatttgttcgagacatatttgctgagccctgctgtgagctacttctagaggtggcatcacctagtcccgacttcatatgggaccacaggacagcttcaggcccaccccctactcagcattgtacacaatgctgggatattc

SEQ ID NO: 174855 - DNA, 601 bp, Human
agcctggtgcgtacctggtggccacacctctgctggttacctggctgaaggtagaggcacctgcagttccagaaccgtgctcttgaaatgccaatgcttgcttttcttctgccttctgcctgagctgtgactgatggaattgtccctgtggaccactgaagacccagccactgctcctcactaacacagcccatttgttcgagacatatttgctgagccctgctgtgagctacttctagaggtggcatcacctagtcccgacttcatatgggaccacaggacagcttcaggcccacccccyactcagcattgtacacaatgctgggatattccagatgcactgccacaaacttccagaaaaccacctctgaaactcaccaggcagatgttaccagggaggcagatacttcatgaaaatgcatgaatatgttcagcaaattctagctaaagaagcacagttagactcttgtttttcttttctgcatgtcatcagatttctaggtggtctagccgggtggtaacagtagatcagctcatgttccccttgcccaccctgagtgcccggttgccagccgcctgaagtgggggccactggtggaca

SEQ ID NO: 174856 - DNA, 601 bp, Human
gtacctggtggccacacctctgctggttacctggctgaaggtagaggcacctgcagttccagaaccgtgctcttgaaatgccaatgcttgcttttcttctgccttctgcctgagctgtgactgatggaattgtccctgtggaccactgaagacccagccactgctcctcactaacacagcccatttgttcgagacatatttgctgagccctgctgtgagctacttctagaggtggcatcacctagtcccgacttcatatgggaccacaggacagcttcaggcccaccccctactcagcatygtacacaatgctgggatattccagatgcactgccacaaacttccagaaaaccacctctgaaactcaccaggcagatgttaccagggaggcagatacttcatgaaaatgcatgaatatgttcagcaaattctagctaaagaagcacagttagactcttgtttttcttttctgcatgtcatcagatttctaggtggtctagccgggtggtaacagtagatcagctcatgttccccttgcccaccctgagtgcccggttgccagccgcctgaagtgggggccactggtggacacagccctttc

SEQ ID NO: 174857 - DNA, 601 bp, Human
gcccattcctaaaggccttcgccacctgaaccagccagtaggggcacacgccaaaggaaaacgtagcctctgagtccctccatctgggcgtctttacagccctgactcccccagctgctgttaaccatagtgggaaatcatggcttctgtcaggatgagcagtctcagctgatttaatgaaatgtactattgagagttgaaacatattagggtcctcttagagggacagaactaataggatatatatatacacacagatatatacacacatacatatatatacatatatatacacacacayatatatatacatatatatagatacacacatacatatatatacatacatatatacacatacatatatatacatacatatatacacatacatatatatacatacatatatatacatacatatatatacacacatatatacatatatatatacacacatatatatacatatatatatacacatacatatatatatatacacatacatacatacatacacacacacacacatatatatataaaggggagtttattaagtattaacccacatgatcacaaggtcccacaataggctgtctgcaaa

SEQ ID NO: 174858 - DNA, 601 bp, Human
tgagggtatggctcagagaggctgagtgacttgcccaaagtcacacagcacataagagtcacaaccagtcgtctgtccccaagtcctccgtccttctgtctcctccatgtggcctctttatttgaattattactgtgaacgtacttcctggaaccattatttctggttcaaagaatacattaaaatactctggctgctggaaggaaagctatttcatttttatgctaaaggacattaaatcagaggggaatgccaactggcccagggtcattgtggtcacagtgagtcactgaagacagaygagaccaccacccatcccagctcctcttccaggactctgcttccccctgggtgggccttcctgagagctgttgggctgacccaaccccttctgaaatcattagatggccacggtggccccttcttttctggacatcaaggtagtgatgggggccaagtgtttctgcagacccttgtgttggaaagggcgactgagggtcacacatggcagtgttccaaccggaccccactggcctttgaagcatacggcttattttttattttttatttttatttttgagacagagtctcactctgttgc

SEQ ID NO: 174859 - DNA, 601 bp, Human
cctctttatttgaattattactgtgaacgtacttcctggaaccattatttctggttcaaagaatacattaaaatactctggctgctggaaggaaagctatttcatttttatgctaaaggacattaaatcagaggggaatgccaactggcccagggtcattgtggtcacagtgagtcactgaagacagatgagaccaccacccatcccagctcctcttccaggactctgcttccccctgggtgggccttcctgagagctgttgggctgacccaaccccttctgaaatcattagatggccacrgtggccccttcttttctggacatcaaggtagtgatgggggccaagtgtttctgcagacccttgtgttggaaagggcgactgagggtcacacatggcagtgttccaaccggaccccactggcctttgaagcatacggcttattttttattttttatttttatttttgagacagagtctcactctgttgcccaggctggagtgcagtggtgcgattcgcccaggctggagtgcggtgatgcaatctcggctcactgcaaccttcgcctcctgggttcaagcaattctcatgcctcagcctcc

SEQ ID NO: 174860 - DNA, 601 bp, Human
ggtgaaggctgcagtgaactatggtggagccactgcatttcagcctgggcaacagaacaagaccttgtatctaaaaaaaaaaaaaaaaaaaaaaagatgtcaggccaggtgctgtggctcatgcctgtaatcccagcactttgggaggctgaggcaagcaaatctcttgaggtcaggagttcgagatcagcttggccaacatggtggaaccccatttctattaaaaatacaaaaattcggccaggtgcagtggctcacgcctgtaatcccagcactttgggaggctgaggcgggtggacaygaggtcaggagttcaagacccgcctggccaagatggtgaaaccccatctctactaaaaatacaaaaattagcctggcacagtggcaggtgcctgtaatcccagctactcgggaggctgaggcaggagaatcgcttgaacccaggtggcagaggttccagtgagccaggatcgcgccactgcactccagcctgggcgacagagtgagactctgtctcacaaaacaaaacaaacaaaaaaattagccgggtgaggtggtgggtgcctgtaagctactccagtgcctcccagctactccggag

SEQ ID NO: 174861 - DNA, 601 bp, Human
ctattaaaaatacaaaaattcggccaggtgcagtggctcacgcctgtaatcccagcactttgggaggctgaggcgggtggacacgaggtcaggagttcaagacccgcctggccaagatggtgaaaccccatctctactaaaaatacaaaaattagcctggcacagtggcaggtgcctgtaatcccagctactcgggaggctgaggcaggagaatcgcttgaacccaggtggcagaggttccagtgagccaggatcgcgccactgcactccagcctgggcgacagagtgagactctgtctcacaaaacaaaacaaacaaaaaaattagccgggtgaggtggtgggtgcctgtaagctactccagtgcctcccagctactccggaggctgaggtaggagtatcatttgaacccgggaggtggaggttgcggtgagccgagatcacaccactgcattccagcctgggcaacagagagagactccatttcaaaaaaaaaaaaaaaaaaagggaaaagaaaaaaagatgcaaaaggaggtaaagaagctcccttgggcctgttttataaggatgctgctcccattaggaccccaccttcatgatct

SEQ ID NO: 174862 - DNA, 601 bp, Human
attaaaaatacaaaaattcggccaggtgcagtggctcacgcctgtaatcccagcactttgggaggctgaggcgggtggacacgaggtcaggagttcaagacccgcctggccaagatggtgaaaccccatctctactaaaaatacaaaaattagcctggcacagtggcaggtgcctgtaatcccagctactcgggaggctgaggcaggagaatcgcttgaacccaggtggcagaggttccagtgagccaggatcgcgccactgcactccagcctgggcgacagagtgagactctgtctcacaaaacaaaacaaacaaaaaaattagccgggtgaggtggtgggtgcctgtaagctactccagtgcctcccagctactccggaggctgaggtaggagtatcatttgaacccgggaggtggaggttgcggtgagccgagatcacaccactgcattccagcctgggcaacagagagagactccatttcaaaaaaaaaaaaaaaaaaagggaaaagaaaaaaagatgcaaaaggaggtaaagaagctcccttgggcctgttttataaggatgctgctcccattaggaccccaccttcatgatctga

SEQ ID NO: 174863 - DNA, 601 bp, Human
aacccgggaggtggaggttgcggtgagccgagatcacaccactgcattccagcctgggcaacagagagagactccatttcaaaaaaaaaaaaaaaaaaagggaaaagaaaaaaagatgcaaaaggaggtaaagaagctcccttgggcctgttttataaggatgctgctcccattaggaccccaccttcatgatctgatcactttccaaaggccccacctcctaacaccatcaccttggggtcaggtttcaacatgggaatttgcagggacacaagcccacaagccttcagaccatagcacrggctccagaggtgtgaggcaggtcaggtgctttagaagtcaaaaactctcagtaaggcaaatcaccccctatctcctggccttccctgaatcttgcctgccttcactctcctttctctggttttcctacaaggtctgaaaactccaaatggctgtgagctggtggtggggggagagccccagtgctgggcagaagggcgctgccttctctttgatgactctttcctgcatgctgcgttccatgaaggtgagtggctgcctttcccacttcctttttttcaatgaatagacttttattttt

SEQ ID NO: 174864 - DNA, 601 bp, Human
ggaatgagaacagatttttcataatccatgacagtgagtcttctgcctttgtcctaatttatatacaagaatttagttcctccgaatttttttttttttttggagaaggagtctcgctctgtcacccacgctggagtgcagtggcgcaatctcagctcactgcaagctccacctcctgggttcatgccattctcctgcctcagcttcctgagtagctgggactacaggtgcccgccaccacaccaggctaatatttttgtatttttactagagacggtttcactgtgttagtgaggatggycttgatctcctgaccttgtgatccacccgcttcggcctcccaaagtgctgggattacaggcatgagccaccacgcccggcctcctctgaattatttaatagtggccgggggaagcttttgagactggaaagaactatgataaactaaaggttctatttcaatacttaaatattgacttccagattaatattatagaaataaaaattaaaatctagaattataaaccttactggatgggtgagcatttggagcatacctttcaaattcattactgaaagtatgtataaagaagtttacatc

SEQ ID NO: 174865 - DNA, 601 bp, Human
ttaaaagtaatctgtcagtacgatcctgagtgtcttcaccacttacagcacttaggagaacactacaaagaaaaaaatgttgaaaacaattttagacagtttcctactttgccatgtgattaaaaaccaaaacaatgttcatcagaaaacagtgcaaattcttcccacaatttgtacacactgcaaaggtgtcactatctactccctgaattcccaatctgcattatgttcatttaaattggtatttgcccctctatcttaaggctgtcattttccacttctatgaatttttattacctayataaattaactggttactatgcatttaaaacttcaaagatttgcatttttttctgataaacatctacctcaaaaggaaatgaagacccatgtaaaagaaaacaccaagttaactatcaaagcatttattagaggtctaacccacatacctctcaggagtttgaatattatctagatcctctatatctaagaccatctgctgagattcttctttagcagcttcagttttttcctctgccattttcaaatatgccctaacaacatcctccagagattttatgttcacctaatccaaaaaaac

SEQ ID NO: 174866 - DNA, 601 bp, Human
tgtatgaaagtgaaaattcagctgggcgcgatggctcacgcctgtaatcccagcactttgggaggccgaggtgggtggatcacaaggtcaggagattgagaccatcctggctaacacggtgaaaccccatctctactaaaaatacaaaaaattagccgagcatggcagcgtgcgcctgtagtcccagctgttgggaagactgagggagaagaatggcgtgaacctgggaggcggagcttgtagtgagccgagattgcgccactgcactccagcctgggccacagagcaagactctgtctcaaaaaaaaaaaaaaaaaaaaaagaaagaaaaaaagaaagaaagtgaaaattcaggctgggcagagctgtaatcccagcactttgggaggctgaagcaagaggatcacttgagtccagaagtctgagaccagcctgagcaacaatgcaagatcccagctcttttttaaaaactaaaaataaattaaaaaaaaaaaaaaaagtagagaactcaagttcactaaaaaaaaaaaaaatggaaaagtttattttttcagttatacagagaattccaaaataactttaaaatgtctttcattattac

SEQ ID NO: 174867 - DNA, 601 bp, Human
cctgacctcaggtgatccacctacctcagcctcccaaagtgctgggattacagacgtgagccaccacacccatcctcgggtatatatagcagtgcgagaacatactaatacacctagcctcttcatatttaccacacacagcttaattagttttcctagagccttccatgaaataagccatgactcttcttgcccatcattacttcttctcttactaactggcccacggtattccccagagccaacccaagtcctgctagatcaaaactcccaccaatttaacccctgctcacccactggygcggaactgcctcaagtgaacagtgattgacaccagtgcttccctgtccatacatcagaacccttggcactgaatcagaattcccagtatttaatcatgagttattaaacctgaccacaaagttttctgcccaaagctacaaaaatcctcaaattaatactaaccatatcattaataaggccaattcgtgtcggtggggcttgaagacctagtagtgttgcaaggcgacgctgtttttcaactataatgccatccatatccagaagtcgagcaatatccgtacgctcaggagtaataggg

SEQ ID NO: 174868 - DNA, 601 bp, Human
tgcattttaaaaagtatttcacatacaatttcactgaataaccctaattaagtccatactatttagtaacatcaaatgaaagtttaaaagagaaaaaagttgaaaatattttagttcttcagacattgaacatcagacactgaaggtaagtctaccttaccttctcccctagtgatgtggtttggatctgtgtacccacccaaatctcatgttcaactgtaatctccagtgttggagtgtggcctggtgggaggtgactaaatcatgggggcaatttctaatgatttagcaccatccccgyaggcccatcctcatgataagagttctcccaagatctggtgttgtttaaaagtgtgtggtaccttccccctctgtcttcctcctgctccagccgtataagccatacctgcttcccgttccccttccaccatgatggtaattttcctgaggtctccccagatgcagaagccactatacttcctatacagcctgtggaaccatgagccaattaaacctcttttctttataaattacccagtgtcaggtacttcttttttgtttgtttgtttgaaaaggagtctcactctgtcgcccaggctgg

SEQ ID NO: 174869 - DNA, 601 bp, Human
atgaaactctaaaaaacacaactacaaccaattaaatattcacaaagacaactactgtggccaatagaatattttattaccaataacaaggaaaataccagttttacttttatataaattatcacacaaaaattatcatggcagcactatttctaatagccccaaactggggagaattcacatatggtgtattcataaaataaacaaaaatgctcaaaaaagaacagctacatagaacacatgaataaatctcacaaacatagcggtgagaaaagaatttcacatattaccccatttatayggacttcaattttaccatggaatatgtcattttttttaggaactgttaacccaaggacaaaataactgctgggatagagcaaagcacagaagtgtgtacccatagagagtgggtgacaaaactgaggcaaatattggcagatcgcatccccaagcaaggagggcacccacacatgggagcactcaggtctaaggttaactctaatgtaaaatgggtacaaggctgaaatcctacaacattctaacacttcctccttataagcatccatatatctttactgcaataaggtgtggtatatgc

SEQ ID NO: 174870 - DNA, 601 bp, Human
acaaaactttttttatttttttatttttacctgctgcagaaggcggaggatggtgttgttttgcagttgtggcacatactgctgcaattccggttccttttcaggttgttccctaacccaatttagaacctataaaatccattaaattgaaagagaatcacactttctacataagagatactaaaacatctaaaactcttttttttttaatatacaaaaacatcatccaatgcaaagaaatacaaaatgtatcatgaagctactgatacttgtttgaaggtgactggcagcaatggctaarttagtcatgctgctaattaacctccaaaggtttgctgagcacatcagatatatcttttctcttgaaataaagaaaaaagacaatgaaatgtgcactgaattccaacacataggacaaaacttctctcttaacaaatatgaatacaacccaaaactgcaagaaggccaactctgtggtaacaaccagaacttaaatacaaaggcttacctttgtgactcgctcacagagttttaatgggttaaattctacttcaagccaattgtaaaggtctttcacttctgggacaacatattgtagtac

SEQ ID NO: 174871 - DNA, 601 bp, Human
gttggaaagcatcaacaaaaggaaccaaagaagtcaaacgagaaaactcaatgctctgataaatctgtgacacctgcatagaaaacaaagggttaataacactagccactgtttattcagcactttttatgtgcaatctcatgacagtcatgggaagtagaaattatgccagagaatttatgttagcagtacattgttaaagccagaatgctaatcccagaccatcgactctaaactccatgctttgagaaccattatcatactattcctcaaacctataatcttttcaaatcctagttgytgtaaaacaaaaaagcctaaaaacctgctacttaccgaatatatttaaacacttcttatagaatttttgtctgaaggagactggcagcattactatttatagttatactgctaattagccttcaattatttgtatagcacataagaaataacactactcacataaaagaaagcaggtcaatgaaatgtgcacaaatactgagatgaaaatataataaaacgccctccttcccaaatgcaacaaatggaaaacaaaatgggagcacttactgacttaagcccctggactaaaatatatgaa

SEQ ID NO: 174872 - DNA, 601 bp, Human
ttccagttggaaagcatcaacaaaaggaaccaaagaagtcaaacgagaaaactcaatgctctgataaatctgtgacacctgcatagaaaacaaagggttaataacactagccactgtttattcagcactttttatgtgcaatctcatgacagtcatgggaagtagaaattatgccagagaatttatgttagcagtacattgttaaagccagaatgctaatcccagaccatcgactctaaactccatgctttgagaaccattatcatactattcctcaaacctataatcttttcaaatcctrgttgttgtaaaacaaaaaagcctaaaaacctgctacttaccgaatatatttaaacacttcttatagaatttttgtctgaaggagactggcagcattactatttatagttatactgctaattagccttcaattatttgtatagcacataagaaataacactactcacataaaagaaagcaggtcaatgaaatgtgcacaaatactgagatgaaaatataataaaacgccctccttcccaaatgcaacaaatggaaaacaaaatgggagcacttactgacttaagcccctggactaaaatat

SEQ ID NO: 174873 - DNA, 601 bp, Human
ttttcctttgcattcacaacttgattagtgcaagaggcctagctttcaacatgccttcctcactaagcttaatcatttctagcatttgatttaaagtgagacaggtgactcttctattcagttgaacacttaaaagccattgtggaattgttaattagcctaatttcaatattacctctcaggagctgggcacagtggctcacgcctataatcccagcactttgggaggctgaggcgaacagaacacttgaggtcaggagttcaagaccagcccagccaacacggtgacctcatctccackaaaaacacaaaaactagccgggcatggtggcaggcgcctgtaatcccagctacttgggaggctgcggccagagaatcacttgaacccggcgggggcagaggttgcagtgtgccgagattgcgccactgcactccagcctgggcgacagaatgaaactctgtctcaaataaatatatacatattagtgtctcagggaataataggaagggtcaaggacagggagagacagagagtaagggaatggccagtcggtagaacagtcagaagagacttaatttacagattaagttcaccgccttc

SEQ ID NO: 174874 - DNA, 601 bp, Human
gagaatcacttgaactgggaggcggaggctgcagtgggctgagattgcgccattgcactccagcttgggcaacaacggcgaaactccatctcaaaaaaaaaaaaaagcttttcctttgcattcacaacttgattagtgcaagaggcctagctttcaacatgccttcctcactaagcttaatcatttctagcatttgatttaaagtgagacaggtgactcttctattcagttgaacacttaaaagccattgtggaattgttaattagcctaatttcaatattacctctcaggagctgggcasagtggctcacgcctataatcccagcactttgggaggctgaggcgaacagaacacttgaggtcaggagttcaagaccagcccagccaacacggtgacctcatctccactaaaaacacaaaaactagccgggcatggtggcaggcgcctgtaatcccagctacttgggaggctgcggccagagaatcacttgaacccggcgggggcagaggttgcagtgtgccgagattgcgccactgcactccagcctgggcgacagaatgaaactctgtctcaaataaatatatacatattagtgtctca

SEQ ID NO: 174875 - DNA, 601 bp, Human
ttcgtgacattcgattcttatgttcaagagccttttcacgttctagctgcattgtagtaatctgcaagtacaaatattgtgaaatttcaatgcacttttttttttactcattaaccccaaattactgagaaatactcttgaaaaattagaagctgctccactgccccttctgtcatgccataaaaatgaaaacgttaactacatccatgtcaataggtccccagaaggcaattacgggcaagaggtagacaaagtaatcctgaggcatttaggagagacagttttcatttagccccatgayaccaggaactttataaaggaaaaattatgatacacggacacaccttggaggcactgcaggtttggttctagaccaccacaataaagaatattgcaataaagcaagcaacgcagattttttggttatccgatgcatatagaagtttgcagtctattaagtatacaatagcatgtctaaaacaccaatgtacaaaccttaattttaaaatactgtaagtcagatgcagtagtacgctgaggcaagagaatcacttgagcccaggagtgcaagatcagcctggacaacatggtgagactcctg

SEQ ID NO: 174876 - DNA, 601 bp, Human
aagctcacctcataaacagactgccgtgcagctttgagtcgcattacgaataaatctctgtcttcaagcattcgtgacattcgattcttatgttcaagagccttttcacgttctagctgcattgtagtaatctgcaagtacaaatattgtgaaatttcaatgcacttttttttttactcattaaccccaaattactgagaaatactcttgaaaaattagaagctgctccactgccccttctgtcatgccataaaaatgaaaacgttaactacatccatgtcaataggtccccagaaggcaattacgggcaagaggtagacaaagtaatcctgaggcatttaggagagacagttttcatttagccccatgataccaggaactttataaaggaaaaattatgatacacggacacaccttggaggcactgcaggtttggttctagaccaccacaataaagaatattgcaataaagcaagcaacgcagattttttggttatccgatgcatatagaagtttgcagtctattaagtatacaatagcatgtctaaaacaccaatgtacaaaccttaattttaaaatactgtaagtcagatgcagtagt

SEQ ID NO: 174877 - DNA, 601 bp, Human
taacttccaaatgaccattaacttgtcagcaggccaaattttaaaacatttaaattgttgatattacctacctccagtgggtttgtctttatacaaaataattcaatggtcaaattagaatctaagcccaggacattttgatctagttttttcatttctaacaaaaacagtaaacaaaacttgtattaaattatgcattcaactttcacctttagaacaattttgatgattgttttgcttatgaaatatcatccaaaaatttctattatttgaatgaccgttacacatagtaactcaatamagaatataccaatttgttaagggagaacccttaggccaatactagaaagctcatgaataaacatttcccaaaaatcagcaagctcacctcataaacagactgccgtgcagctttgagtcgcattacgaataaatctctgtcttcaagcattcgtgacattcgattcttatgttcaagagccttttcacgttctagctgcattgtagtaatctgcaagtacaaatattgtgaaatttcaatgcacttttttttttactcattaaccccaaattactgagaaatactcttgaaaaattagaa

SEQ ID NO: 174878 - DNA, 601 bp, Human
gattacaggtgctgccaccgcacccagctaatttttttatttttagtagagacagggtatcaccatgttggccagactggtctagaactgacttcgcgatccgcacgcctcggcttcccaaagtgctgggaattataggcatgagccaccacgcccggccaaacgatgatgtctttcatggaactcagcaacagtctctcttctgtagcaaactcagcagtgctatggacaaaactttcatgacacgcatgcgcaaaagtatgcttaagcctgtaaaattccatctttgctaagacaagtwtaattcttccccccttaggtgccttctgttctttgggaaaactaccacattaaaaagagcggtgaaaatgggctgggtgcggtggctcgcgcctgtaatcccagcactttgggaggccaaggcaagcagattgtttgaggtcaggagttcaagaccaacctggccaacatggtgaaaccatatttctaattttagtagtaaattttgtattttctactaaaaatacaaaaatcagccaggcatggtgttgggcgcctataattccaactacttggaagactgaagcaagagaatggcttg

SEQ ID NO: 174879 - DNA, 601 bp, Human
ttcacgattctttttttttttttcccctgagacagagtcttgctctgtcacccaggcttgagtgcagtggcgcgatctcagctcactgcaacctccacctcctgggttcaagcaattctcctccctcagcctctcaagtagctgggattacaggtgctgccaccgcacccagctaatttttttatttttagtagagacagggtatcaccatgttggccagactggtctagaactgacttcgcgatccgcacgcctcggcttcccaaagtgctgggaattataggcatgagccaccacgccyggccaaacgatgatgtctttcatggaactcagcaacagtctctcttctgtagcaaactcagcagtgctatggacaaaactttcatgacacgcatgcgcaaaagtatgcttaagcctgtaaaattccatctttgctaagacaagtataattcttccccccttaggtgccttctgttctttgggaaaactaccacattaaaaagagcggtgaaaatgggctgggtgcggtggctcgcgcctgtaatcccagcactttgggaggccaaggcaagcagattgtttgaggtcaggagttcaagac

SEQ ID NO: 174880 - DNA, 601 bp, Human
aaaaacttatgagacacacaaagacattctgaaaactactgatcaagaaacaaaaagtactcacaaaggggaaaacatgatgcagtgtaaacatacttgagactaaataatgttcgctaatatggatggaaaacttaaagtaactgttaagtgagtactaagaggaaagataatgtgtaaatatctagaagcaaaaatacccagtccactgcaataaaatataagttaaggtatggtcatgattttgttttgttctgaagaggcaaaggaaagttgtaatttatactgtggaagttttttyaaaaacttaggaaaaaattaatggtggccaggcacagtggctcatgcctgtaatctcagcactttgggaggttgaggtgggtggatcacctgaggtcaggagttcaagaccagcctggccaacatggttaaattcatctctactaaaaatacaaaattagccgggcatggtggcacatgcctgtaatcccacctacttgggaggctgaggcaggagaatcacttgaacctggaaggtggaggctgcagtgggccgagatctcgccattgcactccagcccgggcaaaaagggcaaaaaaa

SEQ ID NO: 174881 - DNA, 601 bp, Human
ctgacctcaactgatccacctgcctaggcttcccaaagttctgagattataggtgtgagccaccacgcctgcccctttatttgaatttttgaaaaaaatgtcttggcaatgaaactctaaaataacaactagagatgagaagcagtgaaagacaagaatggtcagaaaataaattcgtcccgggtcatcacagctaatgattctgggctgtctcttaaggtgggggttgttctaagagactttcccaagtaaacaccttgagagaaaatagaaacataacagtcaaaggaatttatgggccacacaattgagggaacaaatacagccagaaggccaagcttctcccacccccatgcctgctttgcaatttatactcaacaaagaatgcaaggttttagaggatatagtacaactattacaacctccaaagacttttgaaggatggctcttatagccattaaacaaacaaaaagaagtaactctgcctcctgggctcaagccatactccctcccacctcagtttcccaagtagctgggcatgcaccaccacgcccagctcatttttgtattttttgtggagacagggtctcactatgttgcc

SEQ ID NO: 174882 - DNA, 601 bp, Human
ccttttctccaggtgccttctgaatctctatctccccaacgagagtcctccattgacaaagtgaaaaagaagcattacattggtaaccatttactattacaactactggtattaccattcaaatattttttgtacttataacaatatgaagcccttaaataagcaagttttaaaatttcatttattttttaatctgagatcagactgacgctacagggaaactggtagtctcatatattgtaggtggccttacaaaccgatataacactgtgctggaaagcaacctgggaacatacacctctacagatttccttcaacctagaaatcccctttgaagaatgtgaaaaaagccacatgccctgaaatggacatcacagtgcctacgaagcaaagaaaggtggagacattttatttaatgtctaatgggggtggttaaattaacagtacttctctattcaaagtactctgatgggccgggcgcggtggctcacgcctgtaatcccagcagtttggaaggccgaggcaggtggatcacgaggtcaggagatcaagaccatcctggctaacacggtgaaaccctgtctctactaaaaatacaaaa

SEQ ID NO: 174883 - DNA, 601 bp, Human
aaatgaaccaaattttaaaaccactgataagatattaacaggaactggagcggcattattttcctcaactctacttacttctctggcgggcctcttctccactcagaatctgcttcaggtccttttctccaggtgccttctgaatctctatctccccaacgagagtcctccattgacaaagtgaaaaagaagcattacattggtaaccatttactattacaactactggtattaccattcaaatattttttgtacttataacaatatgaagcccttaaataagcaagttttaaaatttcayttattttttaatctgagatcagactgacgctacagggaaactggtagtctcatatattgtaggtggccttacaaaccgatataacactgtgctggaaagcaacctgggaacatacacctctacagatttccttcaacctagaaatcccctttgaagaatgtgaaaaaagccacatgccctgaaatggacatcacagtgcctacgaagcaaagaaaggtggagacattttatttaatgtctaatgggggtggttaaattaacagtacttctctattcaaagtactctgatgggccgggcgc

SEQ ID NO: 174884 - DNA, 601 bp, Human
atgcacacaattcttcatggctctcctttccctgcctctacaaaatgaaccaaattttaaaaccactgataagatattaacaggaactggagcggcattattttcctcaactctacttacttctctggcgggcctcttctccactcagaatctgcttcaggtccttttctccaggtgccttctgaatctctatctccccaacgagagtcctccattgacaaagtgaaaaagaagcattacattggtaaccatttactattacaactactggtattaccattcaaatattttttgtacttayaacaatatgaagcccttaaataagcaagttttaaaatttcatttattttttaatctgagatcagactgacgctacagggaaactggtagtctcatatattgtaggtggccttacaaaccgatataacactgtgctggaaagcaacctgggaacatacacctctacagatttccttcaacctagaaatcccctttgaagaatgtgaaaaaagccacatgccctgaaatggacatcacagtgcctacgaagcaaagaaaggtggagacattttatttaatgtctaatgggggtggttaaatt

SEQ ID NO: 174885 - DNA, 601 bp, Human
aaaaacaacaacacaggccaagtgcagtggctcatgcctgtcatcccagcaatttgagaggctgagacagtcagatcgcttgaggtcaagaggtcaaagccagcttgggcaacatggcaaaaccccatctctactaaaaatacaaaaagtagccaggtgtggtggcacacacctgtaatcccagctattcgagaggctgaggcacttgaacccaggaggcagaggttgcagggagccgagatagcgccactgcaccccagcctgggcagcagacccaaaaaaacaaaatacaaacccacaygcaatcagacatgcacacaattcttcatggctctcctttccctgcctctacaaaatgaaccaaattttaaaaccactgataagatattaacaggaactggagcggcattattttcctcaactctacttacttctctggcgggcctcttctccactcagaatctgcttcaggtccttttctccaggtgccttctgaatctctatctccccaacgagagtcctccattgacaaagtgaaaaagaagcattacattggtaaccatttactattacaactactggtattaccattcaaatattt

SEQ ID NO: 174886 - DNA, 601 bp, Human
cctactacatggtctggacagctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggarcaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcaggtgagtaggatggagtggaaagggtggtgtgtctccagaccgctggaaggcttacagccttacctggcactgcctagtggcaccaaggagcctcatttaccagatgtaaggaactgtttgtgct

SEQ ID NO: 174887 - DNA, 601 bp, Human
tcgtccaaaaaatggtcctaactttttctgactcctgcttgtcaaaaattgtgggctcatagttaatgctagatgcttccttcctctatttccccccaaatttcctgggaacccctggtcaataccagcagtaagttccactgttctagggtgtagaaatggctgtgacccagcagcaagagggaaggacatcagatgtcatcagtggtcatactgcaacacagccctttttctgtttaggaatgcaggtacccacaacatttactaacactttttttttcttatttattttctagttggygtttgggggcaagatggtgagatatgctttctttctttcttttttatgaaatcaccccatcattctttgtagttatgaatggagctttctcttaggcctcccacagaacttccacagaggtcaggaaaaggagtttctgccatctacccctttgactttcctcacaagtctggagatatttctagcccagaagagggaagcaacagaggcaggaaataatgagtcttaaccatacaaaagaaaaattgagacttaaatgaagttgaaagcactaacagttttcatttgtttgcatttcat

SEQ ID NO: 174888 - DNA, 601 bp, Human
gtgcacatgcatatgagtgtgcccggcctgaacttactctctcaaccacagcggtagagtcaggagtgttccaacattggaagcccctctattcaatcagctcttccaaactgagtgaaccaatgttgtatttaatggcaaccatggctggacaccatggctcacacctgtaatcccagcactttgggaggccgaggtgggcagatcacttgaggccaggagttcgagaccagcctggccaacatggcgaaaccccgtctctactaaaaataccaaaatcagccagacatggtggtgtacrcctgtagtcctagctactcgagaagctgaggcaggagaatcgcttgaacctgggaggcagaggttgtagtgagccgagatcacaccactgcactctagcctgggtgacacatcgagactgtctcaaaaataaaataaagacaaccattatgccagcctagattccgccatgctgcctaatttgtagtgtccttaggagccatttttgtaaatagtcatcagataagatgtaaggcccataacagctttttctatgcagctgagggaattggaagatccattgtttcctaagagttgaggg

SEQ ID NO: 174889 - DNA, 601 bp, Human
acaaccattatgccagcctagattccgccatgctgcctaatttgtagtgtccttaggagccatttttgtaaatagtcatcagataagatgtaaggcccataacagctttttctatgcagctgagggaattggaagatccattgtttcctaagagttgagggaagagtcccaacccacgggagcagggtctgatcttcattgccgatagaaacattactaatggcttcttactgtttccttttcaggtaatgaagaaatgggtaagaagatttccactctatctagcaaaagttttcaaatrtggaatgaaatgctcatagagtacaatcacagtaacaaaccctgagaactaaaactattaaagggaaaatacaagtatctttcaatgggatccgtatgaaacttgcctgtatttgttgctagctgtcatgtcagattatagctgtgcatatatgtatctctgatcatacacatatggatgtgggttggagctaccatgtgtttttgtataagccatgaaatctttgaaggcagacagagacagtgtctcatttacctagcccagtgtctggcacatagtaggtgctcaatgaatattttt

SEQ ID NO: 174890 - DNA, 601 bp, Human
taaagaggggagtggtcaactctactgagtgtcgttgggaaaggttccctgggggaggtggtccttgagctgaattttaaaggataagcttatgttttagggaagaaaaatattttatgcagaagagataaagctgtatagtatgaggataagagtctaactgagctagatcagaatgtttgaatcttggctcaactctctacttgctgggtgtgtttgagtaatttacctaacttttctgtgccacagcatcatcatggtacaatggaaataatagtgctacctaacttgtagggttatkatgaggaccaaatgagtaattcatttaaggcacttagaacattatctgacataaaaggcagtaggagggccgggcatggtggctcacacctgtaatcccagcactttgagaagccgaggtgggaggatcacctgaggtcaggagttcgagaccggcctggccaacatggtgaaactccatctctgctaaaaatacaaaaattagccaggcatggtggcaggtgcctgtaatctcagctactcaggaggctgaggtaggagaattgcttgaacctgggaggcggaggttggagtgagctga

SEQ ID NO: 174891 - DNA, 601 bp, Human
gtttgagtaatttacctaacttttctgtgccacagcatcatcatggtacaatggaaataatagtgctacctaacttgtagggttattatgaggaccaaatgagtaattcatttaaggcacttagaacattatctgacataaaaggcagtaggagggccgggcatggtggctcacacctgtaatcccagcactttgagaagccgaggtgggaggatcacctgaggtcaggagttcgagaccggcctggccaacatggtgaaactccatctctgctaaaaatacaaaaattagccaggcatgstggcaggtgcctgtaatctcagctactcaggaggctgaggtaggagaattgcttgaacctgggaggcggaggttggagtgagctgagattgtgccattgcactccagcctgggcgacagagcaagactctgtctcaaaacaaacaaacaaacaaacagacagtaggtgaattttagctattaatacatggaaagcatgctgactatagatgataagcattaaagtttactgagcatgtatgttttaggcattgctctaaatattttacttgaatttcctcatttaattcttccaacaccc

SEQ ID NO: 174892 - DNA, 601 bp, Human
ataagcattaaagtttactgagcatgtatgttttaggcattgctctaaatattttacttgaatttcctcatttaattcttccaacacccctactgtacagttaaggaaacaaagcctcaaataaatacagaaataaacaaaaataagtaaacaatccagtcctggggatataaatgcagatttaggccaagtgccatggttcatgcctataatcccaacactttgggaggccaaggcaggaggctcgcttgagctcagaaggttgaggctgcattgagcaaagattgtgccactgtactcsagcctctgtggcagagaaagaccctgtctctgaaaaaattaataaatagaaatttaaaaataaaaaaattttaatgcagatttatatgataccgaagttcattttctcaaccattatgaaatactgtttctggatatgtataaaatctttgtgagcacacatatctttttttaacttaactttcattttaaattcaggggtacatgtgcaggtttgttatataggtaaacttgtgccatgggggtttgttgtatagattatttcatcacccaggcattaagcctggtacctgttagttat

SEQ ID NO: 174893 - DNA, 601 bp, Human
aataggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacayctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattga

SEQ ID NO: 174894 - DNA, 601 bp, Human
ttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcatasgctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattc

SEQ ID NO: 174895 - DNA, 601 bp, Human
catatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaarttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaacc

SEQ ID NO: 174896 - DNA, 601 bp, Human
aatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccawgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctcta

SEQ ID NO: 174897 - DNA, 601 bp, Human
tgcagtcatccgattccgcccctaagctgtgggaagagagactttgatatattagctcctgccttttcctttcccttcccctatggagagaaacaatgggaggatcttgagctgaggaaagtcacaaaatgatgagaagagtgtagggtccttagagatgaatgaaagaaaaaaaaagagaaaggacgtctgaacagaaaagggagcggtagaggagagaacaatggggtttgccattctctatctgggtctcactggcacagacagtgctgcaagattggttccctcatgggaatgaaaygtttcccctccttcctccgcaggacaaaacaaggagaggccaccacctgttcccaacccagactatgaggtaacgtgggatagaaatgggccaggacgctggaggggatgtccctccaggggggaaggaaacagatgggatggcccatcttgtctgccagatgcctcaaagcccctcactcagggcttccattacaaccctctatgtgccacctctgcgtccttcatggtaaaacaggactgtctcaaaggctgcatggcttccacaaccatggagaggtggaagcttgcaggagacata

SEQ ID NO: 174898 - DNA, 601 bp, Human
actcattgggaaatagccccaaactttgctcaccccaacccacccttacacacacacatacacacacacacacacacacacacacacacacacacacgtgaccagacatcccagtccctcccctaccgggctgcctcttgagttggggtaacaaagagttaatgcctggcatggcagaggatcaccaggattgttctagttgattggtatgtgtgcactcctagttgttaaatattttcactatcacacctggatatactcaacaaatatttgttgagccaaatactcaacaccagccaarcacgtagtatttactttagcttaagcgaattatttagccctgacagaagccctggaatgtgggtctttaagttcctatttttgagatgggaaagctgaggctcacggaaggaggtgaccagctcaagtctcctaccgtccatgccaaattagaattccagcctgcctcctgacttcaagtccaaagttcttcccacgcactaaagctagctcttcagtgtcctttcttaggaggtacttcctcccgcaccactgaccgccccctctctatttcacccccagcccatccggaaaggccagc

SEQ ID NO: 174899 - DNA, 601 bp, Human; identical to SEQ ID NO: 33217

SEQ ID NO: 174900 - DNA, 601 bp, Human; identical to SEQ ID NO: 33218

SEQ ID NO: 174901 - DNA, 601 bp, Human; identical to SEQ ID NO: 33219

SEQ ID NO: 174902 - DNA, 601 bp, Human; identical to SEQ ID NO: 33220

SEQ ID NO: 174903 - DNA, 601 bp, Human; identical to SEQ ID NO: 33221

SEQ ID NO: 174904 - DNA, 601 bp, Human; identical to SEQ ID NO: 33222

SEQ ID NO: 174905 - DNA, 601 bp, Human; identical to SEQ ID NO: 33223

SEQ ID NO: 174906 - DNA, 601 bp, Human; identical to SEQ ID NO: 33224

SEQ ID NO: 174907 - DNA, 601 bp, Human; identical to SEQ ID NO: 33225

SEQ ID NO: 174908 - DNA, 601 bp, Human; identical to SEQ ID NO: 33226

SEQ ID NO: 174909 - DNA, 601 bp, Human; identical to SEQ ID NO: 33227

SEQ ID NO: 174910 - DNA, 601 bp, Human; identical to SEQ ID NO: 33228

SEQ ID NO: 174911 - DNA, 601 bp, Human; identical to SEQ ID NO: 33229

SEQ ID NO: 174912 - DNA, 601 bp, Human; identical to SEQ ID NO: 33230

SEQ ID NO: 174913 - DNA, 601 bp, Human; identical to SEQ ID NO: 33231

SEQ ID NO: 174914 - DNA, 601 bp, Human; identical to SEQ ID NO: 33232

SEQ ID NO: 174915 - DNA, 601 bp, Human; identical to SEQ ID NO: 33233

SEQ ID NO: 174916 - DNA, 601 bp, Human; identical to SEQ ID NO: 33234

SEQ ID NO: 174917 - DNA, 601 bp, Human; identical to SEQ ID NO: 33235

SEQ ID NO: 174918 - DNA, 601 bp, Human; identical to SEQ ID NO: 33236

SEQ ID NO: 174919 - DNA, 601 bp, Human; identical to SEQ ID NO: 33237

SEQ ID NO: 174920 - DNA, 601 bp, Human; identical to SEQ ID NO: 33238

SEQ ID NO: 174921 - DNA, 601 bp, Human; identical to SEQ ID NO: 33239

SEQ ID NO: 174922 - DNA, 601 bp, Human; identical to SEQ ID NO: 33240

SEQ ID NO: 174923 - DNA, 601 bp, Human
gtatttctttgctccataccaaagtcttcctcccccaaaataaacaagtgaattagaattaaaaaagaaaaaaagttaataatttcttctagttctcagagttttatataaaactgtacaaaattatcatcatttagagttgatttttttcaccagccctgaattttcaaacttgtaatatgctgtttcacaatttttttattaaattacttaatgattccagtctgcaaatgagcatagactttgctctgttgttatagatcattgaattgggggggaaacatagtaagctaaactatcygtcactgctcatgaaagacccacattgttgattatttttcccagcacagaagaaaagtgacaagtgattcatcctgcaatggcctctgccaatcttttcatatctatgtaaccttttgtagttactgtgtgatttagcgttgtgctattgtaaatcttggattaattaacaaaacaacaaaaatctatcacctggaatattgaaagaaattcagtaaaacaagatgtgtctcatagttaaggagagacataaaaataaaaatgtcatttaacagtttgaatttaggatttactgttaatc

SEQ ID NO: 174924 - DNA, 601 bp, Human
agcttgtaacttttctttcaatagcccacttataaagtttgctttatctaccagtatgggggaaaaaaagaataaagttggttttattccatttaaagtagttttggtatttctttgctccataccaaagtcttcctcccccaaaataaacaagtgaattagaattaaaaaagaaaaaaagttaataatttcttctagttctcagagttttatataaaactgtacaaaattatcatcatttagagttgatttttttcaccagccctgaattttcaaacttgtaatatgctgtttcacaatytttttattaaattacttaatgattccagtctgcaaatgagcatagactttgctctgttgttatagatcattgaattgggggggaaacatagtaagctaaactatccgtcactgctcatgaaagacccacattgttgattatttttcccagcacagaagaaaagtgacaagtgattcatcctgcaatggcctctgccaatcttttcatatctatgtaaccttttgtagttactgtgtgatttagcgttgtgctattgtaaatcttggattaattaacaaaacaacaaaaatctatcacctg

SEQ ID NO: 174925 - DNA, 601 bp, Human; identical to SEQ ID NO: 30751

SEQ ID NO: 174926 - DNA, 601 bp, Human; identical to SEQ ID NO: 30752

SEQ ID NO: 174927 - DNA, 601 bp, Human; identical to SEQ ID NO: 30753

SEQ ID NO: 174928 - DNA, 601 bp, Human; identical to SEQ ID NO: 30754

SEQ ID NO: 174929 - DNA, 601 bp, Human; identical to SEQ ID NO: 30755

SEQ ID NO: 174930 - DNA, 601 bp, Human; identical to SEQ ID NO: 30756

SEQ ID NO: 174931 - DNA, 601 bp, Human; identical to SEQ ID NO: 30757

SEQ ID NO: 174932 - DNA, 601 bp, Human; identical to SEQ ID NO: 30758

SEQ ID NO: 174933 - DNA, 601 bp, Human; identical to SEQ ID NO: 30759

SEQ ID NO: 174934 - DNA, 601 bp, Human
gagcctccaggcctggacccattaagtagtttctcatcatccaccccttcatccttccaagtcttcactgtccatcattccactctctacatctgtatgtacgtattttttagctcccactgataagtgagaacatgtgatatttgctttcctaagagatgtcaatgcatataccatatatcacacaatcttagatgaacatgtatttcacatctaacatcttggaatgcaagaggcattttacaatctatagtatcctttgattaaaattggcaagattcttgagattctttctctggcrctggagcacagacagctccttacaatctagcacattttagagttcatgtaatatagcattctttactataacaagtgacatataacaaggaagttgcaggccaccttttcctatgcttagtaacaatttaaatcgcaggacattgtttctggaaaactaaaaggatgtgtcaataaaaacatctggccctggggctgggggctgaaaggaggaggagataattatttcttgggaatcttctcacctattcatatatctatctgtgactcaagatttcttgtgtcaatttagagaatttgt

SEQ ID NO: 174935 - DNA, 601 bp, Human
ctgggcgcggtggcttatacctgtaatcccagcactttgggaggccaaggcaggtggattacgaggtcagcagttcgagaccagcctggccaatatagtgaaaccctgtctctactaaaaatacaaaaattagccaggtgtggtggcacgtgcctgtagtcctagctacttgggaggctgaggcagaattgcttgaacccaagaggcagaggatgtagtgagccaagatcgtgccactgcactccagcctgggtgacagagagactccatctcaaaaaaaaaaaaaaaatgtaaaagaaayacgtaccactcaccccacttggtcacacggtctagtcttttaatttactatttgttcacagctgatttaagtttttcacatctactttcctaagtacttttttttttttttgacatggagtctcactctgtcacgagacgagtgcagtggtgtgatgtcggctcactcaacctctgcttcctgggttcaagtgattctcccgcctcagcctcccgagtagctggaactacaggcgtgcaccaccacgcccagctaatttttgtttttttgtgtgtgtgtgttttttttttgagacggagt

SEQ ID NO: 174936 - DNA, 601 bp, Human
ctcaattttcagttaattatttgtttttgtctaagcatacaacatatcatttgcaaataacaacttattttttcctttctaaaaattacacgctgcctttgttctggcaatgattttatcctttcatcattaaggaagggactattggtttagactgtatattttatcacactaaatattgttcctataatatcttttttgttgttgtttttaatcagctctgaacaccaaacagtgttgccttggcacccaataaggtaatattaattttcttgacagcctcctggttgctgtgaaacaygcaccacaggctgggcgcggtggcttatacctgtaatcccagcactttgggaggccaaggcaggtggattacgaggtcagcagttcgagaccagcctggccaatatagtgaaaccctgtctctactaaaaatacaaaaattagccaggtgtggtggcacgtgcctgtagtcctagctacttgggaggctgaggcagaattgcttgaacccaagaggcagaggatgtagtgagccaagatcgtgccactgcactccagcctgggtgacagagagactccatctcaaaaaaaaaaaaaaaat

SEQ ID NO: 174937 - DNA, 601 bp, Human
caccccacctgagtgactcagtacaagccccaggcagggacttatgaatcctggagtcagggagagctgccccagcaggacccctgtgcttggggacacagtcatgcttggaaaacaggggcagccgaatgactcgtcacaccacatcattgctctcctgattggctatcaaggacccacagggacacttctaactgtgcacatttacctggtctcaccagcatacaaatccttaaattcactctcaattttcagttaattatttgtttttgtctaagcatacaacatatcatttgcaaayaacaacttattttttcctttctaaaaattacacgctgcctttgttctggcaatgattttatcctttcatcattaaggaagggactattggtttagactgtatattttatcacactaaatattgttcctataatatcttttttgttgttgtttttaatcagctctgaacaccaaacagtgttgccttggcacccaataaggtaatattaattttcttgacagcctcctggttgctgtgaaacacgcaccacaggctgggcgcggtggcttatacctgtaatcccagcactttgggaggcca

SEQ ID NO: 174938 - DNA, 601 bp, Human
attctcactgggcccctccacagcctgggctagaggtgtgccctggaatgctgtggcatgcaggtagttaaagaccacatctcgcatagatgcatcattctcctgcatctcccgcaggatcacatcacgttccttctcaatctgtgagtcttccagactacagttctgcacaatgtcacccaggagctccacagctagatgcaaggaggacatgtttaggtgccaggtggaccactgcagaccaacgacagcacaaaatccccaggcctggcatctcctgctgcccacccctagttgcccrgctgcaaagccatacgctaagggtaatatgattctgtggtcagccaggggctcctaggtagctgtcctctgcttccctgccctctgtccccgcctcttcctccaggtgttacctttcggcagatccttggacagcgccttgatgtagtaagctgtgtgctcccgggtgctgtaggcattaagatgggcccccatgctctccacctccttctccagggcactgccaggccgattctttgttccctggaaccagatatcaaccagaacaatcaggagctacacaggaacccaagaaccctgt

SEQ ID NO: 174939 - DNA, 601 bp, Human
tccacctacatcaaggacaagactggtactcctgggcacaaagccacctggcctgccttttccctctagctctccctcaagtatttctggctgctggccctgcagggggtggcaagtgagggggcagaaagaggagctattacagggctgtgattagctcttgggtcccctgagagctggggacatttgcaaataatgttacaaacgtataccctaggactccttggatcttgcctcctcacctccacaagaggagggctctgtggtgccaccagttgcattggcctttttttttttttttgagacggagtctcgctctgttgcccaggctggagcacagtggtgcaatctcagctaactgcaagctccacctcccgggtccacgccattctcctgcctcagcctcccgagtagctgggactataggcgcccgccaccacgcctggctaatttttttgtattttcagtagagacggggtttcactgtgttagccaggatggtctcgagctcctgatcttgtgatccgcccgcctcggcctcccaaagtgctgggattacaggcgtgagccaccgcgcccggcctgcgttggcctttcattc

SEQ ID NO: 174940 - DNA, 601 bp, Human
cttgtcttcaacgcacactgtgacccccacgcacaggagcacacagccccagcaccctctcttccctgaaggcgaggtcccatgctcgcgctggcactcaccacgccaccaccataagtgcagtcatagtggccgatgatggcattggccacttgcaaggccacattgtccgggctggcccagccaggaccctctactgcaatggccacgtgggcaaaaggtagagcatcatcacggtggcggatctgaaacagtacatgacaaggctgaggaacagccagactgccaggggaacagaaaaggtggcaggtgtgggtagagggtgtatgtgtgtgaacatgtgtgcctgtgatgcagcagccacagaaccccttcccaactgctgaggtatctctggagtcaccaggataaccatgcacatgggggtcctcccacaggcccccagctgagcactactcctgcccaaaaggcagcatacctcactgccagtgaagcggcatggagtaagagtgggcacagcgtcctctgcatatgtccatgggatgccaccgaggtgcttctgggcgaggtctaacagttgctggtgctccactcctgctga

SEQ ID NO: 174941 - DNA, 601 bp, Human
acccttcctcctgttggaaaactagcccacctttgaaagttctgggctcagagaggccaagtaattcacctagggccacacagctcagttccagtccaacaacccggcccacactccttggccaggagagagggaagggcctggggtgcccacagggtcctccccagactgggggcgatggggattggagagggaagcgagggggccagagccctccccgaggtgatggtggccagacctagccaccgccaagccgatatgcccccacacacctgtccccgccccctgctctgccacaccygtctctggcccaccactgtcacgaccgcctcacctgtccccagcagcctccccagtcacggcaacctcacctgtccccggttccccatctgtctcccgccccttctccatgcgagacccccgcccaggccgccctacccacccatcccggtgcacctcccacctcctcccagaggaccccgcctcaccaccgcgctggcaagcgtgcagagcgggccgcccattgctgtatggcatccagatcttcttcagggggttctgtgtcaattcccgtggggacgccatcccggggccgggatga

SEQ ID NO: 174942 - DNA, 601 bp, Human
actatgcaaagggtaaagtgttgcccaaatgcaggcactgggagctggaggtgctgcatgggcgggttccatgttcattcactgcttacccactccctgctgtgaaccctgaggcccaaatccccaaacaacctgcaggtctcatctttggcctctcaggtgctacctcctcctccaggaaaaagtgcggacctagaacccagcctaccccaacaccctgagacaccgtgatggcacgagcccctcagctcaggccagagccacatttcagttccacacttagagcctggagaaacacaakccctgcctcaggagctatgagaccttcccattgggcctcagcttcctctcacctgtaacgggggttggcttggagctgatgcatcaatccctgactcagacgtagtgagaagcaaagaaagaatggtagtgatgacagaataccctgcctccgcttattgaggacctactccttaaaggctcacagacttggctaggcatggcagctcatgcctgtaatcccaacactttgggaggccaaggggggcagatcattagagataacgaattcaagacgagcctggccaacatggtgaaactc

SEQ ID NO: 174943 - DNA, 601 bp, Human
agagacagctccagcctcctcccatggcatttggtggcatttcccttcccgccttccacccacatgcgcagcacaaggtgggcaggcagggcagcaaatcaggcctgggtgcaaaacaaggcaataaattacctatctcctctgctccccaagataagctcccaaggaaatgacccaaaagaaaaccaaagttcaagtgtatcacaacagctctgcttaccatagcaaaacactgggaaattccagccataagaaattgccaactgaggcacaacaaggagggaacacattgcagctctcraaacagagcacgtggactaagcgggctgggtgcacggctgcacctgtggctctgagcccacaggaccctgacactgagcaaacaggatggtagaatacactgtttatagctgggcgtgatggcacatgcctgtaatcccagcactttgggaggccgaggcaggcagatcacctgaggtcaggagttcgagaccagcttggccaacatggtgaaaccctgtctctactaaaaatacaaaaattagccgggtgtggtggtgcacacctgtaatcccagctactcgggaagctgagacaggag

SEQ ID NO: 174944 - DNA, 601 bp, Human
gcagcctggtagccactgggcttgatttggggaagtcactagagctgggtcaacctctgctcactgccctatcctgatggctgggccaagagcaagtctctgccaccctaggttgataaggggcttctcaagaccacagctaacacctcctgagaaaagcacagcatggctgctcagaccaccagctggtgctcagttccttgaagaaaggactcagttcaagtctgaaagttgttgagggtggggcggtagcatatacatatttctatctccagagtaacagcagaagtgtgaacgactyacccagcagcatctaggagatgtcaatgcaaagccaatcgcaccagcaatcacacaccaagaacatgctccaaatacacaggagagagcttatcctggggcaagggaggaagccccccacccccagctccatccctaaggcctgtatgcctgcactcactcaggttcccttccccagcagcagccatccccacggggcgctggggtgagcgagcgtgacctccaggcagcagctccaacgacctgcatgggctgagcccctcttacctccctgaagctctgtccttcccaagggttcctt

SEQ ID NO: 174945 - DNA, 601 bp, Human
acacgtgtgggtggttatgtgtgtgttgtgcccaagtgtgtacatgtaaatctgtgagtgtacctgtgtgagtattccctgggcccatgtatgagcacaggtgcacacacacgagcgtgcacaacccctgtgtgcagtatgtgactaaatgggcacaggtatgagtgagtgtgcccacatgtgtgcacacaggatgtgtgtgcatgcacccatgtgtataagtttgtgtgtgtgtgtccaagcatatacagagtatgcatgtgggggtgaccatgtgtgtacacatggtgtgtgtgtataagtcttcatgtgccatgtgactgtgtgagaacatatgcgatcatgcttggtgtgtacatgtgcacagatccacatgtgcatacaggtgaacacaagcgtatatgtgcccacacacatgactctgaggtatgcatatgtgtgtgcacccaccttcatgtgtagtgggtgactgcatgtgtgtggaagagttaacacagcaggtatgagaatggtccccttcgaaaggcctgcttgtgaggttggcccttggccggggttggggaacttgatggtaaacagttccctctagtgatatgaaact

SEQ ID NO: 174946 - DNA, 601 bp, Human
tctcttttgtgggctgctctggccatgacaccaccatgcaggagagacctcagggccccggtggagatgctgagggaagagcctgggagcctgtgtgtgtgcgtgtgtgtgtgtgtgtataagagagtgcaaatggggtgaagagatgcatatgtgcatgaatacacacgtgtgggtggttatgtgtgtgttgtgcccaagtgtgtacatgtaaatctgtgagtgtacctgtgtgagtattccctgggcccatgtatgagcacaggtgcacacacacgagcgtgcacaacccctgtgtgcrgtatgtgactaaatgggcacaggtatgagtgagtgtgcccacatgtgtgcacacaggatgtgtgtgcatgcacccatgtgtataagtttgtgtgtgtgtgtccaagcatatacagagtatgcatgtgggggtgaccatgtgtgtacacatggtgtgtgtgtatacgtcttcatgtgccatgtgactgtgtgagaacatatgcgatcatgcttggtgtgtacatgtgcacagatccacatgtgcatacaggtgaacacaagcgtatatgtgcccacacacatgactctgaggtatgcatat

SEQ ID NO: 174947 - DNA, 601 bp, Human
ctgtgccccaatgggtcttccagttaaagcctcaaagtgctttcttcctcatgccaaaaacatctgaattctgagagtccaggtaactggcattggtagggacatttctccttagagccccacgttctgggctaagatctcttttgtgggctgctctggccatgacaccaccatgcaggagagacctcagggccccggtggagatgctgagggaagagcctgggagcctgtgtgtgtgcgtgtgtgtgtgtgtgtataagagagtgcaaatggggtgaagagatgcatatgtgcatgaatmcacacgtgtgggtggttatgtgtgtgttgtgcccaagtgtgtacatgtaaatctgtgagtgtacctgtgtgagtattccctgggcccatgtatgagcacaggtgcacacacacgagcgtgcacaacccctgtgtgcagtatgtgactaaatgggcacaggtatgagtgagtgtgcccacatgtgtgcacacaggatgtgtgtgcatgcacccatgtgtataagtttgtgtgtgtgtgtccaagcatatacagagtatgcatgtgggggtgaccatgtgtgtacacatggtgtgtgtgtat

SEQ ID NO: 174948 - DNA, 601 bp, Human
cccaaccatcaaatgtgaggattaaaaaaagacatttcagatgtgcaaggtctcacacaatttacctccccaagcacctttctcaggaagttactggaggatgtgcttcaatgaaacaaatcagtaagtcaaagagaggatgatgtgggatccacaggcagaacattcaacccaggagagagaagggcaatggctgtgctacaggcacagattgtagctggggacagagaactccagaaggcatgactccaggaagaagaaggaagggaaagaacagcccctgtgtttgactatataaggytggggtagagccgtttcccacagacaccccagtttagccctgttctgctcttccgtctgactagaagggccaacacacaggtggaatccccttaatccaggattcagtgggttcctacaacaaccagtaatgctgggcaggattctccccacaccaggagaaatcacatttactaaagacttaggcaacctgatacctgtaacttctggggtggccaagaatacaagcatccagagggaagtcctgcagggtcaaatgcggccaccacatgcccagagggaaactcctggcccatatcca

SEQ ID NO: 174949 - DNA, 601 bp, Human
tctggagctctttgagaagtacctggggcctgcacaagcatcctctgagtagcctcctgagtagctgggactacaagtgtgcaccacacctcggttacagcatcatttttttgtttttatttaaaaaaaatttttttgagacagggtctcactctgtcgcccaggctggagcgtagtggagcaatcatagctcactgcagcctcaacctcctgggcttaagttattctttcgcctcagcctcccaagtagctgggattacaggcatgtaccaccatacctggctaatttttttttttttttgagacagagtcttgctctgtcgcccaggctgcagtgcagtggcgtgatctcggctcactgcaacctccgcctactgggttcaagcgattctcctgcctcagcctcctgagtagctgggattacagctacttgtgccaccacgcctggctaatttttgtatttttagtagagacgaggtttcaccatgttgggcaggctggtctcgaactcctgacctcatgatctgccagccttggcctcccaaagtgctgggattacaggggtgagccactgtgcccaaccacatctggctaatttttt

SEQ ID NO: 174950 - DNA, 601 bp, Human
ggttcaagatcaaattaaggttagccaaaacctgaaaagggatgtccctgtcacacacgaccttctgacaaggtcagatgcactactcaccacgatgttggcagctatgacctcaggatccacacagatggactcgacaaaaaaggtctgcggcaggaccagaagcgccggggtggtgggagggaggaacacggacatgttcagggcctcccgccttgctcctcggagctctccatcccctgaggcccatgctgacaagcagccaggccctgaaaccctgcttcagagggctggaggcggrgtcaaggagtccagagctaaagcaggtgctgccctctcctagactctcccacgaaaacccccttccctctggaaagcaaaccccaagtggagacagcccctctcatcccaaattacactcaggagccatgccagccccatgcccctcatgcataagcaggcggtgaaaggagccctggagggcaggggacatgccacagttccgccaaggagaggagccaaggaggcctcaccttgtagccattctgttctccaaaattaaagatggtcgctctccgttctcgggtggtgtttgtggcat

SEQ ID NO: 174951 - DNA, 601 bp, Human
ctggacctatgtggcactgcagcttggacagcacattgatcagtctctgggtgtgggggtgcagggtgggctctggttcaggctgagagtcctctggatattctcagttgagctctcactgtctggaccttgggaccttggtttgggggtgtcacgatgacaccaccaataaaagcaagagcaacgcttactgacaaatccaacagaagctgctccagacaaatggatcacatcacagaaccatgaagagaaatgctgtgctgggggaccatgaaagccatagagaggcccaggtggcagrtgccattcagctcaggcccggcctgggctggctctagaacccagctgaggaccctgctctatgcacaccccaaaagcattcatctcagagttgcttgtgtttcttggttcatgtgcatcctttttttttttttttttttttttttgagacagggtctcactctgtcacccaggctggaatgcagtggtgcaactgcaactcactacagccttgacctccctgggcttaggtgattctcccacctcagcctcccgagtagctgggactacagccatgcgccaccacaccaggctaattttt

SEQ ID NO: 174952 - DNA, 601 bp, Human
tcctgggcagctggtggatgagacaggaagcacaggaggatggtgctggtggtggcagccgataagtccagctcagccactttccctactctggacctatgtggcactgcagcttggacagcacattgatcagtctctgggtgtgggggtgcagggtgggctctggttcaggctgagagtcctctggatattctcagttgagctctcactgtctggaccttgggaccttggtttgggggtgtcacgatgacaccaccaataaaagcaagagcaacgcttactgacaaatccaacagaagcygctccagacaaatggatcacatcacagaaccatgaagagaaatgctgtgctgggggaccatgaaagccatagagaggcccaggtggcaggtgccattcagctcaggcccggcctgggctggctctagaacccagctgaggaccctgctctatgcacaccccaaaagcattcatctcagagttgcttgtgtttcttggttcatgtgcatcctttttttttttttttttttttttttgagacagggtctcactctgtcacccaggctggaatgcagtggtgcaactgcaactcactacagcc

SEQ ID NO: 174953 - DNA, 601 bp, Human
tatatgaggtatataaagtagtcaaagtcataaagacagaaagtggttgccaggggctgggagtagcaaatagagttattgtttttctttttaaaatttttttagagatggggtctcactatgttgtccaggctggagtgcaagggccaatcgtgaatgaaatcatagcacaccacagcctcaaactcatgggctcaagcaatcctcccacctcagcctcccaagtacctgggactataggtgtgagccagcacatctggcttgagttattgttcagtgggtacagagtttctgttttacmagattaaaagagttctggagatgcatggtggtgagagttgcataacaatgtaaatgtacttcatactcctgaaacgtacacttcaaaacagctatgatggtaaattttatgttatgcatattttaccacagtaaaaaaaaatggaaaaacaaaagcaggggtggtaatattcaaattagtcaaagtatatatccacagaaaaagcttttcatattgaaatgggaaccacccataataaagaccaagccatgatggagcaactggtaccagatttgctctggccccaacaaaaacaactat

SEQ ID NO: 174954 - DNA, 601 bp, Human
gggctgagattgtgccactgcactccagcctgggcaacagagagagactccctctcaaaagaaaagaaaaaaaaagaaaagttggctgggcgtggtggctcacagctcacagcctgtaatcccagcactttgggaggctgaggcaggtggatcacctgagatcaggagttcaaggccagcatggtcaacatgatgaatccccgtctctactaaaaatacaaaaattagttgggcgtggtggcgcacgcctgtagtcccagctactcaggaggctgaagcaggagaatcgcatgtacccaaraggtggagattgcagtgagccaagattacgccactgcactccagcctggggaagagaatgagactctgtctcaaaaaaaaaaaaaaaaagatggggacatattggattagagtgggtcctaaatccagtcattggtgtccttttaagaacgccatgtaggccgggcacagtggctcatgcctgtaatcccagcactttgggaggctgaggcaggtggatcatgaggtcaggagtttgagaccagcctggccaatatggtgaaaccccgtctctactaaaaaaatacaaaaattagccagg

SEQ ID NO: 174955 - DNA, 601 bp, Human
ttactgggaaaacgggaaatctgagtatggactgttgttaggtgattttatattataccaacattaaatttcttgggtttattaaatggtattgtgttaacataggaaaatattctttttttttttttttttgagacagtctcactttgtcacccaggctggagtgcagtggcgcgatcttggtccactgcaacctctgcctcctgggttcaagcgatttctcctgcctcagcctccccaatagctgggattataggcgcatgccaccaggcctggataatttttttttttttttttttttgagacagagtctcgctctgtcggccaggccggtgtgcagttgcacgatctcggctcactgcaacctctgcctcccgggctcaagcaattctcctgcctcagcctgctgagtagctgggattacagaatgtgccaccatgcccagctaatttttgtatttttagtagagacggggtttcaccatgttggccaggctggtcttgaactcctgacctcaggtaatccgcccgccttggcctcccaaagtgctaggattacaggcgtgagccaccgggcccggccttaatttttatatttttag

SEQ ID NO: 174956 - DNA, 601 bp, Human
gcagtattgttttgaaaaagcttcccaaaatttacacaaaaatattatctaaattatggtccatgttctcccagccacacccacatgactgtcacctgcctgatggctccactatgtcatgtgtaaagtcatatgctcccaccttcctacagctgttgaccttaacaggagcatcagatctaaagggctgctatggccttagaggttatcttttggaacagcacaacttttgactagcgaaacacgtcacttaacctcactgagcttcagtatcttgtttgtttttttttgttctggagayggagtctcactctgtcacacaggctggagtgcagtggtgtgatctcagctcaccacaacctctacctcccgagttcaagcgattctcctgcctcggcctcctgagtagctgggactacaggcctgtgccaccacgcctggcaaatttttatatttttagtagagacagggttttgccatgttggccaggctggtctcgaactcctgacctcatgtaatccacccaccttggcttcccaaagtgctaggattacagacgtgagccaccacgtccggtgaactccagtttcttcatatgtaa

SEQ ID NO: 174957 - DNA, 601 bp, Human
cgcaccaggcctatgattaattttttgcactatttaacttttctgtaactctgaaattactttaagataaaaaaactatttttgtttcctttttattatctagctccaaaaaccattttattttaaattaatggaagatatcaggtgaagcaatatcttattggtgttaaactctagtgagagtgtttctttcaggactaaggagatcagaaggacacccacctcactgccaccagccagaggatactaaactcaagaggttaggacacagtagggtgagcaggtcaagcccaaatatttmatcttttcctaatacttagatctgagccagaggggttaaggtcagggcagtgtattcatgagtaaaatcaggctcaaatacaaacattcaaatgactatagtaccatggctaattcttcaaggaatcaattcacttgacactggcaaataacatgtttataaagcacaccctgcactccttactaactgtaaaggagactttctttttttttttttgagatggagtcttgctctgttgtccaggctggagtgcagtggcggggtctcagctcactgcaacaacctttgctaggattacag

SEQ ID NO: 174958 - DNA, 601 bp, Human
gctgggactacaggcgcgtgccaccatgcccagataatttttgtatttttagtagagacggagtttcactacgttggccaggctggtctcgaactcctgacctcgtgatctgcccgcctcagcctcccaaagtgctgggattacaggcatgagccactgcgactggccaatttttgtattttttaagtagagggagtttcaccacgttggccaggctggtttcgaactccggacctcaagagatccacctgcctcggcctctcaaagtgctaggattacaggcatgagccaccgcaccagkcctatgattaattttttgcactatttaacttttctgtaactctgaaattactttaagataaaaaaactatttttgtttcctttttattatctagctccaaaaaccattttattttaaattaatggaagatatcaggtgaagcaatatcttattggtgttaaactctagtgagagtgtttctttcaggactaaggagatcagaaggacacccacctcactgccaccagccagaggatactaaactcaagaggttaggacacagtagggtgagcaggtcaagcccaaatatttcatcttttc

SEQ ID NO: 174959 - DNA, 601 bp, Human
attttttgtatttttagtagagatgaggttttgccatgttggccaggctggtctcaaactcctgacctcaagtgctccgcccacctgggccttctaaagtgctgggattacaggtgtgagccactgtgcccggcctaaaaaaatgttttgtaaaaatgaggtttcactatcttccccaggctggttttgaactcctgggctcagacaatcctcccaccttggcctcccaaagtgctgggattgcaggtgcaaaccactgtgccaggctcttattcaccactttcactgtacaaagaataaycccttttgtttacatatgaaataaatcattccttctgtacaaaggcatttcagtctttaagttgtggacatgtacaggtggatgcttatttcccagatcataagtgcccaatgggacctctgtcttggtaggggagtacacagcagggcaaaggggaaaggtggctgctggaggtggtaatataattttattatattataaatatagacctggcatggtggctcacatctgtaatctcagcactttgggaggccaaggcgggtggattgcttgaggtcaggagttcaagaccagcctggc

SEQ ID NO: 174960 - DNA, 601 bp, Human
catacaggctgggaacagtggctcacgactgtattcccagcactttgggaggctgaggtggggaggtgggtggattgtttgagcccagaagtttgagaacagcctgggcaacatggcgaaacccatctgtacaaaaaatacaaaaattagccaggcgtggtggcgtgcacttgtggtcccagttactggggaggcagaggtgggaggattgcttgagccctgggaggcgaagttgcagtgaggtgtgagagcaccactgcactccagcctggccaacagagtgagaccgtctcaaaagatggatagatagatagatagatagatagatagatagatagatagatagatatagacagacagagagacagacagacagacacacacacacacatacatagatacatagatagataaaataaaaggcctggcacagtggctcacacctataatcccagcattttgggaggccaaagtgggtggatcacttgaggtcaggagttcgagaccagcctggccaacatggtgaaatctcgtgtctactacaaatacaaaaattagctgggcatggtggtgtacacctatagtcccagctacttgggag

SEQ ID NO: 174961 - DNA, 601 bp, Human
gcccctttttttttttttttttttgagacggagtttcactcttgttgcccaggctggagcgcaatggcgcgatcttggctcaccacaacttctacctcctgggttcaagtgattctcctgcctcagcctcctgagtagctgggatttacaggcacgtgccaccacattcagttaattttgtatttttagtagagacagggtttctccatgttggtcaggctggtctcgaacccccaacctcaggtgatccgcctgcctcggcctccctaagtgctgggattacaggcatgagccactgcgcccggccaagtatcctgcttttcaagttcactaataggctctgtgtacacatctcacagaaagaacattccattctacattcaacagtaaagaagccagactgtactgcattttaggtctttgtgaacatgtcatcaggttcttatatgtctctttttcacaacagataatataagatccacattccaccataagaatgactgaagccctaattttcaggatatgggaatctttttggtttaatgcaatggtactttaatagcaaaaacataaaacatgattttgtaaaactaaagccacc

SEQ ID NO: 174962 - DNA, 601 bp, Human
agataatttcctttttggttaatttttaaaagaaacaaaactgctacactagcttacacggtttgacccttcttccttctacacttctgccctgttgctctgaagttggtctgtttcatctgagccaactttccctttccaatttcagtagtattctctggagttgcagccatattcgtgcccacttagtcccttctctaaaacagaagggacttatcacactgtcacatacacaccagctcccgtattacgcaggttttctcgcaatgcacattctgattcagtaaatctggggaaaagscaggactctgaacttctgacaaaccacccatccccaatatcccagtgccatgctgctgctgatcttatgcacctaacactatgctgtgatcatagcaggtgtcaatgaatatctgagaaatctacaaacatcactagtccaaaaactgtaagtaaaatgacacagacatttcaaactattgttttctttttttttttttttttgagcagagtctcactctgttgcccaggctggagtgcagtggtgtgatctcagctcactgcaagctctgcctcctgggctcatgccattctcctgcct

SEQ ID NO: 174963 - DNA, 601 bp, Human
cccacatttttttttaagagacagggtctcactctgtcaccaaggctggagttcagaggaatgatcacagctcatgcagccttcaactgttggcctcaagcaatcctcccatcttggcctcccaaagtgctcggattacaggagtgattcactgctcctggccaacaaatttctttttaagtactatttgtaccttaagttagtggttccctcctccttttttttttttttttttttttttttttttttgagatggagtctcgctctgtcgcccaggctggagtgcagtggcgcaatatcygctcacttcaagctctgcctcccaggttcatgccattctcctgcctcaacctcccaagtagctgggaccacaggcgcccgccaccacgcctggctaatttttttgtatttttagcagagacagggtttcaccatgttcgccagtatagtctccatctgctgacctcataatctgcccgcctcggcctctcaaagtgctgggattataggcactcccccctcccattttttaaaataagagttaagtaactaaatttaagataatatactacattatattaatatctagaggttttttttt

SEQ ID NO: 174964 - DNA, 601 bp, Human
tggtgaccagggcaagctctccaaagtactgccccttatggcagcgggcaatctcgacctcctggttcccaccatccttgtttgatttagtctacagcaggcaaagaacatgacctaggctgactccaggatcacagctgggcatgtccagttgcacacacatacactgttctcagcatactctacacaattactgaggaattcactttgcagaaaattcactaactgtaccatgtaaactccatggactaatctcagtggtctggtttgatcagaaaagtctgctttttacctagagctyggagtcctaacattttcaaggtaatctacagccataccattctgaacatgcccaatcttgtctaaataaggacaatgcttctcttaggtaatgagccacaaacttgggctatttctctgatttgagactgcgccttgaacaacattttacagtgacaaaatcccccatgccccccacatttttttttaagagacagggtctcactctgtcaccaaggctggagttcagaggaatgatcacagctcatgcagccttcaactgttggcctcaagcaatcctcccatcttggcctcccaaagt

SEQ ID NO: 174965 - DNA, 601 bp, Human
tgcaaatcaattactgcactcattttcatgatgcaaactgtaaggtttattagtaataataataacctccatggaaacaaaatagaaaaaaaaaaaccaattgaaagaaaattttcactgaatttaagaaatatcaacaaactctgtgttcttttcttttaaaaacattatttctgtttcattaaatttctaaagtaacctttcaaaacaaacattatttctactttaaaaattaaaaaccaccaacaaaccaccgccacaacaacatactactaaggaaaagcctcaaaacatgccttakcgccggatgaatacagcagtcctcacttatctgaggtttttctttctgtgattacagttacccttggtcaaccttggtccaaaaatattagatgaaaaattccagagataaacaatttgcaagttttagatttgcagtgtactgagtagcttgatgaaatctcacactatcctgctctctctggcctggaacatgaaacatctctttgtataccatatccacaccatatgcattactgtcttggttatcagattgactattgcagtgcttgtgttcaagtaacccttatttacttaataa

SEQ ID NO: 174966 - DNA, 601 bp, Human
tactcctccctttttaactccagtccccacagggtcatttaagaaaatgtatgcatgtttctgattcataactatattatgatgattattcttataaacccttttgacgtctaaaagccttagagccactcaacagtcctgtttgggccagtctcctggaatatgagaaaagatgaagaatgggagtgttatggagggcatacgcccctctgatcatcaccacaaagagtggagcccttcatggtcccagctgaaagcctggagaggctgcgcgcggtggctcacgcctgtaatcccaacrctttgagaggccaaggcaggtggatcacttgagcgcaggaattcaagaccagcctgggcaacatggcaaaaccccatctctacaaaaagtacaaaaattaaccgggcgtggtggtgggtgcctgtagtcccagatactccggaggctgacgcaggagaatcgcttgaacctgggaggcgcaggttgcagtgagccgacatctcgccactgcactccagcctgggggacagaatgagactccaactcaaaaaaagaaaaaaagaaaaagaaagcctggggatatttaccaggacccttcct

SEQ ID NO: 174967 - DNA, 601 bp, Human
agtagaaacaatagattttatttagaagggttgaggttcaagtaaatgtatccttattccttttttctttttgcaaattatgatgaaaggctttcgcagtcttattctcatactggtctccccaagtacaaagtaaagaaattaaacagccaaacattaaattatctatttacctatagcatacctgacatctttccatggatgtacaaaatgcagaaaacatagagcattgaagtagctccagtgtaaaattttcagagtaagattgttttttgttttgttaaatttaaaataaacaatmttttttctttcgtttacatgagagcatatattcatattcccttttggaaacacatagaataagaaactgtttcagagaaggtgctgcactaaaaaggcattgtaatgactgaacatgattaaacatgggataaaaatagcagactggaaatcaagtacggaagtgaaatgcctcttaaatcaactgaagtgaaatttagtaagttatctatcttgaaggcactacctggcacatactatgctttgagatggctaaaactaagaaaaactgctaagtgggcaaaattgacagacattctac

SEQ ID NO: 174968 - DNA, 601 bp, Human
atatgcatgccagtattcctctgcatgttaggcaatacaaatgccagttacttatttggccagttactggcttgttttgatgttaaggaaaataatagtattctatactaactgcagtaaaattaagggtattgctctaaaaaagtaaatcagaaaagtggtacacagatttagtatacagcatatatactcactttagtccaggtcagatcaagtaactagtagaacatctaaaaaatatatcacatgcaatgttttccacacagagaaaaaatatttttagcatttcaataactgttaytatccctagcaaactaaaaggttgatgctcagtagaaacaatagattttatttagaagggttgaggttcaagtaaatgtatccttattccttttttctttttgcaaattatgatgaaaggctttcgcagtcttattctcatactggtctccccaagtacaaagtaaagaaattaaacagccaaacattaaattatctatttacctatagcatacctgacatctttccatggatgtacaaaatgcagaaaacatagagcattgaagtagctccagtgtaaaattttcagagtaagattgtt

SEQ ID NO: 174969 - DNA, 601 bp, Human
tatactgaatgtaatagaagagtctgtttatttctttcttttctttcttttttttttttttttttttttgagacagagtcttgctccgtagcccaggctggagtacagtggtgcgatcttactcactgctacttctgcctcccgggtccctgttcaagcaattctcctgcctcagcctcccaagtagctgggattacaggcacacgccactatgcccagctaatttttgtatttttagtagacacggggtttcaccatgttggccaggctggtcttgaactcctgaccttgcgatccaccytcagcctcccaaagtggctgggattacagtcgtgagccaccgcacctggcctatttcatgttaatggaattaattttaactgactaataacgactctggaaggtcagtataaaagacatactgttggtttttgacaatcatatgaattcactgagaacttatcatcagtcctgcatctctaggtcatttgtaaaagcaagtgtaatatgcagtatgcatcaattatacataaaagtaaagctaggaaatgttctttatagaactactcttacatgtggccaaattatggaaccattacac

SEQ ID NO: 174970 - DNA, 601 bp, Human
tttttgtcttttttagacagaatctcactctgttgcccaggctggagtgcagtggcataatctcccctcactgcaacctctgcctcccaggttcaagaattcttgtgcctcagccttccaactagctgggattacaggcatgggccaccacacctggctaatttttgtatttttagtagagatggggtttcaccatgttgtccaggctggtctcgatcgcctgaccacaagtgaaccgcctgccttggcctcccaaaagtgctgggattacaggcataaggcaccgtgcccagctggtacragtaatttaattgaaatatttgcaaggtgcttcaatttcggcacataataactgctctatgagtctgttagataaaataaaaatacatcttttacatatgtgtatgcaatatatcagtcatttaaaaaatataaacatttcatttacaatgctattatttcatggttaaaagatttcatgtctactttaggctgaaacatttaaaatgacaataggattattacaggtctttgggtaagcacatctttgtgtgattggaaattggtaataaagtaaggcaagaaggcagaaggtaaaaat

SEQ ID NO: 174971 - DNA, 601 bp, Human
tatggtgctcactaatactaagacttaaatcaactgggttgcctgtttaagtaaaggacagagtccatccttatctaatgcctccatttgagttagagtacaaggattggcaaaaattgctactgtttactgccagggaagcaatgaacagattgaaagaaaaatattaagacatgagtgtgtttgtttgcactgcttaaagcacctagaggaagacacaagtagaatattatgagccattaatagatttcatctaccttcctattaatttatcctgtcaccaactcactctggggttttmtgattatcccaaaaatcttatctttttcaaaatgtacacattagcatcatacaattaatttttttttgtcttttttagacagaatctcactctgttgcccaggctggagtgcagtggcataatctcccctcactgcaacctctgcctcccaggttcaagaattcttgtgcctcagccttccaactagctgggattacaggcatgggccaccacacctggctaatttttgtatttttagtagagatggggtttcaccatgttgtccaggctggtctcgatcgcctgaccacaagtgaaccg

SEQ ID NO: 174972 - DNA, 601 bp, Human
ttaccagtaattggtgtttttgtttttttactctttgacatctaaataaaactgttaggaattatttgatttcaaaaattaatttgcccgctcaaatattttttagattagcataacaatttatataaagatattacttaaagtacatactgaatagtgtcaataagaacattagatattgccatatttaattttaatttaataattattttttcttctagctttgcttgcctgtatgtgtggcctgtccttcaaagtcttcctccaaactttggcttttggcttcttccattttagggaytggatttgatataatctataggaggaacaaagaaataataatgacacaagaattccaggatgtacatacatatatatagagataaatatataggtacatgcatatttatagtctcctgctgccagattccataagtaggctaaggataatcactcagtggtaaagtaagtggtaaagtatttagaatgtttctgtccgcaatgtaaaaggacattaatttaacatgtgttattaaagatgtctggacttaaggattttatataattcatcatttgtcttttcttaactcaagccttccag

SEQ ID NO: 174973 - DNA, 601 bp, Human
tatgagggtgccaaaaatgtgttattaaacttacttgctttcactatagttttctgtgttacttttttctgtttctttttttccccatgaatagtctgtcctatcttttgctcattgttctatttggtaattagtttcttttcttatcgatttgtagaagctcttaatatatattaggaaactgacactgtcaactgagttgcaaatgtttttccccaatttgttaaatgctttttgacttttgttcctggtgacctttaccagacagcagatatttccttcctttttttccctgtctccyactttccctccatcccttcatccatccatccttccttcctttttataaatgaatttaccaaccttttcttcaatggtctttttgttgttgtttttgtttttgtcataattaggaaggtattcctcacattgctattataaaataaatctccacacattttggctggtactcttgtgaattctttcaaacttctggctaaatttaatggctcaatccaaattaaaagagagaggaaattaccattcaaataagatttagtagagttaaatgtgaatttttaaatttaagttttaagctctt

SEQ ID NO: 174974 - DNA, 601 bp, Human
ccattgtgtagatatacataattgacttaaactgtttaatcgtgatctacattgttgtttccagttttttctatgacatatgatgctgagtgaagaatcttgtgcatacatttttaacactctgtgcaggtatagttatggttatataagtaaaattccctggtcaaagggcatatacattactaattttgatattgctaggttgcctgtacagagattgtaccaatttacactgctatcagcaatgtatgagggtgccaaaaatgtgttattaaacttacttgctttcactatagttttytgtgttacttttttctgtttctttttttccccatgaatagtctgtcctatcttttgctcattgttctatttggtaattagtttcttttcttatcgatttgtagaagctcttaatatatattaggaaactgacactgtcaactgagttgcaaatgtttttccccaatttgttaaatgctttttgacttttgttcctggtgacctttaccagacagcagatatttccttcctttttttccctgtctcctactttccctccatcccttcatccatccatccttccttcctttttataaatgaa

SEQ ID NO: 174975 - DNA, 601 bp, Human
aaattctttaaaacaaggaatattaaactgactatccttcactaaagcttagctatatctacacctttaatgtccatattctatatcatattctatatgtggatgtattccttctttctcctctatattgcctaataatttttgttttatatatgatatatatttaatataaatttgttatgaatgtgtttatattatatgcaggcaatcaaagctttttgttttcacatacagtgttcatatcaatattttagatatgttttatgcatatgcaaaatatacatgtgtgtatgtttgtttaaaaaagagaatccattttgttcgtgttttctacagatggtggtgtattatctgcatttttccttaccttgttttttctgtttcatactatatcttggagattttttcagtatacacacatgaaaaggttcttccttatttagaaaattgaggcatggtgttccattgtgtagatatacataattgacttaaactgtttaatcgtgatctacattgttgtttccagttttttctatgacatatgatgctgagtgaagaatcttgtgcatacatttttaacactctgtgcaggtatagttat

SEQ ID NO: 174976 - DNA, 601 bp, Human
ttaatatatttaaaaattagagtcctgataggatactagaattttggaaaaaatagcacttttattacctaagaaaaaaacttcagcaacaaactaaaattggcattacagtattaataaaggaaactgggaatgttggggaaacaaaataacaatagtatataaaaaacaactggtgagcagggggcctgacctcaacaaaactaaaatggctttaggaaaattattacgagaacatcccattcttctaagattctaggcatattttgcaaacatagaaagaataggattggcagattatttttttttttgagatggagccttgctctgttgcccaggctgaagtgtaggggcgtgattttggctcaccgcaacctccacttcctgggttcaagtgattctcctgcctcagtctcccgagtagctgggactacaggcgcataccaccacgcctggctgatttttgtatttttagtagagatgggatttcactatgttggccaggctggtcttgaactgctgacctcaagtaatctgcccacctcagcctcccagagtgctgggattacaagtgtgagccactgtgcccggccagattggc

SEQ ID NO: 174977 - DNA, 601 bp, Human
cttaataccatcttcataaatgtgaacaacaattgtggtgatcttcagttccttttcaattgtttctaggaattgctttccagtttccagctcatacacaaacccatatctaggcccaaaactcagcttctggtgcatatcctgcatacactgtctacggtatttacgaaggcagttttcatcctctttctctttatggattagttcatattcttgaatgctcatctgagaataaagaaatgatagaaattattaagtcagaagttttattccttagatataccaagcccattctcaaccsaaggagtgtacttttgctcttttttttctgcctggaccacctacctttcactcctgatgtgcctttctctttcacctcattgaagcttttgtttaaatgtcaccttccttgattactttacctaaaaaggtccccatctcacactctccatctttatgctggtttattttctttatagcaacaaacactattatatcttataacttactgatttttttgaatatccaaaaaattcaagtaagacagcttttcctactatttggagttcatcagatcatccaagaggttaatttttggacc

SEQ ID NO: 174978 - DNA, 601 bp, Human; identical to SEQ ID NO: 174965

SEQ ID NO: 174979 - DNA, 601 bp, Human; identical to SEQ ID NO: 174966

SEQ ID NO: 174980 - DNA, 601 bp, Human; identical to SEQ ID NO: 174967

SEQ ID NO: 174981 - DNA, 601 bp, Human; identical to SEQ ID NO: 174968

SEQ ID NO: 174982 - DNA, 601 bp, Human; identical to SEQ ID NO: 174969

SEQ ID NO: 174983 - DNA, 601 bp, Human; identical to SEQ ID NO: 174970

SEQ ID NO: 174984 - DNA, 601 bp, Human; identical to SEQ ID NO: 174971

SEQ ID NO: 174985 - DNA, 601 bp, Human; identical to SEQ ID NO: 174972

SEQ ID NO: 174986 - DNA, 601 bp, Human; identical to SEQ ID NO: 174973

SEQ ID NO: 174987 - DNA, 601 bp, Human; identical to SEQ ID NO: 174974

SEQ ID NO: 174988 - DNA, 601 bp, Human; identical to SEQ ID NO: 174975

SEQ ID NO: 174989 - DNA, 601 bp, Human; identical to SEQ ID NO: 174976

SEQ ID NO: 174990 - DNA, 601 bp, Human; identical to SEQ ID NO: 174977

SEQ ID NO: 174991 - DNA, 601 bp, Human; identical to SEQ ID NO: 174965

SEQ ID NO: 174992 - DNA, 601 bp, Human; identical to SEQ ID NO: 174966

SEQ ID NO: 174993 - DNA, 601 bp, Human; identical to SEQ ID NO: 174967

SEQ ID NO: 174994 - DNA, 601 bp, Human; identical to SEQ ID NO: 174968

SEQ ID NO: 174995 - DNA, 601 bp, Human; identical to SEQ ID NO: 174969

SEQ ID NO: 174996 - DNA, 601 bp, Human; identical to SEQ ID NO: 174970

SEQ ID NO: 174997 - DNA, 601 bp, Human; identical to SEQ ID NO: 174971

SEQ ID NO: 174998 - DNA, 601 bp, Human; identical to SEQ ID NO: 174972

SEQ ID NO: 174999 - DNA, 601 bp, Human; identical to SEQ ID NO: 174973

SEQ ID NO: 175000 - DNA, 601 bp, Human; identical to SEQ ID NO: 174974

SEQ ID NO: 175001 - DNA, 601 bp, Human; identical to SEQ ID NO: 174975

SEQ ID NO: 175002 - DNA, 601 bp, Human; identical to SEQ ID NO: 174976

SEQ ID NO: 175003 - DNA, 601 bp, Human; identical to SEQ ID NO: 174977

SEQ ID NO: 175004 - DNA, 601 bp, Human
gaggcaagaggatatcttgaatccaggaggtggaggttgcattaagctgagcttgcatcatggcactccagcctgggcaacagagtgagactctgtctcaaaaataaataaataaataaataaaattaatggttacaattaatagcaataaaagtaggacagacacctaatctatgaaagtaagcttttcctgtaaggatgatttcctcttttttttttttcttttgagacagggtcttgctttgtctcccagtctggagtgcagtggcacaatcttggctcactgcaacctccacctacggggttcaagcgattctcctgtctcagcctcccgagtagctgggattacaggcccctgccaccatgcccggttaatttttgtatttttagtaaagacaggttttcaccatgttggccaggctggtctcacctgacctcaggtgatccgcccgcctcagcctcccaaagtgctggaattacagatgatttcttatttcagaaatctgccaactataaaagagcaatctcttgatactgtcttgtctgcttctcttgctttctcaacctcttctcattctcttttttctttatatataatata

SEQ ID NO: 175005 - DNA, 601 bp, Human
agcctgggcaacagagtgagactctgtctcaaaaataaataaataaataaataaaattaatggttacaattaatagcaataaaagtaggacagacacctaatctatgaaagtaagcttttcctgtaaggatgatttcctcttttttttttttcttttgagacagggtcttgctttgtctcccagtctggagtgcagtggcacaatcttggctcactgcaacctccacctacggggttcaagcgattctcctgtctcagcctcccgagtagctgggattacaggcccctgccaccatgcccrgttaatttttgtatttttagtaaagacaggttttcaccatgttggccaggctggtctcacctgacctcaggtgatccgcccgcctcagcctcccaaagtgctggaattacagatgatttcttatttcagaaatctgccaactataaaagagcaatctcttgatactgtcttgtctgcttctcttgctttctcaacctcttctcattctcttttttctttatatataatatatgtatttatatacatacactatatatacatttttgtatgcattatgcactcatgtacgcaaaaagttct

SEQ ID NO: 175006 - DNA, 601 bp, Human
gaaacgacacaggttaggagacgtcgctttgaacgtgctataggaccttctcaaacacacaccatcagaattcaatattcacctgccagactggcttatcaagacaaaggtaacatttttattgtgttaaaaaaatccttaaacataagtagatgtaatacagtttcttatacagtaaggcttatgaaatatggatactgatcaaacagccctaataatttaagcttactgatgaaaaactcatccacttgccttagtgaataaccaaagaccaatactttctttttccttgtgggtaagkaaagcagtttgttcaggtttgttagttataaccaatactatttatcaagtacttcttaccaagaacattatataccagtctataaccctcaatagttctacatcagagggctaaaactgagattaaaactcagatgtctggctctttccaagatagtacattgccttttaatctggtatcttttattaaacatgccacttacaggtgtccttcataatgaagttaaagtgagtatactgtggagaggacttccaaatgtggttacctcagctatatcactgcccaacatcagaaaacctg

SEQ ID NO: 175007 - DNA, 601 bp, Human
cttttttgcgcctattcagattctggaagtaaatttttttttcccttcagaaatgtgaagaaattatcttttaacaccaaataaaatgcaaattttaaaaaagcaatggcaaaagtataaagttgtatctggttaaaaaataattgcatgcaaccactttaattaacaaatttgtcagcaatccctgtgatcatattcaaactgtcattcttataaaactaccctaaggaaatgactaccaatgtggattcacccaaattcccaactgtatcacatttgatataatacctggactacagtmagcattcaatagataatttctgttgaataaaagagatgtccaatctatcaataaaacatagatccaattaaggaatttatatttacatatttttgttggtagcttcccctaataggacatcagttacatcttcccattgactaataactgataaacaatcagaatagaatgtcccttcaagtaaaatgtctacaatgagcttattctaagaaatatctcttacctgaatggcaatattgcgatcctgagcaatttcaagttctttgtttttctcagttagtgccttcagttgattgtctg

SEQ ID NO: 175008 - DNA, 601 bp, Human
ctcccaggttaaatttattcctaagttgttttttgatggtactctaatgaaatcttttcttaatttctttttcagctaggtcattgtttgtgtatagaaatgctactagattttttaatattgattttgtatccttcaattgtataaattcacttattagctctgacaggtttttgtggaatctttcaggttttctacatataggatcatataatctataagtaaagataattttatttcttcctttccaatttgggtgcattttatttccttttcttgtctgattgctcttgctggtacktccagtactatactgaatacaagtggtgagtgggcatcccagccttgcattggatcttagtgaaaaagctttcagtttctttctttcagccaccaagcagttaaataaattctattactttttaagtcacttcatagttttttttttctgaaaaattttatgtgactgtgtgcacactattttcctcggttacagatccatagtttttacaagatttataaagattttgtgacagctctgcttctttccaaaagattaagaacctccgtattgggttttatttctggactgccttttatt

SEQ ID NO: 175009 - DNA, 601 bp, Human
ctaatataaaaacctactcaatatggaatacacatttttaaaaaactatctattaaatatctagattttatgaattcgtttagttgtaactaccacttgttgatcaacacactcaagtattttgaaggaactcttgtgagactgggaaagtatacttaactaatggaatattattgtataatgatataaatatctgaaaatcctttcttttatagaaataaaaaaatttcaaaaaccattaaaaaaaaaagaacccaaaacaccttttttttttttttttttttttttgatacggagtctrgctctgtcgcccaggctggagtgcagtgacgcaatcttggctcactacaacctccggctcctgggtttaagcaattctctgcctcagcctacaaagtagctgggattacaggtgcgtgccaccatgactggctaatttctgttatttttagtagagacggggtttcaccatcttggccaggctgctcttggactcctgacctcatgatccacccacctcagcctcccaaagtgctgggattacaggcgtcagccaccgtgcctgggcaccaaaggaaacttcttaccattaactgcttca

SEQ ID NO: 175010 - DNA, 601 bp, Human
ttaaaattttataaataatcattaagctaaaaagcactaatataaaaacctactcaatatggaatacacatttttaaaaaactatctattaaatatctagattttatgaattcgtttagttgtaactaccacttgttgatcaacacactcaagtattttgaaggaactcttgtgagactgggaaagtatacttaactaatggaatattattgtataatgatataaatatctgaaaatcctttcttttatagaaataaaaaaatttcaaaaaccattaaaaaaaaaagaacccaaaacaccttttttttttttttttttttttttgatacggagtctagctctgtcgcccaggctggagtgcagtgacgcaatcttggctcactacaacctccggctcctgggtttaagcaattctctgcctcagcctacaaagtagctgggattacaggtgcgtgccaccatgactggctaatttctgttatttttagtagagacggggtttcaccatcttggccaggctgctcttggactcctgacctcatgatccacccacctcagcctcccaaagtgctgggattacaggcgtcagccaccgtgcctg

SEQ ID NO: 175011 - DNA, 601 bp, Human
cctattaaaattttataaataatcattaagctaaaaagcactaatataaaaacctactcaatatggaatacacatttttaaaaaactatctattaaatatctagattttatgaattcgtttagttgtaactaccacttgttgatcaacacactcaagtattttgaaggaactcttgtgagactgggaaagtatacttaactaatggaatattattgtataatgatataaatatctgaaaatcctttcttttatagaaataaaaaaatttcaaaaaccattaaaaaaaaaagaacccaaaamaccttttttttttttttttttttttttgatacggagtctagctctgtcgcccaggctggagtgcagtgacgcaatcttggctcactacaacctccggctcctgggtttaagcaattctctgcctcagcctacaaagtagctgggattacaggtgcgtgccaccatgactggctaatttctgttatttttagtagagacggggtttcaccatcttggccaggctgctcttggactcctgacctcatgatccacccacctcagcctcccaaagtgctgggattacaggcgtcagccaccgtg

SEQ ID NO: 175012 - DNA, 601 bp, Human
agttaacagcagtagttaagtttttggggagtcaaaagttacacataaattttcaactgtggggggaatcagcaaccctaaccactgtgttgtttaagggtcaactgtagttctcaactctcttattttaacttgtttctgccatagttaattacaaattcaatttctacaaatatatgacaaaaaattgaaatttgtgtatccaaacttgtgaattatccaaatttattttaaatacagtgtgttaagctaaatattcaacgttaaccttaattttcctgatatatatccaaagacctaytaaaattttataaataatcattaagctaaaaagcactaatataaaaacctactcaatatggaatacacatttttaaaaaactatctattaaatatctagattttatgaattcgtttagttgtaactaccacttgttgatcaacacactcaagtattttgaaggaactcttgtgagactgggaaagtatacttaactaatggaatattattgtataatgatataaatatctgaaaatcctttcttttatagaaataaaaaaatttcaaaaaccattaaaaaaaaaagaacccaaaacacct

SEQ ID NO: 175013 - DNA, 601 bp, Human
tccccttctacctctgcaacctgacccagcaagaccaaccccttttcttcagcctaggtaatgtaaagacaaggaggatgaagatggttgtgatgatccacttccatttaatgtacagtaaacgtattttctcttccttatgattttcttaacatttttttctctagcttactttattgaaggagcacagtatataatacagatcacagacaaaacgtatgacaatctactgtgtatgttattggtagggcttctagttaacagcagtagttaagtttttggggagtcaaaagttacacayaaattttcaactgtggggggaatcagcaaccctaaccactgtgttgtttaagggtcaactgtagttctcaactctcttattttaacttgtttctgccatagttaattacaaattcaatttctacaaatatatgacaaaaaattgaaatttgtgtatccaaacttgtgaattatccaaatttattttaaatacagtgtgttaagctaaatattcaacgttaaccttaattttcctgatatatatccaaagacctattaaaattttataaataatcattaagctaaaaagcactaatataaa

SEQ ID NO: 175014 - DNA, 601 bp, Human
tagcaaacggtggaaggaagattggtaatgtatagaaacatttttagagaaatgaaaaagcaagtcagacagaaattaggctgtatttcgtaaagttacattgagtgtgcctccctcttctgcctccccttctacctctgcaacctgacccagcaagaccaaccccttttcttcagcctaggtaatgtaaagacaaggaggatgaagatggttgtgatgatccacttccatttaatgtacagtaaacgtattttctcttccttatgattttcttaacatttttttctctagcttactttaytgaaggagcacagtatataatacagatcacagacaaaacgtatgacaatctactgtgtatgttattggtagggcttctagttaacagcagtagttaagtttttggggagtcaaaagttacacataaattttcaactgtggggggaatcagcaaccctaaccactgtgttgtttaagggtcaactgtagttctcaactctcttattttaacttgtttctgccatagttaattacaaattcaatttctacaaatatatgacaaaaaattgaaatttgtgtatccaaacttgtgaattatcca

SEQ ID NO: 175015 - DNA, 601 bp, Human
ctatcacatacctatagactctaatatgatacgaggtaaagcaaagttattatatgacaactaaaagcaaaaggaaggtgacagatctaaagctggagaatttaatgccagtaaaggatggtttgataattttagaaaggtttgacttataaaaatgtcaacaaaactgaagaagcaggttctgtcaaccaagaaacagcagatgctgctaagaaaatcattgagaaaggttatatgcctgcaccaggtttttaatgcagatagaagtgtactattctggaaaaaacaatgccacaaaagrtatttattagtaagaaagagaagggagcaccaggattagggcaggaagggataggctaactctaccgtactgagcaaatgcagtcaggtttatgataaggactgcccttatttataaagcttttaaccccagggcccaaaggaaaaagataaacaccagctgcctgtcttctggttacacaagaagaagacctggacaatgacagacccccttctctgaattggttccactcatgctttgtccctaaagtcagaaagtaccttgctagtaaaggggctgcccttttttttttttggagac

SEQ ID NO: 175016 - DNA, 601 bp, Human
ttacaaaatgcaaataaagaggatgtcttatttataaagtaagagtattcaaacataatcagagtaaatgtttcaaaaaagaaaactttctcattagaaatcagcaaattatacaagattattagataaaaaacaaacaaaaccccctgctgtctgtattttcaaaaatatataaacttacatttgcttaagatataattctgaatttcctaatccaaagttctttcttctgtacctaattctgtcccaaataaagtctaacacctaaatccaatcatctatacaaaacaagggtaaaaagaaaaaaagagtacaataacaaaaataatgttcccataactgaaaacacttaccttcaccagcttctttcaaaagtttgtgtagttcctctactgcccgggttagttcattgctctttgcttctgagtcatcagcggcactctaaaagttaatcttaaaaagttacctaacagtcaacaatgcaacatttagatactaacatgtgtggtgggatatttaccttgtacaaattagaaagttttatgtgggcatttaattcattgtggaatttctcttccatactggcctgttgttccttggc

SEQ ID NO: 175017 - DNA, 601 bp, Human
gaaaagaccataaatataatacattgaaaaaagcaaaaatttgaggaaataaaagactttacaaaatgcaaataaagaggatgtcttatttataaagtaagagtattcaaacataatcagagtaaatgtttcaaaaaagaaaactttctcattagaaatcagcaaattatacaagattattagataaaaaacaaacaaaaccccctgctgtctgtattttcaaaaatatataaacttacatttgcttaagatataattctgaatttcctaatccaaagttctttcttctgtacctaattcygtcccaaataaagtctaacacctaaatccaatcatctatacaaaacaagggtaaaaaaaaaaaaagagtacaataacaaaaataatgttcccataactgaaaacacttaccttcaccagcttctttcaaaagtttgtgtagttcctctactgcccgggttagttcattgctctttgcttctgagtcatcagcggcactctaaaagttaatcttaaaaagttacctaacagtcaacaatgcaacatttagatactaacatgtgtggtgggatatttaccttgtacaaattagaaagtttta

SEQ ID NO: 175018 - DNA, 601 bp, Human
atgatcttgtattgctttgttggctaaaaaacaattttaaagaccaaatattcaaacatacagttaaaattttagtttacaaaatgcaacagatcagtcacttctcccctcagcagataatattaaatttctagagaggcttcagctgacagtatctattgaaagttcttgctctacttataattttggaattgtcttcgcctggtgtttctccttttgatgtctcttacccacaaagaaaataaggaaacccaaagggtaaaaagtggttctaggtatatctttgatttcgattttgatstttaatcctaagtaaaggaaattattggaaaagaccataaatataatacattgaaaaaagcaaaaatttgaggaaataaaagactttacaaaatgcaaataaagaggatgtcttatttataaagtaagagtattcaaacataatcagagtaaatgtttcaaaaaagaaaactttctcattagaaatcagcaaattatacaagattattagataaaaaacaaacaaaaccccctgctgtctgtattttcaaaaatatataaacttacatttgcttaagatataattctgaatttcctaatc

SEQ ID NO: 175019 - DNA, 601 bp, Human
ataaacttgctacagctttctgtgcacgttcatattcctcacgctggcgtttcaaaattggtgctttggcttccacttctttcactatttcatctaggtacttattaattcttttgttctctagtttctccaaaagcaactgatcctgagtttccacataagcattatagagctgaaagtagacaaagggttgtttcaaatctaaccataacaacgcaaatatttagttgatctagtttcataataaacattctttaacactaacacaaaatggcaatgtttactatgttagttacacagmactaggaaccaaagaaagcctttcctagaatgatccactaattataagatgattttaaaaataagttttgggagaattaaattttgaagagatttgtatacatttgctgaagaaaaagaatttaacaacatttaataccattcttacctcagttagtttcatcccaggtttcactatcttagctacagctgctgcagtaggagacatggcggcaagctcttcttcagacaatatggctcctgtgccaacaaatacacatctagtataatttgtaaaattccaaactaaaagccattaata

SEQ ID NO: 175020 - DNA, 601 bp, Human
ttgttaagtgtcagagtaatgcatacagtccagtcttacttcagtaaaatcaaataattcttacatatgtttatatatgctcatgtatatacacatacagagaaggatgtgaaaaaaatacacaactgtctgttaacttagctacactttgggacttcagagggtagaggggtagaaattggagaaagcttttatttatctttgaattatttcttcatttattacaaccaacacgtataatttaaaaatttatcaaacatttgaaaaaagggaggggctatgaaaagaaacaatgggggtrcaactctgctcgagtactattcctaattaattagaatttcatacatggtagttctatcttaggtaccttcaaacagattcaaagattactgggcagtcaggtttttaaaagtaggaaaacaaacaaaaaaattctaacctgttgtgaaagatcttttacttgtatttccattcttcgattatctctctcaagtacagatgattgcttgttggctttatcagtgtcctcctgcaatcgctgaatctcctttaaaatgtaaattcaagtgaaaattttgtacttccttctaggatttataca

SEQ ID NO: 175021 - DNA, 601 bp, Human
aatagtattagttacaattctggacaagtttagaatgaaagttttcaaattaaaacattacttataaaaccttcaacttgtactgcctcaaattatctttaaaaataaagcatccttggatattaaaatctaaacaatcaaattttaatagaataaaattacttttaagtatgtattgaaggctattacttattacaaagtagccaaattacaattcccaaaacatggctccagttttgtaaaacagtgatcaaataaaacccacaaatatctatttttttgtgtgtgcttttgtatataygatagggcagagcatgaaaaatagacatttaaacaaaaagcatatatataatgccattcatgtgaaatttttacatttgtgcattgcgtggatgtacacacacacaaattagggtaaaatatatgaatgagacattaatttattgatttgcttgttaagtgtcagagtaatgcatacagtccagtcttacttcagtaaaatcaaataattcttacatatgtttatatatgctcatgtatatacacatacagagaaggatgtgaaaaaaatacacaactgtctgttaacttagctacactt

SEQ ID NO: 175022 - DNA, 601 bp, Human
ttatgatttatgaagaagtggcttgtgtaataaggtaaaaccttcattcttttttcccaattccaaatgtagtggttcaagttctaagtaagcaaagtatttcatgctaagtaactttttaatcttatttttaaaaaatcaattatatttaaagtaatgacaatgcaatattgataacaccagacacccactacaatgcagtatacaaattaagttattatacagggttagtgatggatttttgctaatccttttttcttctataatcctcagttttattttcttatgtgcttgaaagctkacataatggctggctagaggtatcaacagagaaaaaagaagtgctttaattggggttgctgaactattagatgtataggggtaactgcctgcaatatatcctgcctgctataaaacagaaacagttttatcatgtactatataaaaataaatattgtcctaacaaactaaactaacaagcattcaatgaatttaataacaaataatcatgaaatatttattatttctttggatgtgaccaagaaaattaattctcctaaaactacatagcacttgcttctcttctacctagaatagaaaa

SEQ ID NO: 175023 - DNA, 601 bp, Human
taactccaggaacagtttttatattttattttcacactgaaaatctgtcagatttgcctcaacctcaaacagcatgcttatgtaaaattaaatgagcgctggcagcaagctgcacttttttttttctaaatgggaaaggggttaattttatgatttatgaagaagtggcttgtgtaataaggtaaaaccttcattcttttttcccaattccaaatgtagtggttcaagttctaagtaagcaaagtatttcatgctaagtaactttttaatcttatttttaaaaaatcaattatatttaaartaatgacaatgcaatattgataacaccagacacccactacaatgcagtatacaaattaagttattatacagggttagtgatggatttttgctaatccttttttcttctataatcctcagttttattttcttatgtgcttgaaagctgacataatggctggctagaggtatcaacagagaaaaaagaagtgctttaattggggttgctgaactattagatgtataggggtaactgcctgcaatatatcctgcctgctataaaacagaaacagttttatcatgtactatataaaaataaata

SEQ ID NO: 175024 - DNA, 601 bp, Human
ttgttcagctaacaaagactctctttgctgagaaagacgaacttcagacaatttaagcatttccttttccttcttcaaattttctgctcttacctaaacataagtagaaatgaaataaaaaatgctgaaaaacatggtgtcaagtgtattaagattataaaattaaaatgattcatacatcactacttttttttaatgctcttagggactatatctcctcattgtataaggaaatacaaaacagtttcatgtgctaaaatacgaagcaaaaattattggggatcatcaatgaaaaaatctktcaattacaaatacttatggttccttgctctaacaatccacagtttaaaaaataacagcaagaaaaatttaatatgtgagaagaagaaagcagaattgcatgactgctgtaatcattcatacctgactactattaaattatgtaacttttagaatccaagccggtttcaaagtacctgtttaaaagtgatgattgatctatttaaagtttctccctcccctcaaccccaagagtctgagtctcaaggggaccagggagagtgttttgaaagctcaaagtactcatatttacacacaagta

SEQ ID NO: 175025 - DNA, 601 bp, Human
ttaagagaaacttattcttgcagatttggtaagcaaccttatttccaaggggcccgggttaaaaaatcaaataaccctcttcagaaagaataatttttaaagtatcaataaatagtttcaagaattagaaagctgggtacataccttgatcaaatgccaagctgaactattctgaatcttttaagacagcaaatttactagtttaggcccaaaattgagtaccactatataaagaaaaagttgggtttttttttgtgtttgtttcattttactagcattcacaaagaattaggctatttaytgacaggatatattataatcccaagaagtacttgtttatttacaattatattggtctacttattttatttacctttaccagttctctgtgaagactgagaagcaacttggacttccatattactgaggtgctgtttcaatgtggcaatttctttttgagcattttttaatagttcttttgtgttaagatgaagatttgtctctgtatccagttgtctctttgtatctaaaagttgaacctataaaatacattaatcttataacattctttaggttcctaagtaactaaaggttcaaacta

SEQ ID NO: 175026 - DNA, 601 bp, Human
gctgggcgctgtggcttacgcctgtaatcccagcactttgggaggccgcggcgggcagagcacaaggtcaggagatcgagaccatcctggctaacatggagaaaccccatctctactaaaaaaaaaaaatacaaaaaatgagctgtgcgttgtggcggccgcctgtagtcccagctactcgggaggctgaggcaggagaatggtgtgaacctggaaggcggagcttgcagtgagccgagatcgcgccactgcactccaacctgggcaacagtgcgagactctctctctcaaaaaaaaaaataataaataaataaataaaaccatatagaaagattatcaagacacaaaggcttcgaacttgaaagatgtatttaaaaagggaagcaaaatctatgaaacaaatcttttacctgaggctaccaacgagcaaatattgggaatactgctttaaaggagatcacaaatcaactcattctttaagagaaacttattcttgcagatttggtaagcaaccttatttccaaggggcccgggttaaaaaatcaaataaccctcttcagaaagaataatttttaaagtatcaataaatagtttcaagaat

SEQ ID NO: 175027 - DNA, 601 bp, Human
gaaataaaactggctgggcgctgtggcttacgcctgtaatcccagcactttgggaggccgcggcgggcagagcacaaggtcaggagatcgagaccatcctggctaacatggagaaaccccatctctactaaaaaaaaaaaatacaaaaaatgagctgtgcgttgtggcggccgcctgtagtcccagctactcgggaggctgaggcaggagaatggtgtgaacctggaaggcggagcttgcagtgagccgagatcgcgccactgcactccaacctgggcaacagtgcgagactctctctctmaaaaaaaaaaaaaataaataaataaataaaaccatatagaaagattatcaagacacaaaggcttcgaacttgaaagatgtatttaaaaagggaagcaaaatctatgaaacaaatcttttacctgaggctaccaacgagcaaatattgggaatactgctttaaaggagatcacaaatcaactcattctttaagagaaacttattcttgcagatttggtaagcaaccttatttccaaggggcccgggttaaaaaatcaaataaccctcttcagaaagaataatttttaaagtatcaataaat

SEQ ID NO: 175028 - DNA, 601 bp, Human
agaaataaaactggctgggcgctgtggcttacgcctgtaatcccagcactttgggaggccgcggcgggcagagcacaaggtcaggagatcgagaccatcctggctaacatggagaaaccccatctctactaaaaaaaaaaaatacaaaaaatgagctgtgcgttgtggcggccgcctgtagtcccagctactcgggaggctgaggcaggagaatggtgtgaacctggaaggcggagcttgcagtgagccgagatcgcgccactgcactccaacctgggcaacagtgcgagactctctctcwcaaaaaaaaaaaaaataaataaataaataaaaccatatagaaagattatcaagacacaaaggcttcgaacttgaaagatgtatttaaaaagggaagcaaaatctatgaaacaaatcttttacctgaggctaccaacgagcaaatattgggaatactgctttaaaggagatcacaaatcaactcattctttaagagaaacttattcttgcagatttggtaagcaaccttatttccaaggggcccgggttaaaaaatcaaataaccctcttcagaaagaataatttttaaagtatcaataaa

SEQ ID NO: 175029 - DNA, 601 bp, Human
ccttgttcagggattcttctaaactagtaaccattgcttgatattgttccacattgctcgtacttgttttgagtctctcctttaagtcattcacctgctcttctgtctgtcttagctgactcacaagatcatccacatcttctttgttgctaggctgacctaaaagacataacagctctgttaaaattaacattttcaatagtattagagatgactgttataaagagcttatgaaattagcattaaggttcaaatacagatatatttagaaagtatatttcaatccatgccgaataccaamataaaagcaggtactttgttatgttacttcctcaaaaacaaaaaaattcaaatattaatattttaaatctgttacaaaaattaagaaaaggatattcaaaagagaacaatcaaatatttccactaaactgagttagctatatgaagaaatgacagaattcttaatttattaaatgttacgggaagtcagggaccccgaatggagggagcagctggagccgtggcagaggaacataaattgtgacgatttcatcttaatatggacatttatcagttctcaaataatacttttataatttct

SEQ ID NO: 175030 - DNA, 601 bp, Human
ctctagttactaaaaacaaagttaacaaatgtgttgagattgaattctgaattcagaattatacatacctgtttttccttgttcagggattcttctaaactagtaaccattgcttgatattgttccacattgctcgtacttgttttgagtctctcctttaagtcattcacctgctcttctgtctgtcttagctgactcacaagatcatccacatcttctttgttgctaggctgacctaaaagacataacagctctgttaaaattaacattttcaatagtattagagatgactgttataaasagcttatgaaattagcattaaggttcaaatacagatatatttagaaagtatatttcaatccatgccgaataccaaaataaaagcaggtactttgttatgttacttcctcaaaaacaaaaaaattcaaatattaatattttaaatctgttacaaaaattaagaaaaggatattcaaaagagaacaatcaaatatttccactaaactgagttagctatatgaagaaatgacagaattcttaatttattaaatgttacgggaagtcagggaccccgaatggagggagcagctggagccgtggc

SEQ ID NO: 175031 - DNA, 601 bp, Human
gttgagatgaactaaatggcaactaatgacttagttgaaagaattcaaatccttacaagttaaaaaaaaaattaatacggttaacctatttacctgttgttccatgctctctatggctcttcttttatcatcctgaagttcttgtttttccttctctacttccatcaacttcttttccaactgtgtctgaaattcagctgactcttttaaacgaacttcaatattcttacgcacttcttctgtcacctttaccatattacaaacagtaggatataaaaattacacacatttaaagtcatamaattattttctccaaatcaaaactaatttgagaagtaataaaattaatgtttgttgtatattaaaaaaagaatccatcaaaggtgattagaagattcaacaacaagcaaaaacaccatataaatctacaagcatttaccattcatcttggctactggccatttttctcttttgaaatgaaatttccaatctctcatttctccctcaatcctcatatccacttgccaaatccatctattctacaatcgaaaggtattttcctcacacattttgatttatttacaatgatgtcaaccacaaa

SEQ ID NO: 175032 - DNA, 601 bp, Human
ccaccaacaaagtattaacattaggtaaaaacattaatccaaatctctatttacctttctgtatctttttttccttgctgcactaaatttattagttctaaaatgttattctaatcctcagtttattccctcttgttcagaaatctctcattttgatccattgtttcatcactttggccatgagaaattttactgaattatctgtgaagaattttttccttctcataggttataattatccatcttctgcacttggtattactttcttcccccactgtttttaaagctatagcatatttcrtggttgccatgctacactgttcatgcttagacagacattacattactattataatttttttttttttttgagacggagtctcgctctgtcgcccagactggagtccagtggtgtgatctcggctcactgcaagctccgcctcccggatttacgccgttctcctgcctcagcctcccgagtagctgggactacaggtgcctgccaccaccatgcccagctaatttttttgtatttttagtagagacggggtttcaccgtgttagccaggatggtctcaatctcctaacctcgtgatccacc

SEQ ID NO: 175033 - DNA, 601 bp, Human
ttaagtctaccaatttcttctgtcaattgttgaatacgcttagtatgaacttccttttcagaaaggagcttccgatattcttctgtatctggatctttctgttgacttactagatgctagaataacaaaaatgcatacttgatttttttaggttttatgaaacaaatgtgctataataaaatggcagaatatctgattatgtttatattaggtgtcctgcatgtaaagtaatcaagcatggaactacaagatactaagatcaaactaagctttggcttgtttggctaagaagtctacccayaatacaagaggaaaaaaaaataaaatgtcattaaatgttcattattttttcatatttgtgaataaacatttcatattagttacaatgaagccaaataaagggatctgaagaatcaaaactttcaatattaagtacctaatttcattgaagtgacatttacaagaaaaaaaatatagacaatgcattacaagttaaacacacaaaccttctgtagatgccaggtaatgtgcttcacatttgttaaatttttatcacacgaaaggtgataagggaaaactaaagctccaagaggttaagaaa

SEQ ID NO: 175034 - DNA, 601 bp, Human
cacaaagcttcatctgataggactgaaagtatggtgaaaacaagctggcaaatacatgatacagttctgcagagaaaacaactctttagtgtatgtttttacaatagaatacacagatttctttttcctaaacagaaagatcactagatattccctgagctttaaaagaaaaataacagactatgaaataactaaaactcacattcctctttcaccagaagctggagttgttttcaatgtgatctgtctctgctgttcagggacctataaagagaaagctcttgattgttgttcctagccyacaagagtccactaaaaatgccacaaaaaaattgtcattattgttaattctctccgcatatattgaattttagccaaaattcactgacaaaggctcctatatcaccaagcactttcaagtaaaatgtacaaagaaaaacaatttgttacttaagcagaattagctaatcaccttattagaaggttcttgaggctcatctctctgctcaaggtgtctctcttgatgctccctgagttctctttccaagcgactaattcgaccttcatattgggactttagcgcagtaatgcgaacatccaa

SEQ ID NO: 175035 - DNA, 601 bp, Human
aaactacacagggaatgctccagagtggtgcatcctgacaatgtaaaatgtatctagctgttgaattgctgaacccaagtctcagcccagcattttctatctgtcatcatgtaacatcacggggaaaatcagtagcagcctaacttagaaaccaactgtaaactaaaagatgagagacgttttctctgtcacaaagcttcatctgataggactgaaagtatggtgaaaacaagctggcaaatacatgatacagttctgcagagaaaacaactctttagtgtatgtttttacaatagaatayacagatttctttttcctaaacagaaagatcactagatattccctgagctttaaaagaaaaataacagactatgaaataactaaaactcacattcctctttcaccagaagctggagttgttttcaatgtgatctgtctctgctgttcagggacctataaagagaaagctcttgattgttgttcctagcccacaagagtccactaaaaatgccacaaaaaaattgtcattattgttaattctctccgcatatattgaattttagccaaaattcactgacaaaggctcctatatcaccaagca

SEQ ID NO: 175036 - DNA, 601 bp, Human
tagcatgcaataaaatgttgcctgaattaaataaatatctgtaactgattttgcatctattcatttaaattactgttgaataaaattaatgaaattaagctcaaagtaaaattagaatttttcattaagcatcatttagtttttaattgatataacagatagtaaatttgattagtaatatatttagtttattggatgtagctgaaataaaacattctctactttcacagcacagaaatacttgaataatttactgaattctaacatttgtcaagataagaatctaaggaaatatgcaggyagcaaagttttactgaacacctactgtggagttaggtaaagggattaaacaataagaagctgagatttttgcccttgaggagctcaatgtagtggagtaaaaagcatgtataccacagaataaaatacaaagttgtaattgctgtaatgaataacaagagtgtcatgggaaaaaattgaagaaagcaatgaaatggtcagtttcagtgagaaagcaatgttggattgagccagtaattcagtatgattttccaaagtggatttcatatattctttgtcattacaagtgaaaattttggtc

SEQ ID NO: 175037 - DNA, 601 bp, Human
atcagtactttcttctgccataacttcttcctgtatcataatacactaatatattaaccatatcagtgtagtagatgaagggttacctgtttttgttagttctctcatttgaaaaaacccttcaaatctatattttatgaaactatagaaaaataaaaaaattttatttaaaaattataatcacattcctcctcagtatacacaaagtaaggtttatgaacattaatacatgctaatacaattaatttagtagccttaatgtttgatttgaaacctgcttcattacaatttaatcttaacmacaaaaaggaatataattttggctaatcttagaaaaagatagcaggtaacagtttatgtccatgagacttagaaacttcgagatgaaattcaacttatgtttttatgactgagcttttttattgaaatagaaacaaatgcaattaaagatatgcaagaatataaaacactgttggtaataatacctgggttgtcagtggaatctttgtagaaagttcaataaaagtgttttccagataatatattttggccccaaaaggttaattttctttaggctgtagctgaaaagagtaccttaact

SEQ ID NO: 175038 - DNA, 601 bp, Human
tcttcatcatcactgtcaattacaatgacatcatctcctttgccttgaccatcctgggatgaagttgtcgtctgctgatctgattgaagtggcccaagatctatttgtagagactgagaggtttcttcactgtcttccataggtgtataatctccctgggtaactccctttaaaaataaaaaagttaaaaaagaattaagagccctataaacatacctaaaactatatgtgaggtattattataggtcaaagtaaagaataatgagtacttatggactagcagcatttaatttaatttttyttttttgagacagtctcgctcttgtcaccctggctggagtgcaatggtgctatctcagctcactgaaacctccgccccactgggttcaagcgactctcctgcctcagcctcctgagtagctgggactataggcaccaccccacgaagtctggctaattttttgtatttttattagagacagggtttcaccatgttggccaggctggtctcgaactcctgacttcaagtgatctcccaccttggcctctcagagtactcagattacaggtgtgagctacctcagccagctacatttaattt

SEQ ID NO: 175039 - DNA, 601 bp, Human
ttaaacaggtggagttgaagaaaatgataaaattacactatatcaggagctatttaaaaaatgtttattaatctaaaataagaagctgtcaatataggattaaaccccaaaataaaacaaacaatttgaccttatatatataaaatacactttatatataaaaaaatgacaaaaatgaactatggggctccaagaggaaacaaaaacaattcttgtttcttctttttatctccggaaaccatagcacttacatttaaagccatacagtcatttatcaataagacttaaaattaggtctaaytgataacaaatcctaaaagactcatcaattgtcaaaaaaacaaaatgaaacaaaattttaaaaatgggcattccatcactggctctacactaattttcattataaaatgttgatttctgaactaattaagatagaagaaaaacaatatatataatctatttaatatataatatattaaatatataatatatatattatatatataaatatatataaatatataacatatatattatatatataaatatatataaatatataatatatatttatatatataatatatataaatatataata

SEQ ID NO: 175040 - DNA, 601 bp, Human
aatatcaagtggtccagtttaattctaaatttaaacaggtggagttgaagaaaatgataaaattacactatatcaggagctatttaaaaaatgtttattaatctaaaataagaagctgtcaatataggattaaaccccaaaataaaacaaacaatttgaccttatatatataaaatacactttatatataaaaaaatgacaaaaatgaactatggggctccaagaggaaacaaaaacaattcttgtttcttctttttatctccggaaaccatagcacttacatttaaagccatacagtcayttatcaataagacttaaaattaggtctaattgataacaaatcctaaaagactcatcaattgtcaaaaaaacaaaatgaaacaaaattttaaaaatgggcattccatcactggctctacactaattttcattataaaatgttgatttctgaactaattaagatagaagaaaaacaatatatataatctatttaatatataatatattaaatatataatatatatattatatatataaatatatataaatatataacatatatattatatatataaatatatataaatatataatatatatt

SEQ ID NO: 175041 - DNA, 601 bp, Human
taaggttttactatgtcaacactaatgatttcagcttagtatcagttgttagttatctattaccagataatcactaattatttaatacacatttcaaaataaaattattttctacgacttccatactcttttaatgcccacaacttttcagtggacctccaggacttatccaagatttaacaaaatatatgctatattgatccaaaaatcttttattcattggaaaagcagaccatactgcaaagctccaatagccccaaatcttgaagcatgcagcttgattagactgacctcctctggytgtgaactgctgttacaagtagtccctaatttaatttttcctcttaatggcagcatatagcatttataataccgtaagggttacaaaatgtttgcatcttacagcagcccaatgaggcagaaaagagtataatgacagcacctaacaatcataaatatagtagactttttatgagagcacaacagtcacaaagctagaacaggggccaatctctttttaccaattcaataaataaatttatatattagaattaagtgcaattctagtttagaaaataccagagatattcaattcaaaaaa

SEQ ID NO: 175042 - DNA, 601 bp, Human
agacaaattacctaaaggttagaccattagagaatcagtgtaacaatcaaaaaggataaagacagaggagaagccttacaactacattttaatcttttggttttcctgaattttgaattttaacaaatgtctctcaaatgtctgggtattcttctacatacactgtagcaacaaaagaagccatcttcaactatgaaaagttgaacaggatgtcacagaatttcatagtttaaaagtctgaggtctagattcagatccttgctctaatacttaagctacttagctacttagtaagctatgygacacctcaagtcactttacttctgcgattcagattcttcattgatacctaaaccttattaagtttactacaagaattaaacaattcaatacaagtgtagttgcttgaaatgtactcaaatccatccattaattttgttcagggcactaggcctatttttgcttggttgcaaaaataaaaataaaaataaataggaaaaagaaggaaggaaggaagggagggagggagggagacctagaggagcaaaaattcctccctctatatttcaactacgtgatacacaaaaaatgtttcttaacc

SEQ ID NO: 175043 - DNA, 601 bp, Human
cttgggggaagtggatgtggtgggcgtctcggtgactgaggtgctcgaggggcctgtctttcagatgctgatgatggctgttgttctctagaaacctcctgagaaaaagaagattctgcagcacctgtatttccttcacctgtaggaaaagagaaatttacttttgaactgctaaatttaccacaaaaaaacttggacaatccctagaagtataaatcttgccaacaggaatgttcaccgtacgaatattttcagaagtaaagtagtgaggtgtgatggaagcaaatgtgggttttacacycagagacaatgggatgtgtacttattcgctgtgtggctttgggcaagtcccttaacctctttgagtctattttttggttggttaatagagcaaatgtaacctccaagtctggtgtttctaaaatggtttttctaaagatttcagataatgaacataaagctcttagctcgacctatgataaacattaaaaacactaaaattaaagtaaacatttaataaaataaaataaaactaaaattaacatttaataaatctggattaattttaataaagtagacaaattacctaaaggttagacca

SEQ ID NO: 175044 - DNA, 601 bp, Human
tctgttaagtacaacagaaattcctttatcttttataaatacgtgcactgtagagaaagaaaccttcaaatcagataatggtgagctgcgaaaatgtactttaattaaaacccaagaaaatctttttcttttctcacttgagaaataacaattttatttgctatgactataaccatttcaatgtatgcacaacttttagtaacacttgcctttctaaacatccctcagagattagttttagttcaaagaattttataaaaatatgccaaaataccaaaaagttcatgggattgctaatttwaaaaaaccaagagagagagagaaatacataatggaaagggagaaaagccaagatttttttcaagttcatttttcataatgaccagtacttttaatacctgaactggtggtcccaactcctgaggtggggcatgaatggtcagtcttgggggaagtggatgtggtgggcgtctcggtgactgaggtgctcgaggggcctgtctttcagatgctgatgatggctgttgttctctagaaacctcctgagaaaaagaagattctgcagcacctgtatttccttcacctgtaggaaaagagaaat

SEQ ID NO: 175045 - DNA, 601 bp, Human
ttttcccatcatgaagttattttcactagtggtatttcagtagaatctatatttgacagtgtttacacatactattttatagggaaaaacttaagctaaattaatagaacttttgtacttttcctactctttttccaagtgcttctgattaagagatgcccgaccctactacatgctaaatataaggggtcatacataccttcattaaacttaaaagttaaaatatgtgattaccaagaaatgagaaaaaatattcttctgttaagtacaacagaaattcctttatcttttataaatacgkgcactgtagagaaagaaaccttcaaatcagataatggtgagctgcgaaaatgtactttaattaaaacccaagaaaatctttttcttttctcacttgagaaataacaattttatttgctatgactataaccatttcaatgtatgcacaacttttagtaacacttgcctttctaaacatccctcagagattagttttagttcaaagaattttataaaaatatgccaaaataccaaaaagttcatgggattgctaatttaaaaaaaccaagagagagagagaaatacataatggaaagggaga

SEQ ID NO: 175046 - DNA, 601 bp, Human
tattttcccatcatgaagttattttcactagtggtatttcagtagaatctatatttgacagtgtttacacatactattttatagggaaaaacttaagctaaattaatagaacttttgtacttttcctactctttttccaagtgcttctgattaagagatgcccgaccctactacatgctaaatataaggggtcatacataccttcattaaacttaaaagttaaaatatgtgattaccaagaaatgagaaaaaatattcttctgttaagtacaacagaaattcctttatcttttataaatamgtgcactgtagagaaagaaaccttcaaatcagataatggtgagctgcgaaaatgtactttaattaaaacccaagaaaatctttttcttttctcacttgagaaataacaattttatttgctatgactataaccatttcaatgtatgcacaacttttagtaacacttgcctttctaaacatccctcagagattagttttagttcaaagaattttataaaaatatgccaaaataccaaaaagttcatgggattgctaatttaaaaaaaccaagagagagagagaaatacataatggaaaggga

SEQ ID NO: 175047 - DNA, 601 bp, Human
aattaactgattcacttaattcttataacttatgcaacagaaattattctattgttattcccatttttaaaatgaaggtgctcatgaacagagaacctaaggaacttgctaccgctagtaaacagtagagttaggtttcaaacacaggcattctaactctagaggccatgttcttaaacattcttatattgtctttaacttcaaaattcttggtagaagtaactgtatgtcattcacctctgtataattttccccaacaatacatcctcaactgacctaccccaagtacttattagtacayagtagagagggactcaacaaacaatgagttaaccaaatgataaacaaactaacagagaaagactaaaagtttgattagttataaagtatgtttctctttcattaacttactgaattgcttcagcaaatccatcagtacgatgtggcaccacaagagttggagtacttggaactgttctgtcttcatcatcaaaaaaatgctgttgctaaaacaaagaaaacagagttaacaaacaaaacaccacacatatggactatataaatatctgctcaagaaatgaattacttttacataatgggt

SEQ ID NO: 175048 - DNA, 601 bp, Human
cttcccaaggagctagggctaccaacacagacccagctaattatttttcatttttgtagagacaggggtcagtcttgttatgttgtcaaggctgcacctgaactcctggcctcaagtgatcctcctgccttggcctcccaaagttctgggattacaagtgtgagccactgcacctggcctcaaaattttaaatacaacttaaagacatcctttaaactttctaatgctacagtacccttaaaacattcgctaaaatgctcttaagagtttcatacaagctaattttattgagtatccaackatggatgttaattacaaagtaattaacaaagtaattaccaaggttactaagcttaaaatgttggcattccaatttaagcctagatgcccaagtctaggaaactgtattaacatacaaagtcacaaaatcacataacattttaaatttacaaagtcaacttacaatttcatataagaagaggccttcagtgttagaactaatatcctaaacaagcagatgttacattacatgacttttatgatggctaaagattgagcttattgtaatagtagtatgcattctctattcatttaccaagtg

SEQ ID NO: 175049 - DNA, 601 bp, Human
atggggctgttgtgtgctccctcctgagtcacagccctcttgtctggcagggtggaagggagaggactcaccgcgatgagctggacgcagtggtcggcggaggtgccccggacgcagaggagggagggctggatgcccgcttcccggaaggcctcgctcatgttgccgcacttgtgctgctctgggtccgaggtggcgcaccaccgcacctccatgccaccgagcactgcgggcaggggaccgtgaggcccggctcccccgccctgcccagccccggcccaccatggagggtggctccagmagttctgtgtgagcccattcgcctggacagccagtcctctagggcagccctgccctcccacagggaggcactaggcgcagagacaggggaagggctggtattcctgtgctcagggcctctctgaccaggagcacggctgctggcaaatggaatggctcagaacccggccctttatggaggaatgggagggtctacaggtcgcttctcagctacccccacctggtgggagcactggctagggagtctcggcaggccctggaagtggaagcttcttcccctctccaggcctcccgaagaggg

SEQ ID NO: 175050 - DNA, 601 bp, Human
gggcctggcagggcgaggtcggctcctttcctggtgaatggggctgttgtgtgctccctcctgagtcacagccctcttgtctggcagggtggaagggagaggactcaccgcgatgagctggacgcagtggtcggcggaggtgccccggacgcagaggagggagggctggatgcccgcttcccggaaggcctcgctcatgttgccgcacttgtgctgctctgggtccgaggtggcgcaccaccgcacctccatgccaccgagcactgcgggcaggggaccgtgaggcccggctcccccgccstgcccagccccggcccaccatggagggtggctccagcagttctgtgtgagcccattcgcctggacagccagtcctctagggcagccctgccctcccacagggaggcactaggcgcagagacaggggaagggctggtattcctgtgctcagggcctctctgaccaggagcacggctgctggcaaatggaatggctcagaacccggccctttatggaggaatgggagggtctacaggtcgcttctcagctacccccacctggtgggagcactggctagggagtctcggcaggccctggaagt

SEQ ID NO: 175051 - DNA, 601 bp, Human
gtggaggttggccaaggtcacagaagtcatgggaaggggaagggctgggtctgctgagctgtgccgctgccagacagcacctccctacccggagccgggcttctgaagggaggccctgagagtgcaggtggctcggcattaaggacgccttgctcacccaaggcagttacgcacacagcaccgtgcccggcaccacgccaggcccgggacagcccgcagtaagagctgagtgggcacaggctagggggctgctgggctccctgcgggcaagagcagacttggggcagctctctgtgtcccyggagctcctgtccctggggaatttgagagagccttagggcgttcttctggctgggactccaggactgctctgtggacagggctgatggccagctcaggccaggcccagcaagggcagcctggagagctgacttccagcgcaggctgtcctctctcctcccactgcaccctcttaccttgatcgtacacttcgcccaccaccggcttcaggccgtgctcctttcccgcctcatagatggctcctccatccagagtgatggcgtcagcctcctgggcctgcaaggaaatgtggctcagccaa

SEQ ID NO: 175052 - DNA, 601 bp, Human
ctttgagtacatcgcagcccatcaccgagaggcggccgctctccaccaggtagcccacgggcacgttccagcccactgtgcgattgatgcccgtgtggcaggacttcacgcctttcagggtgtcaatggtcacatgggagctcctcctgaccacagccacggcgtaataggaggtaccgacctctaggaggggaggggagtgggtgagggcagcagggagaggcctcgagagaggctgcaccagcaccctgcctgggcgggctgtgggagaggtgtgtgcacggagcacggctgtacacayggatgtgtgcatagcgttctcgttaccaagagagcaagtgggcttcatctgcatgtattaagaggccctgccctctagcctcttgaggtagagacgatcctgagatattgatgtattcattgatttccccctcttccttccccagcagctggtgcttagctgggtccacatttgctcacatcaggggagttatttagctggacagaaagcagaagccagcaagtccttgctttccaagagcctaggcccctaggagaacttggagggtttgggggaatggtgtcagggtcatgggaagaa

SEQ ID NO: 175053 - DNA, 601 bp, Human
ggccacgctcatcgccagccagactgagcttttccagagtaagccctcttcctggttttttttttgtgacctcccagaggagtagatatttaataaatatgccaagtgcctggtgagccactcacacctggccaccagctgagagggtgaggcttccaggctctcgcgggtttacacggctggttgggctgatgagccacttgggagctttctgggtgcaagtcggcacctcgtttgggtcctgaaaaaatagcatttctggtcctgtaaagccgaggacacatttctagacacagtgacmtgcgcccggtctatactggtgggaagcactcctgggagattcactgcttcccactcatgggctgggcctgtgcctggctgtgccatgtgggacaccacgatgcgtgagcaagaatcgcgccccacagggtccaagcaagcaggaagtcaagcggcggcgccggcggcagagtggaggcgggggaggcacggggcgggcgggggctgctgcgccttccaggaatgaagaatggtggcgaggccggagggaggctacccagtgaagggacgagcatgggccaaggaaaggagggggaggcct

SEQ ID NO: 175054 - DNA, 601 bp, Human
gggtccaccaaggcagcagacagcactgggagcgactgtcatttaaaaatggttcgggggaactaaacatttcctcctaaatgaccacgtgggataactcagtatcagccagatgctcttctcactgtgggtttcatttccagctcagccaactgtgactgatgacagaggggaaataaagaattattgaagatcactgatgggtagacaacccttctcacggcacagggagggaggcacacgcccggcggccagcctcacgggggacgaggtcagggtctgccgccctgcatggttcttycggccctgccagcaccaaaacccacaagtatttatcctgtgccgcgcgaggaggccctgctgctggcacctgagccagtcgggccacgctcatcgccagccagactgagcttttccagagtaagccctcttcctggttttttttttgtgacctcccagaggagtagatatttaataaatatgccaagtgcctggtgagccactcacacctggccaccagctgagagggtgaggcttccaggctctcgcgggtttacacggctggttgggctgatgagccacttgggagctttctgggtgc

SEQ ID NO: 175055 - DNA, 601 bp, Human
agaggcgacagagggactcagagtaactggtctctcctgcccccgggacgcagctgcccccaaaatagtcgctgacagctgtgggaaggaggtagagaggtcactcagcagaactttcttcagagccaagccaagcccccagggtcagcagggggcccgggctctcatctggactctgctgagaatggttccaccttccagcttcagtctgagcaaagctggggagtggacccgatcagtgacccccaaaccgggtccaccaaggcagcagacagcactgggagcgactgtcatttaaaartggttcgggggaactaaacatttcctcctaaatgaccacgtgggataactcagtatcagccagatgctcttctcactgtgggtttcatttccagctcagccaactgtgactgatgacagaggggaaataaagaattattgaagatcactgatgggtagacaacccttctcacggcacagggagggaggcacacgcccggcggccagcctcacgggggacgaggtcagggtctgccgccctgcatggttcttccggccctgccagcaccaaaacccacaagtatttatcctgtgccgcgcg

SEQ ID NO: 175056 - DNA, 601 bp, Human
aacatgccacttccccctccacggccctctctgggcaaaggtgtttttccccagcatttgtggcctcagctcctccctgccctcggcccctccctgcccccactccgctcaccggaaggccccgctgtagtcgtagtatctctccagggggctcttgtcacacaccccttccccagagctgtcacccctgcagaggcgacagagggactcagagtaactggtctctcctgcccccgggacgcagctgcccccaaaatagtcgctgacagctgtgggaaggaggtagagaggtcactcagcrgaactttcttcagagccaagccaagcccccagggtcagcagggggcccgggctctcatctggactctgctgagaatggttccaccttccagcttcagtctgagcaaagctggggagtggacccgatcagtgacccccaaaccgggtccaccaaggcagcagacagcactgggagcgactgtcatttaaaaatggttcgggggaactaaacatttcctcctaaatgaccacgtgggataactcagtatcagccagatgctcttctcactgtgggtttcatttccagctcagccaactgtga

SEQ ID NO: 175057 - DNA, 601 bp, Human
ctggtctgagaatggggacatgggagtggccaaaaggctgttttttccattttcttctcttggagccctcacctcactaaatataccaaacacgttgatttcatgagcaaatccggtttggcatattccagctggatgtttttaaactaaccagggcacagaactatataaagggtgctttgatgagacgcagccaacatgccacttccccctccacggccctctctgggcaaaggtgtttttccccagcatttgtggcctcagctcctccctgccctcggcccctccctgcccccactcygctcaccggaaggccccgctgtagtcgtagtatctctccagggggctcttgtcacacaccccttccccagagctgtcacccctgcagaggcgacagagggactcagagtaactggtctctcctgcccccgggacgcagctgcccccaaaatagtcgctgacagctgtgggaaggaggtagagaggtcactcagcagaactttcttcagagccaagccaagcccccagggtcagcagggggcccgggctctcatctggactctgctgagaatggttccaccttccagcttcagtctgagca

SEQ ID NO: 175058 - DNA, 601 bp, Human
cactcccctgaccccgctccctgctggtctgagaatggggacatgggagtggccaaaaggctgttttttccattttcttctcttggagccctcacctcactaaatataccaaacacgttgatttcatgagcaaatccggtttggcatattccagctggatgtttttaaactaaccagggcacagaactatataaagggtgctttgatgagacgcagccaacatgccacttccccctccacggccctctctgggcaaaggtgtttttccccagcatttgtggcctcagctcctccctgccckcggcccctccctgcccccactccgctcaccggaaggccccgctgtagtcgtagtatctctccagggggctcttgtcacacaccccttccccagagctgtcacccctgcagaggcgacagagggactcagagtaactggtctctcctgcccccgggacgcagctgcccccaaaatagtcgctgacagctgtgggaaggaggtagagaggtcactcagcagaactttcttcagagccaagccaagcccccagggtcagcagggggcccgggctctcatctggactctgctgagaatggttcc

SEQ ID NO: 175059 - DNA, 601 bp, Human
ggcaaatgtactctcaaatgggtcagaacacacacgcacacacacacacacacacaataaaatgtgggaaaatgctaaacagttagaatttgggtgaagaatagaagggagctctttgagttattcttgtaagttttccaaagctcagttctttcaaaattaaaaaacttaaatgacatgatggctcaatatataacaccagtctttgtgggttttttttttgttgttgttttttagacagagtctcgctctgtcaccaggctggagtgcagtggtgtgatctcggctcactgcaatctcygcctcctgggttcaagcaattcccctgcctcagcctcccaagtagctgggatttgaggcacccaccaccacgctcggctagttttttgtattttagcagagataggatttcaccatgttggccaggatggtctcttctcctgacctcgtgatccgcccacctcggcctcccaaagtgctgggattacaggcatgagccaccgtgcccagcctcaacaccaaactatatcttaaaccttcccagggatgagggacaaattctccaggcaagaggagaaaaatgccaggaagggctggtagg

SEQ ID NO: 175060 - DNA, 601 bp, Human
attgagggacattctataaaataaccggcctgatgcttcaaaatgccaatgtcataaaaacaaagactgagaaactgttccaagataaaggaaagtaaagagatctaacaactaaaccccatgcgtggtaagagtttaggtcctggtctgcaagaaatgggcatgaaggacagaattgggacggtgagtgaatctgcaatatcggctatagactggataacaggattgtatcaaagttgcgtgtcctgatttggattactgtggctaggtacacacctccttgtcttaggagatacatacyaaagtattcaaggggtatgacataggcaaatgtactctcaaatgggtcagaacacacacgcacacacacacacacacacaataaaatgtgggaaaatgctaaacagttagaatttgggtgaagaatagaagggagctctttgagttattcttgtaagttttccaaagctcagttctttcaaaattaaaaaacttaaatgacatgatggctcaatatataacaccagtctttgtgggttttttttttgttgttgttttttagacagagtctcgctctgtcaccaggctggagtgcagtggt

SEQ ID NO: 175061 - DNA, 601 bp, Human
cttagattgcctcagattaccatcaacactttgaaaaagctgccaggtgcacgcctgtcatcccagctactcaggaggctgagatgcgaggatcagttgaggctgggggtttgagaccagcctgggcaacatggtgagacccccatctcaaaaaaaaccccaagtttgaaagagctgattcttaacccaacatatccctactctttgcccgttttccaaattctcctttgtcagactcgtcctggggcctgtgaacgggagcccatttccaggcttgcccagcactagagcgcatcgtccyacgtgcttcctcgtgtgcagggcactcgccttcttcctcctcagatctggtccatgtttgccttcgtgatggactttctgatttaaaaggcaatggttaataacagcaaagaatgacaatgatttaaaaaaaaaacccaatcatcagacgtcctgggagacgcaaaactgcagacagaacggtgtgtttgctgcttgctggcaggtgcggggagataactagcaggggcctgaggaactcctgggctgaagggtctgccccatcaagatctcgattgtggtggtggttatacaactgcat

SEQ ID NO: 175062 - DNA, 601 bp, Human
cggtcgctcctccccacccgtctctgtgggcttgttgcagtagacactctcctcttccccaggcagcagggggtgtgggtagtaagaactgcccaggcactgccaccacccgcccacctggcccacgctgcacctgcgtgactcccacctggatccgctccatgcagtgttggggggacttggctgacacgcactggatctctggcttgagccgctgccggcggaaggccacggccatgtctccacacttctggatctcgggagtggagagcacacaccagcgcaggtaggggggcagccctggggtggggcaagcaagcggtcactgccaggccagtactgccatggaagagcatggagtcggacccaagggaaattctgggcctttctcctgtcaggtgtgtggctgggataagttatttaaccatcggatcccacttcctcacacagaaaaggggcaactgtgaggcctgaggaagaccatggctggcgtgcatgtaactcagtgtgtggtacccacttccctggctggaggtggaagatacatggggccagggggctaaaggcaagaagctcacttgtagactactgcaatagtcca

SEQ ID NO: 175063 - DNA, 601 bp, Human
ctgagattcagaaaggggaaggggcttgccccaggctacagggcgtcagtgcccagctgggccagcgcttcttctgctcctggcacccccacttagtgaggagctcccaggctctccaggggactcacccctatctgcctgtcccctggggtgggtgctggcccctgcggtcgctcctccccgcctgtctctgtcccctggggtgggtgctggcccctgcggtcgctcctccccacccgtctctgtgggcttgttgcagtagacactctcctcttccccaggcagcagggggtgtgggtaktaagaactgcccaggcactgccaccacccgcccacctggcccacgctgcacctgcgtgactcccacctggatccgctccatgcagtgttggggggacttggctgacacgcactggatctctggcttgagccgctgccggcggaaggccacggccatgtctccacacttctggatctcgggagtggagagcacacaccagcgcaggtaggggggcagccctggggtggggcaagcaagcggtcactgccaggccagtactgccatggaagagcatggagtcggacccaagggaaattctgg

SEQ ID NO: 175064 - DNA, 601 bp, Human
caggtgtccaacaacagaggatggatagagaaaatgtcattggcatgcaccgtggaatactatttagccataaaaaagaatgaaatcctgtcactggcagcaacacggacggaactgggggacaccgtgttatgtgaaataagccaggcacagcaagttaaacaccatatgttccactcatatgtggaagctaaaaaaagttgatctcacagaagtaaaaagtagaacagaggatgctgcagactgggaagggtaggggaagggaggaatagggagagtttttttttttttttttttttttgagacagtctctctcttgtcgcccaggctggagtgcaatggtgtgatctcggctccctgcaacctccacctcccgggtccaagcgattctcctgcctcagcctcccaagtagttgggattacaactgtgtgccaccatgctcggctaatttttttgtacttttagtagaaacagagtttcaccatgttggccaggctggtcttgaactcctaacctcaagtgatccacccaccttggcctcccaaagtgctgggattataggtgtgagccaatgcacccagccaggagagataggaggaa

SEQ ID NO: 175065 - DNA, 601 bp, Human
ggatgagaggcctaaatgcagggcccaagacaataaaattgctgaagagaatataggcaaaacgcttcaggacattggtctgagaaaagattttatgaaaagacctcgaaagcataggcaacaaaagcaataataagcaaagggaattgtatcaaacaaacaagtttctgcacagcagagaaaacaacgaacagagtgaaatgaagacagcctatggaatgagagaaaatatttgcaaactactcatccaacaggggattaatatccagaatacacatgcaacggaaacatctcaacagcrgaaaaccatccaacttaaaaacgggcaaatgatcagaacagacgtttctcaaaagaagacatacaaaatgccagcagccatcactgatcatcagggaaatgcaaatcaaagccacagtgaggtatcagctcaccccagttagggtggctgttatcaaaaagataaaaaataacaaatgctagtgaggatgcagaataaaggaaactcttacacaccgttgctggggatgtaaacccggacagccgctatggaaaacagtacggaagtccctccacaaactacaaatcgaactattgaata

SEQ ID NO: 175066 - DNA, 601 bp, Human
gttgtgagggttacacgagatgatccacacaatggccctcactgtgtggggcatacggggagtgtcagcttgcgcgatggtcatcgtcgtaagcctggtcaccctgtattcttgcccggtctcctctttgtggccttccagtcgatgtggttccctggcctgggcagagttggcactgctgaggggcctgtgcttggggaccccctgagcaggccccacctacttgctctgaaaacaaaaactggggagtgtgaacacccaagggctgacagccggggctctgggccgaggctggacaccygtgaccacagcagtcctccctgactgcagggccacgggggccccctctgcatctggcgttagtctccaggcagagaagagaaccaggaaagagctgaacaggcactagagatcaggccagtgtttctagctgcggatggtgagcctattcatgggggccaaatcgagtgggtcatgacaagtgtcaggaaaaaaaggattagaatagaatacattagaaaatagtgggtaccatttgtgtcatatctctgtatataaaggacatacatttttaaatttctatctgaaagaaaagtttccg

SEQ ID NO: 175067 - DNA, 601 bp, Human
tgcttggcgtgggcctccctgtgccctgccagcccccagacagccgggcaccgcctctccagcacctggccaagggccagcacagcgtgtgctgcaatgcctgtctgttaaatgcgtgtacagatggaagaatgaccggatctgaaacgatggcagtctcagggcctggggaggaggcttcagggctgagggatggagctctgcctgcggaggcgcgggagggtccagtgccttcttcccaggaccctcctggggcctccaggtcacctgcacccaccccgcttgtccattcggaagcctmttgacaggtggtcccaggaccccgccaaggggctaactggtaacagagccatagtagtgtgattaacctcaagggaaggggatgacagtgtgacagtgggggagagtggggacacctgtgccccaggaaggtgtcccacgccattcctgaagaggcatgaagtgatggcggttaataacaggcagcggcgttgatatttggggccaggagggtgcacagctcggggccctttttccaccactcagacctcccccttcctattgtgctgtcgggcaggacacagaccctgcaccacagccc

SEQ ID NO: 175068 - DNA, 601 bp, Human
aaagtggaggcgcagctgaggctgcagaagcattttcctacagcccagagattgctcacacccaggtggaagggacccaggcctctgaggtcaccagtaagaggacagaggccaaagccccagcccaggcccctgagaaggtgcaaatgagctgccagggggactctgaagggccactttccatggctgcttagggccagaagaggctgaggaggccccagtagtccaagatggcaaactacgaggcctgctcttgtatggcctgggttgtaagctaagaatggtttttatattttgaaarggttattgaaagagagactgtctgtcgtctgcaaagcctcatgtatttatcctctagtccttcacagaaagtttgccagccccttagagacgtttgttgaatagttggggaaactgaggcctggggcaggaggggcaggcctggtgacaggcagccactatccccaggagagaggcatggagcttttgaaaatggctgaggggggcactcttttatatttataaaaatatccccacctcccggctgaggccaggcggcaggccctgcactcacgggcatagtgctccccggctgcgggaa

SEQ ID NO: 175069 - DNA, 601 bp, Human
gagggtcccagcctctgcacacagccccagactgccaggccacccgggtacctgaaggcgccgcggtagccgtaataccgctcctggctgttgcccacacacttgttgcggccctgctcgtcccccacgcacagtgcacacagcgaggaggggtagttcttggggttgttcacgggcacgcagctggcattgaagaactcgctcactgctggggtggagggaagggcaatgatgaggggccagcagtggaaagtgtgggagggagctgggcgggccgctcccccacaggtctgcccacccmccggatcctacactgcaaggccacctgtctgctccgctcccctcagctctgagtggagtgtctcctggaggatctcagtgcggggaatgcagaggttgtctagatacagcatctccatcaccaaacatcacccagccttcacttgaactccctcagggacagggatctcactacctcactattttgttccaatcagagcaggtgtccagctgtctgggagtgggagctgccaaccctagtgccctctgtgtgcttgtgtcagtggttagaaaaaaaagtgcttgtatgttttctgagtta

SEQ ID NO: 175070 - DNA, 601 bp, Human
atccagcacccctggatgtgtggtctgaggtctgttcttaccctgtgacccttggggctcccagcttcccagggggcacagccttctagactcagcctctctgagctgctgcttggccccagcccagcatggtgtctggatggtgctgaagatggggaacagtccccccgacctacctttggccctgctcttgcccccacctaccgtttgtgttgtcaaagacggttgtgtgcctgacgaaggcaacgtcacccgcattctccaccaggcacctgccacacagagggcagggcaggcgtcrgcaggagggtcccagcctctgcacacagccccagactgccaggccacccgggtacctgaaggcgccgcggtagccgtaataccgctcctggctgttgcccacacacttgttgcggccctgctcgtcccccacgcacagtgcacacagcgaggaggggtagttcttggggttgttcacgggcacgcagctggcattgaagaactcgctcactgctggggtggagggaagggcaatgatgaggggccagcagtggaaagtgtgggagggagctgggcgggccgctcccccacaggtctgccc

SEQ ID NO: 175071 - DNA, 601 bp, Human
acttgttaactccagagcagaccactctttggaggagttttgcttcgaaagggagcaggattggccgggcacagtggctcatgcctgtaatcccagcactttgggaggccgaggtgggcggatcacgaggtcaggagatcgagaccatcctggctaacacggtgaaaccccttctctactaaaaaatagaaaaaattagccaggcatggtggcgggtgcctgtagtcccagctactcaggaggctgaggtgggagaatggcgtgaacccgggaggcggagcttgcagtgagccgagatagygccactgcactccagcctggggcgacagagtaagactccgtctcaaaaaaaaaagaaaaaaagggagcaggattacagctgcaagaggatggatgtgagaccaagaggttagtttgttctttaaggatggcagaagtcacagcatgtttcatgttggtgaaaatggtccgactgagaagggaaaatcaacgatgcaggaggcagaggggacagtttctggagggatgtccttgcgtaagtgaaaatcacagaatttcccccgggcttcctcaatttctctagaggtctgctccaggtaga

SEQ ID NO: 175072 - DNA, 601 bp, Human
gcccctcacctgctcaccccaatctgtcccttttagggcttactttccagaagaaggacagacaataaataaatgaatatatgatttccagtagtgagaagtgctacaaacaattgtaaactaggggaaggggctcctgagagtcacagtggttgtgttagctcaggtggtccaggagggtctctctgaggagctgactttgagcagacacctgggtcaagtgaggaagcggctatatgaaaattgggggtgcctttgccaggccgaggtgggaggactgtttgaacccaaaagtttgagsccagcctgggcaacatagtgagatcccatctccacagaaaaatgaaaaatgggggtcagggttgatgagagcatccagacaaaaggaacagcaggcgcaaagactccgaggtgggaatgaactgggtgagtttggaaaaaagcaagaagctctgtccactagacctataatgtgagccacataggtaatgcaaaatgttctagtagccacatcataaaaagtaaaaagaaataggtgaaattaattttcatattacattttatgaaacccaatatatccaaaagatgagcatgttaatgt

SEQ ID NO: 175073 - DNA, 601 bp, Human
ggacagacaataaataaatgaatatatgatttccagtagtgagaagtgctacaaacaattgtaaactaggggaaggggctcctgagagtcacagtggttgtgttagctcaggtggtccaggagggtctctctgaggagctgactttgagcagacacctgggtcaagtgaggaagcggctatatgaaaattgggggtgcctttgccaggccgaggtgggaggactgtttgaacccaaaagtttgagcccagcctgggcaacatagtgagatcccatctccacagaaaaatgaaaaatggggktcagggttgatgagagcatccagacaaaaggaacagcaggcgcaaagactccgaggtgggaatgaactgggtgagtttggaaaaaagcaagaagctctgtccactagacctataatgtgagccacataggtaatgcaaaatgttctagtagccacatcataaaaagtaaaaagaaataggtgaaattaattttcatattacattttatgaaacccaatatatccaaaagatgagcatgttaatgtataatcaatataagaattattaggcagatattttacattattttttccattctga

SEQ ID NO: 175074 - DNA, 601 bp, Human
aaggaacagcaggcgcaaagactccgaggtgggaatgaactgggtgagtttggaaaaaagcaagaagctctgtccactagacctataatgtgagccacataggtaatgcaaaatgttctagtagccacatcataaaaagtaaaaagaaataggtgaaattaattttcatattacattttatgaaacccaatatatccaaaagatgagcatgttaatgtataatcaatataagaattattaggcagatattttacattattttttccattctgaattttcaaaatatgatgtgtatgttacrcttatagcacagtataagtaataatatggactaattacatgtgctcagtagccatatgttactaatggctgctgtgtgggacagtgcaggcttaaaggattggataatttgtaaaattttgccctctactctattgattaataacaacgctattgagctcctgggtcctctgagcttctgggctttcaaatgcatggagaaactgctcttcctcacctgcctacccctattcaggtgggcaccccaggcctgctacctcagaaactgcatttgatcaagatcccagtgttgtgtgcacag

SEQ ID NO: 175075 - DNA, 601 bp, Human
aaagtaaaaagaaataggtgaaattaattttcatattacattttatgaaacccaatatatccaaaagatgagcatgttaatgtataatcaatataagaattattaggcagatattttacattattttttccattctgaattttcaaaatatgatgtgtatgttacacttatagcacagtataagtaataatatggactaattacatgtgctcagtagccatatgttactaatggctgctgtgtgggacagtgcaggcttaaaggattggataatttgtaaaattttgccctctactctatkgattaataacaacgctattgagctcctgggtcctctgagcttctgggctttcaaatgcatggagaaactgctcttcctcacctgcctacccctattcaggtgggcaccccaggcctgctacctcagaaactgcatttgatcaagatcccagtgttgtgtgcacaggttagagtctgcaaagtgctgcttcaatttcatctgcatcagacaagtctgggcttcaatttcagctcttccacttattcacgtgggatctgtagcatgtcttttaattaacataattatgtctcccacaagcag

SEQ ID NO: 175076 - DNA, 601 bp, Human
ggaggccgggcgcggtggctcacgcctgtaatctcaacactttgggaggccgaggcaggcagatcacgaggtcaggagatcgagaccatcctggctaacttggtgaaaccccatctctactaaaaaaatacaaaaaaaattagctgggcgtggtggcgggcgcctgtagtcccagctactcaggaggctgaggcaggagaatggcgtgaacccaggaggcggagcttgcagtgagccgagatcgcgccactgcactccagcctgggcgacagagtgagactccgtctcaaaaaaaaaaaamaaaaaacctcactggaaccatgaaaggtggcagctagcatcatggttaatgcttggatgtgggatgttgggtgggtcccttcactttgcagagcttcagtttccctgatggggatcccatgagccccctcccttgggctgatgagaacattaggtttgagtgttagaatttgcaacatgctgcttccatttcagctgcatcagacaagcctgggctccagtttcagctctgccacttactggaatctgtaccatatttcttaattaacataattatgtcttaattatgtcataattagtt

SEQ ID NO: 175077 - DNA, 601 bp, Human
taccacccagttctcactcctcttcatcgtgatgagggtctgagtctcgcttcctcttgcagatcatcatctttgagcaggaaaactttcaaggccactcgcatgagctcaatgggccctgccccaacctgaaggaaactggcgtggagaaggcaggttctgtcctagtgcaggctggaccgtaagtacctgggtggcctctcctggtcagggactttgggtgaggtgatcaagttgtggagtgggggaatctacccttgctcctgtctgcaaatctgggaaccaagttttggggtctggmagcctatggagataattcatgctttgcagtcagatagagctgggttcaaatccaggttccaccccttctgggttgtgtggtgttggaccaggaccttccccctctgagcctcagtttcctcctctgtaggatgaggctaaccatgtactctggggatgaagggagagggtcatgtggaaagcctgatacagaggtcagccacttcctcaaggcaggaagatggacatagtgactgatgaagcttttagaactgccaatctctggctccaggagtgtcctcactcctgggaggtttaaggc

SEQ ID NO: 175078 - DNA, 601 bp, Human
ggtcatgtggaaagcctgatacagaggtcagccacttcctcaaggcaggaagatggacatagtgactgatgaagcttttagaactgccaatctctggctccaggagtgtcctcactcctgggaggtttaaggctggatgttccagccctgcatccactcctcccttcccgaatcctgacaatgctgggtctttacagattttttggcacacttgggggccaggtctctatccaagagagaaggggagctgaatggttggctcaccttatgtgatgtagctgagcatagtcctatgtgagcytgcagagtctgggacacaaaaccacagtttctctcgtcactccttctctgtaaaagcctcaggatgtaggaatgtccgctggtggccagtaagtcagatatggctggaaatcctaaggtgacctataccacacctcaaggttctcagggaattttgcagagttccatggtcctacataggtcagaacctgaagatgtgcagaacacagctaaagcagtggccctgccaagccttggtcatctgacatgctcagggaatctgttgtgtccaagagaatccctttctggatagctgagattt

SEQ ID NO: 175079 - DNA, 601 bp, Human
aatccctttctggatagctgagatttgaccgtttaagcaccacatctgactttcagctgccttttcaaacattttgatgaaaaaaaatttcccaaagagattttacactcttcttctttcttttttaaaaaatataacatttagtatttttattaattatcgtttattttaaaactaagaagatatggtttaaggcaaaaaaccgtatgacttgtattcactactcagaagtaaccattattaagattttggtatgaatttggatttctctgtgtgtgtgtgtgtgtgtgtgtgtgtgtgtataatcaaatcaaacttggatcatactaaacataatgttttattactcactttggaaactttacaaggtagcatggactctctccatgtcattaaatagcattttatgttggtgtttttcaaagtagtttgaggaaaattagcatcagattcacagaagggagatgctttaaaatggaggttcttgggccccacttaagccccactaaatcaaactgagctctggagcctggaatctgcatttaacaagcttacctggtgatagttacgccaattacatttgagaacccacatcctatgt

SEQ ID NO: 175080 - DNA, 601 bp, Human
ttctgctttcctctattagccatgcccgacctgaaagccatcccttcctctttaatgtactatttttcttctaatgtggatctacaaaaacagagtttgggcagagtctaacaacaggaacaagagaagaaacagatccaaagagaggggctttgggcacagcgatgttctggagtcagttctcagtggtgaaggctgactgtgcatctctcttcctaacttcacttgcagccgtgtcatattgatagcttgaaatctgccacagtgggagcatttacaccatggaaattggcaaacgctrcaaatcaagagtgttaattttcgttttgttttttgagagttggctattaacttaccagcatactattggctttagtgcatggcgtctatatattggtatttgttgctgggccgttatttagactgccttcttatttcttaactgtgttccaggtgggtaaaggcagcatagcactgagttctagataactgaggggattttgcacttggatttgctgtgctaaggtttgggtggggctattacatcttgccgggctgggcaagagtgaaccctaggggtcaacatcagtagccaggattc

SEQ ID NO: 175081 - DNA, 601 bp, Human
gcccgacctgaaagccatcccttcctctttaatgtactatttttcttctaatgtggatctacaaaaacagagtttgggcagagtctaacaacaggaacaagagaagaaacagatccaaagagaggggctttgggcacagcgatgttctggagtcagttctcagtggtgaaggctgactgtgcatctctcttcctaacttcacttgcagccgtgtcatattgatagcttgaaatctgccacagtgggagcatttacaccatggaaattggcaaacgctacaaatcaagagtgttaattttcrttttgttttttgagagttggctattaacttaccagcatactattggctttagtgcatggcgtctatatattggtatttgttgctgggccgttatttagactgccttcttatttcttaactgtgttccaggtgggtaaaggcagcatagcactgagttctagataactgaggggattttgcacttggatttgctgtgctaaggtttgggtggggctattacatcttgccgggctgggcaagagtgaaccctaggggtcaacatcagtagccaggattctgccataggaagcttggagtgga

SEQ ID NO: 175082 - DNA, 601 bp, Human
caatcttctcccgttctcccccgacggcccgcgaaggcaagcgccatcgggaagggatgggtaggacagaggagaccggccgggcccagcacccggaacccgtccctacgagtccctacgcagcccgtccgcgtggagactgacacccttgcgtggccggtgccaagcgccccggaccttgcacacaacctcgcgcgcaccccaaacacgccctgcagctcttggagcctcagcctttgtgcgcagcaaccgagcgcccgctccgtgctggccctttcccccgagcctccagctccagggracgcggatcaatcacaccgcccgccggcccggctggcgccttccaggccctacggcccctcgcctgcccctccccctacctgctgccgccgcggccgcttccaccttcacttgcctttgactcgggcccgccccggctcgggcttcccgcagacccgcccccggcccgccccagcccgcccacgggcgctaggctccccgcagacccgccccagacccccagtaaacacgccccccctttcaccccgcccagactgccgctcaggaaagggttgtgctggggccggggggcgaggggcgg

SEQ ID NO: 175083 - DNA, 601 bp, Human
ggggaaaacaacataaaagggacatctgtccaaccaacccaatgcctcccttcctcccaagacccttcctcccaactctgaataaactccgcaagttcaacattagtgggtgaggagcagagcacctggacagacctgcacaggaaggagcctgcagcctgcggggtggggtcacttactgggctcctattggctggatgcagtgggattaggggtcagggttctcactccttctgactctggggtctgagaaaacacagcaacgaggtgaatgacatgggagacagacctggggtctttyagggacggaaagcctcagccaagacccagactcccagggtcatcaacctcctcgggtcactaaccctccccagtgtctgtctacccctaagtccagagaacacgtcctctctaggctcgagccggaatcaatataggctacaagggcatcagttcaggctgcgcggaggagagaaggaagtgctgatgtggaggtaagagggtggccctgtcagaacctccggattcgaatcccggctctgccactcccagtgtgaccttgccccagttagttactacatttggcctcaattttctatct

SEQ ID NO: 175084 - DNA, 601 bp, Human; identical to SEQ ID NO: 38224

SEQ ID NO: 175085 - DNA, 601 bp, Human; identical to SEQ ID NO: 38225

SEQ ID NO: 175086 - DNA, 601 bp, Human; identical to SEQ ID NO: 38226

SEQ ID NO: 175087 - DNA, 601 bp, Human; identical to SEQ ID NO: 38227

SEQ ID NO: 175088 - DNA, 601 bp, Human; identical to SEQ ID NO: 38228

SEQ ID NO: 175089 - DNA, 601 bp, Human; identical to SEQ ID NO: 38229

SEQ ID NO: 175090 - DNA, 601 bp, Human; identical to SEQ ID NO: 38230

SEQ ID NO: 175091 - DNA, 601 bp, Human; identical to SEQ ID NO: 38231

SEQ ID NO: 175092 - DNA, 601 bp, Human; identical to SEQ ID NO: 38232

SEQ ID NO: 175093 - DNA, 601 bp, Human; identical to SEQ ID NO: 38233

SEQ ID NO: 175094 - DNA, 601 bp, Human
gctggtagggaagtgggtgtggaccactaaaccttactcagtagagaaggatggaatggttggtgaaaagacttagaaacaacaaggacaggtacatagaagtatttgctaaatggaccacaaagactgtccctcaagtcttgtgattcaaaagtttttagggtcaaagtgtaaggagcaagggttcaggacttctggggtccagttgtaactgcctctggtcacctctaacacgatggttttccctcttgagaatcctagacctcccaaatctgctaacaattatgattaccactgcacyagatggggttaaaaggaaagggagcttctagggcggtctacgttcaaaagactaccttgatcacacagacacaccagtagttcacttttatggtctcctctccatggccctctgaacctcactgctcagatagctcctcctaacccgctccactctgcagctcaccagcctttttagactgagatcttggtaaagcctccttccctctgtcctcactctcctgagttagggacatggaacctcagccatggacttcaaaggtacagcaggaggcgagaggaaggcacacctgctcacctg

SEQ ID NO: 175095 - DNA, 601 bp, Human
ttcaaaagcagtaggccaattatccttacatgctggggcagctggtagggaagtgggtgtggaccactaaaccttactcagtagagaaggatggaatggttggtgaaaagacttagaaacaacaaggacaggtacatagaagtatttgctaaatggaccacaaagactgtccctcaagtcttgtgattcaaaagtttttagggtcaaagtgtaaggagcaagggttcaggacttctggggtccagttgtaactgcctctggtcacctctaacacgatggttttccctcttgagaatcctasacctcccaaatctgctaacaattatgattaccactgcactagatggggttaaaaggaaagggagcttctagggcggtctacgttcaaaagactaccttgatcacacagacacaccagtagttcacttttatggtctcctctccatggccctctgaacctcactgctcagatagctcctcctaacccgctccactctgcagctcaccagcctttttagactgagatcttggtaaagcctccttccctctgtcctcactctcctgagttagggacatggaacctcagccatggacttcaaag

SEQ ID NO: 175096 - DNA, 601 bp, Human
cctttcaaaagcagtaggccaattatccttacatgctggggcagctggtagggaagtgggtgtggaccactaaaccttactcagtagagaaggatggaatggttggtgaaaagacttagaaacaacaaggacaggtacatagaagtatttgctaaatggaccacaaagactgtccctcaagtcttgtgattcaaaagtttttagggtcaaagtgtaaggagcaagggttcaggacttctggggtccagttgtaactgcctctggtcacctctaacacgatggttttccctcttgagaatcytagacctcccaaatctgctaacaattatgattaccactgcactagatggggttaaaaggaaagggagcttctagggcggtctacgttcaaaagactaccttgatcacacagacacaccagtagttcacttttatggtctcctctccatggccctctgaacctcactgctcagatagctcctcctaacccgctccactctgcagctcaccagcctttttagactgagatcttggtaaagcctccttccctctgtcctcactctcctgagttagggacatggaacctcagccatggacttca

SEQ ID NO: 175097 - DNA, 601 bp, Human
cccggaacatcctggtgtacagccaatctggtatattcagaggaagcagatggtggaggcgtggggcgggggggctgggaatactgcatggtcatagctgactaacctatgggcacatactctcattctgagaagattctagggcccctaaaactgtctgtaggatagcaagcaaaatctcttaggaagctggcctcatatctgaggcaagaagagtcagaaaagggcaaagcttcctatcccaaaacaaaacaacaataaaccactttgcacatagcagtttccagaacagaaatagagwgatatacaagaaggcccaaactgaagctgaattccccagcacggaaagtttccccagaaggtggcctaaaatcaacaaaactcactgagataccttcttaggcccaatgaagatctgaatcatctccatatcaaaccaggttccagacacctgatcccatgatttttttctcagtaggggaaagaactgacagggactgggatactatgaactgccttggaaccgaggtcatgcatatattgcccctggacaataatcacagagttttctatagtcaggccttaaacaccatcctcgaga

SEQ ID NO: 175098 - DNA, 601 bp, Human; identical to SEQ ID NO: 38347

SEQ ID NO: 175099 - DNA, 601 bp, Human; identical to SEQ ID NO: 38348

SEQ ID NO: 175100 - DNA, 601 bp, Human; identical to SEQ ID NO: 39265

SEQ ID NO: 175101 - DNA, 601 bp, Human; identical to SEQ ID NO: 39266

SEQ ID NO: 175102 - DNA, 601 bp, Human; identical to SEQ ID NO: 39267

SEQ ID NO: 175103 - DNA, 601 bp, Human; identical to SEQ ID NO: 39268

SEQ ID NO: 175104 - DNA, 601 bp, Human; identical to SEQ ID NO: 39269

SEQ ID NO: 175105 - DNA, 601 bp, Human; identical to SEQ ID NO: 39270

SEQ ID NO: 175106 - DNA, 601 bp, Human; identical to SEQ ID NO: 39271

SEQ ID NO: 175107 - DNA, 601 bp, Human; identical to SEQ ID NO: 39272

SEQ ID NO: 175108 - DNA, 601 bp, Human; identical to SEQ ID NO: 39273

SEQ ID NO: 175109 - DNA, 601 bp, Human; identical to SEQ ID NO: 39274

SEQ ID NO: 175110 - DNA, 601 bp, Human; identical to SEQ ID NO: 39275

SEQ ID NO: 175111 - DNA, 601 bp, Human; identical to SEQ ID NO: 39276

SEQ ID NO: 175112 - DNA, 601 bp, Human; identical to SEQ ID NO: 39277

SEQ ID NO: 175113 - DNA, 601 bp, Human; identical to SEQ ID NO: 39278

SEQ ID NO: 175114 - DNA, 601 bp, Human; identical to SEQ ID NO: 39279

SEQ ID NO: 175115 - DNA, 601 bp, Human; identical to SEQ ID NO: 39280

SEQ ID NO: 175116 - DNA, 601 bp, Human; identical to SEQ ID NO: 39281

SEQ ID NO: 175117 - DNA, 601 bp, Human; identical to SEQ ID NO: 39282

SEQ ID NO: 175118 - DNA, 601 bp, Human; identical to SEQ ID NO: 39283

SEQ ID NO: 175119 - DNA, 601 bp, Human; identical to SEQ ID NO: 39284

SEQ ID NO: 175120 - DNA, 601 bp, Human; identical to SEQ ID NO: 39285

SEQ ID NO: 175121 - DNA, 601 bp, Human; identical to SEQ ID NO: 39286

SEQ ID NO: 175122 - DNA, 601 bp, Human; identical to SEQ ID NO: 39287

SEQ ID NO: 175123 - DNA, 601 bp, Human
attcagagtttgtcctgagggtagggagtggataacagtgaatttaatcttttaaatttccttcaagttttatgatcgtgacacgggggcaacaggagaagagaaaaagtttggaaaccaaacacaaatgttttcagattcctgctaggtatgtaaatggctaagtcaatgccggtaggggtactcattcagaaacacccagtgccactctgtacgggccactaaattgggcactgcggatataaaggttcattcctcgcttactgtacccacagctgccaagaaatgaccactacaaaasagtcgttataactgagggaacaaagcgccaaagcagcaacaaaaaggggttcttgctgcttcgcgggatagggggctgagcagcctcacaaaggcgacgtcctcgcagtctgaagaggagtgggcaaggcggacgagggtggggctcaagcgtccgtccggtaaaagtgagctggaagaaccgaggcccagcgtgaggaggaaccgcgaactacttgcagaagggcgaacgtctgctgctgaaggtggagagggagtaccaatgtacgaggctttatagaaatggccgtttggtaaaggg

SEQ ID NO: 175124 - DNA, 601 bp, Human
ggaaaaaaaattctccctcttaggtaattcaggaactactctgagacttgactactaattattgcctgaccatatgacttgcacttcttactccactatcctcccctcttacctctttaattatctaggtcctatatagccataaaggccaaattcaagtgccaattccactatgatggttttgatggcttcactacctacaccagctcttgttacttctcttcattgtacagactgtagattcattcatttggtttcgtacatatatcttatcatattcctcactttttgtaagcgtctmcccttgaatcctatgctttttaaacttcttgaggacaggggcaatttcttccttatttttgtctaattagacccatgaacactgtagatactcaagaaaggtaattaattaggtgggaggatcctgccagtgcatcttctatttctaggggccagaatacgagcacatgaacctaacatgatctagacaagatttagagatgcagttgaagatactgacaaatattggaacaatctaccacaaaggtgatactgagtcactatttttgcagagctttgttactagtttgccttaaataat

SEQ ID NO: 175125 - DNA, 601 bp, Human
gtaggccaggcatggtggctcacgcctgtaatcccagcactttgggaggccaacgtgagtggattgcttgagctcaggagttagagatcagcctgggcaacatggtgaaaccccttctctaccaaaaatacaaaaaatagctgggcatggtagcacacgcctgtggccccagctacttgagaggctgaagtgggaggatcgctggagcccgggaagtcaaggcagcagtgagccatgatcatgccacagcactccagcctgggtgacagagggagaccctgtctctaactaactaactaamtaattttgcagatcactttgttgaaacaaacaactacctgatcctcaggtccccttttgcaactgccattgctgaatgggaaaagactccacaggaaaattaaataggctggatatggtggctctcacctgtaattcaaacactttgggaggcttaggcaagaggacagcttgagcccaggtgttcaagacaaatttgggcaacataatgagaccatatctctattaaaaagttaaaaattagccaggcatggtggcatgcacctgtagtcctagctactcaggaggatgagccgggagg

SEQ ID NO: 175126 - DNA, 601 bp, Human
tttgggaaactgaggcgggcagatcagcagaggttgggagtttgagaccagcctgaccaacatggagaaaccccgtctctactaaaaatacaaaattagccaggagtggtggcacatgcctgtaatcccagctactcaggaagctgaggcaggagaatcacttgaacctgggaggcggaggttgcggtgagccaagatcgcgccattgcactctagcctgggcaacaagagcgaaactccatctcaaaaataaataaataagtatgatgaggaacaattaaaaccaagaaacaacaaacamcaccacagatagaggatggcctgtcacaaaaacgacagaaaggtgaacacaaagtagtcaatgatgtagtacaccaatatagcggctttttaaaagttaattttgtaggccaggcatggtggctcacgcctgtaatcccagcactttgggaggccaacgtgagtggattgcttgagctcaggagttagagatcagcctgggcaacatggtgaaaccccttctctaccaaaaatacaaaaaatagctgggcatggtagcacacgcctgtggccccagctacttgagaggctgaagtgggag

SEQ ID NO: 175127 - DNA, 601 bp, Human
atcaagagatattcatatctaaaaaagaaaaaataaataaaaataaaaaaggatatgtacatgcagggagaatacagtcttattgtcaaaaatattaaacatgtttagcaaggacctggatcaaagtatcaaggctctagtagttaggtctgcatacagcagaaagtttggttaataccaaaatgtagttaatgtcatagaaaaatgaaatgaaacttaaaatgaccaagagcaattagaatcattcattgaaagagtatgaatttagaaatggaaaagtataaagaagtatgatgccggrcacagtggctcacacctgtaatcccagcactttgggaaactgaggcgggcagatcagcagaggttgggagtttgagaccagcctgaccaacatggagaaaccccgtctctactaaaaatacaaaattagccaggagtggtggcacatgcctgtaatcccagctactcaggaagctgaggcaggagaatcacttgaacctgggaggcggaggttgcggtgagccaagatcgcgccattgcactctagcctgggcaacaagagcgaaactccatctcaaaaataaataaataagtatgatga

SEQ ID NO: 175128 - DNA, 601 bp, Human
agcttgagcccaagagtccaagaccagcctgggcaacatggcaaggccctgtttctacaaagaaataaaaattaaaaagtaggcaggcatggtagggtacacctgtggtgctagccactcaggaggaggctgaggcaggaggatcacttgagccctgaggtcgagactgcagtaagctgtgttcacgccactgaattccagcctgggtaacagaacgagattcttgtcttacacacacacacacacagaaaagggtcttagctatattactagctaaatatacaaatcaagagatattcayatctaaaaaagaaaaaataaataaaaataaaaaaggatatgtacatgcagggagaatacagtcttattgtcaaaaatattaaacatgtttagcaaggacctggatcaaagtatcaaggctctagtagttaggtctgcatacagcagaaagtttggttaataccaaaatgtagttaatgtcatagaaaaatgaaatgaaacttaaaatgaccaagagcaattagaatcattcattgaaagagtatgaatttagaaatggaaaagtataaagaagtatgatgccgggcacagtggctcacac

SEQ ID NO: 175129 - DNA, 601 bp, Human
aattatcagatttcagtaatgctgtaaaaaacaaggtgtggccgggcgcggtggctcacacctgtaatcccagcaatttgagaggccgagatgggcggatcacgaggtcaggagatcgagaccatcctggctaacactgtgaaaccccgtctctactaaaaacgatacaaaaaaatcagccaggcatggtggtgggcacctttagtcccagctacttgggaggctgaggcaggagaatggcgtgaacctggcagtcggagcttgcagtgagccgagatcgcgccactgcattccagcctgkgcaacagatgtggtaggcaaatttttatttccggtgagaaacgaatggaataatctgaacttttatcaagtcttgagttatatcttacatgacaacatgattcataaacttacaatacagtgtttcacaagggtttcctaagaatcctaaagctcaacaaaatacattctttgaaataatcaaaataacacagaaagaacagtgacattctggtttaatttgtatgtttcatctttacctattaccacagtaccaaatgatgggtcagatcaagctctcggtcagaagacaagatacatt

SEQ ID NO: 175130 - DNA, 601 bp, Human
accatgttaacataaatatttcagtccttacaagttggtattgacttttctcattggtaatctgactgatttaatactgctcattccaatatctggtgatgtaattctggttatgaatccttgtattaataacacctcctgggaggttttttttccccaacattacattcagaatattagagctgaaaataccttttttaaggttatcaggaggagggagcttatgtttaatgtggtggataaaacttaactgctggttaatacaattgttattcaggtgaaattccctaaacttttcacrtgcaaagttttgtatgtatacagacatttggggaaaagttttatcatccctaaaaccggttactgtccagaaaatgataagaatccctgggttccaaatccttcataaggtatttattcatttatttattcaacacatttactcaatgcctccgctctgctgcaactacactgacattctgcttctaatctaacgaaaataatgtgttcggtttagcaaaataatacataacacttgattcaccctttaattaagagaaccactgaaattaatatggtctgattacaaatttgctgaatc

SEQ ID NO: 175131 - DNA, 601 bp, Human
cagaggctgcagtgagccaacatcatgccactgcactccagactgggcgacagagcaagactctgtctcaaaaaatatataaataaataattcattaatttgaaaattttccactctaatggaaactgaatttattaaaatctgactcagggcttggtgtggtgccttatctctgtaatcccagcactgtgagaggccaaggtgggaggatcacttgagcccaggagttccagaccagccaggggaacatggtgaaacccagtgtctctaaagaaaatttttttaaaaattagccacacawggtggcctgtgcctgtagtcccagctgctggggaggctgaggtgggaggattccactctcacccatttcttctttcattttcagtttctccagttagtaactgaagatgttctttgagtaattaagtgagtgagaaaatttttaagtgagaaatctataaaaagaaccatgttaacataaatatttcagtccttacaagttggtattgacttttctcattggtaatctgactgatttaatactgctcattccaatatctggtgatgtaattctggttatgaatccttgtattaataacac

SEQ ID NO: 175132 - DNA, 601 bp, Human
atagatgaaatattaaactcctaagaactgaactgaaattgctaaataagtaggccattagtttacatttagaaatattttgtttacttaaatatttccattctggtaaggcactggggctcacgcctgtaatcccagcactctgggaggccaaggtgggtggatcacttgaggtgaggagttcgagaccagcctggccaacatggtgaaaccccatctctactaaaatacaaaaaaaaaaaaaatttagctgggggtggtgatgcaaggttataatcccagctactggggaggctgaagsaggagaattgcttgaacccacgaggcagaggctgcagtgagccaacatcatgccactgcactccagactgggcgacagagcaagactctgtctcaaaaaatatataaataaataattcattaatttgaaaattttccactctaatggaaactgaatttattaaaatctgactcagggcttggtgtggtgccttatctctgtaatcccagcactgtgagaggccaaggtgggaggatcacttgagcccaggagttccagaccagccaggggaacatggtgaaacccagtgtctctaaagaa

SEQ ID NO: 175133 - DNA, 601 bp, Human
aataaaggacaggaatatactcaacaacctaggctgggatccaatattctttttgaggcatgtagtgtgaattttaatgaattcaggccactgatcaacaaagtgtacaaaatgacaatgttgggggccaacagtgttacctataacactcacaaacacaaaaatcttaatactttgctgaagccttggttaccaaatgatatttcctgactatattattatcatctattacttcacaagctgggttgccatcataaccttaataacgatttgagaaactaaaattaggacaaaatgttayctttgagaaagcctaatatctgtggttaattaaaatatagatgaaatattaaactcctaagaactgaactgaaattgctaaataagtaggccattagtttacatttagaaatattttgtttacttaaatatttccattctggtaaggcactggggctcacgcctgtaatcccagcactctgggaggccaaggtgggtggatcacttgaggtgaggagttcgagaccagcctggccaacatggtgaaaccccatctctactaaaatacaaaaaaaaaaaaaatttagctgggggtggtgat

SEQ ID NO: 175134 - DNA, 601 bp, Human
ccgatgctgaagagttcagaccagagactaacgaactggcaaaggcagctactgtagtcgagtcctgttctgcacgccgcttctgccctgtgacagtccctgctacctccccagggcccttcttttctgccacagcacccatcatggcagagagcttggaatggtcagcataggttacaagagtaggatgtgcatcatcttgtaggagacctcgctttacctcaatcaactcctgagctgcaaacttctgcaggaggctttctaccccatcttgagtggcaggagcatctggctagagaasgaggggaggtatgggcaataagacactgaccgtgaactgaaaataagtggtaaatcctaactctgtcaggtcattaccgtggagatggcaagacagatggacacagcatcagtgggcaatgttaaggccagatcagagaggtggtgtagcaacttcttctctaactcaggatctgtagctaattcaggaactgctgaagctgtgctgggcttagggccaccagaggtgggtgcagtaggcactgggctgtcactacggaaggttggagacaatgctgcctctggattccgtagatctaag

SEQ ID NO: 175135 - DNA, 601 bp, Human
cgcaaattctttttgacattaatgtcttctaagagataaatcaacttttttttttttttttttttaagagatgggatcttgctgtcacccaggccagagtgtagttgtgtaatcataactcactgtttctcccactgaactcccaggctcaagtgatcctcccagctcagccttcaattgtagctgggaatataggtgcgtgacaccatgccagctaatgttttaattactttactttctatagggatagggtctatgttgcccaggccagtcttgaactcctcgcctcaggtgatcctcrcgccttggcctcccaaagtgttgagattacaggaatgagccattgtgcctagacctaaattagctaacttaatattggaaaattggagccttcagataagagatttgttaggggttcagtccttcctcacaaatatgcatttgggatgaaattaaaatggaagaggcctggttcctaccgctaagcattatgttaacatcccctccccaggaaggcattccttctacaaaaaacatatttactgggtgctgaactaaaaagtatagtgctaaacactttactttttagctcagagtctat

SEQ ID NO: 175136 - DNA, 601 bp, Human
ttatagatcaaactggctcttagaccaactccgcaaattctttttgacattaatgtcttctaagagataaatcaacttttttttttttttttttttaagagatgggatcttgctgtcacccaggccagagtgtagttgtgtaatcataactcactgtttctcccactgaactcccaggctcaagtgatcctcccagctcagccttcaattgtagctgggaatataggtgcgtgacaccatgccagctaatgttttaattactttactttctatagggatagggtctatgttgcccaggccrgtcttgaactcctcgcctcaggtgatcctcacgccttggcctcccaaagtgttgagattacaggaatgagccattgtgcctagacctaaattagctaacttaatattggaaaattggagccttcagataagagatttgttaggggttcagtccttcctcacaaatatgcatttgggatgaaattaaaatggaagaggcctggttcctaccgctaagcattatgttaacatcccctccccaggaaggcattccttctacaaaaaacatatttactgggtgctgaactaaaaagtatagtgc

SEQ ID NO: 175137 - DNA, 601 bp, Human
gacttaaaatgtcttatagatcaaactggctcttagaccaactccgcaaattctttttgacattaatgtcttctaagagataaatcaacttttttttttttttttttttaagagatgggatcttgctgtcacccaggccagagtgtagttgtgtaatcataactcactgtttctcccactgaactcccaggctcaagtgatcctcccagctcagccttcaattgtagctgggaatataggtgcgtgacaccatgccagctaatgttttaattactttactttctatagggatagggtctaygttgcccaggccagtcttgaactcctcgcctcaggtgatcctcacgccttggcctcccaaagtgttgagattacaggaatgagccattgtgcctagacctaaattagctaacttaatattggaaaattggagccttcagataagagatttgttaggggttcagtccttcctcacaaatatgcatttgggatgaaattaaaatggaagaggcctggttcctaccgctaagcattatgttaacatcccctccccaggaaggcattccttctacaaaaaacatatttactgggtgctgaacta

SEQ ID NO: 175138 - DNA, 601 bp, Human
cccattcagtattcactcttgtactgtatctgtccatacctacataactgaattgcattacctgcctgtgacccagaggaagagaaagccatcatcctgtagtacgggtatgttgagcctgcgcatctcatcatctgtcagggtcccatagggcagttccatgtgaatatcccagggtgggtcagccatcacaactgcaaacttgcccaagatactgacgtccaggtagcggatatcacaacagatccactgcataaagtggtatttggtcatcttccctactttaactctgagattcatrgcccgagtccctcttttccatttgatttttcctattcccttaaaagcttatctatccccctccattcccaataagcaagacaagattgctgaattatgctctgctttcttaacgtgtatggctgccctatcaaacataagtccgtaagttgagacgagttttctgagcagacaggtacctgaggtgggaagagtcggtctgcactggaatcacctccgacactctgtgtaagagcaagctcctggcttggcgtgtggtctttgctgccaggggcctcagaatccatgcaagcatcaattt

SEQ ID NO: 175139 - DNA, 601 bp, Human
agcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagtkctgtccttaatcataaataatagccccttgaggactagcctgttctctggtcaccttaccagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttacacaagattgcaattctagccctttctattatgtttatgatctaaatgagaaaaatctgggatgagaatacacccaacatgaataactgatacca

SEQ ID NO: 175140 - DNA, 601 bp, Human
aggcagcaccgagctgttcagctccttgtcactcaggaccccacaggagaggaggaggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacrctcttattacggagagtggagctcttctctttgtcccgccaagtagcccgagagagcacctacttgtcctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactc

SEQ ID NO: 175141 - DNA, 601 bp, Human
ctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccrgtcgagtggccctcgtcagcctcatccactttattcttacccatcttttcaggcttcaccctgaagaactgggaggccctccactgaagaagctgaaacaagaggtatgttttccggggtgcatataggggcactgggcagccttccccaatcccctcccttggcaggtcttcatttccccatgttgggcatccacaggttggagaacagagtcaccctgaaatccagcagcctcccccaggccctgagtcctatgtacccccataccgccccagcctggaggaggacagcgccagcctg

SEQ ID NO: 175142 - DNA, 601 bp, Human
tatagtcgtcagagagggcagtaggatggctgggctccagccagccaggccttggggtgcagagaggcagaccctgccgagctgctcccaccatggaaagtctggtcctagtgtagatctgtgaaaggggaactggggaatggggggacagagaaaagaggatgaaggagcaggaaggaggagcatcaataagggaagctcagatggcacttccaccaacccaggagtggggagcaggctaggagttgtgggtatggggatggggatgcccagcttggaagcagaggagcccaaagcagtsatgctttgtgtgtggaagggggaagagggagtgggcaggcggagggccgggcagccgctgggctgagagtgacgcagcagacaaagccaccaaccctggcttggtatttttaaactgtgcgtgggtgggaagtgggggcggggactggaaggggggctcttcttgagggaggagctcggaggctggcttcctgttctccctctgatttggctaccaaaaaacttggggggccatggtagagtggcctgggaggggcctgggagggggccagggatgagtgggggtggcagagcttgggaa

SEQ ID NO: 175143 - DNA, 601 bp, Human
gaggaggaaagtgtaagcaaagacttgtgctgccgccaggtacagaaagccctctctctcctacaatgggccctggccagggtccagactccccatctacccccagtgcttcttctcaacaccttacctctcacagcccctattaaagacacccaacctacccataaccatttcagaagttcttccaaaggtctctccttccctgtcattgctacagtgagcttcatttttaaaatgggaacttgacaaggcagaattatagaggatagaggcaggattcctccataagagattggaattkcccaaagaaaatgaaagtggggtttgcttccccaacaaacaggcagttgtcaggacctctggatgtgctacatgtctgtctctatttttccatctctagcttttacacccactcctgtaaacttctggcatggactttgccccagagggacacacctagcttcttgcgggagtgggcaaggaggagcacagttggaactacagggagggtggtggggcttggcccccatgcagtaggcacatggcaggtgttccctaaggaggaaacctggccctcctcagtctttcctgtgagactgag

SEQ ID NO: 175144 - DNA, 601 bp, Human
atagatgggaagctgttgatagggattcactgagatcaccacattcccaatgtaggtctggagccaggaagaaggtgaagggaatgagcttgagggtgaggtgggagcctgtgacctctccagccacatatccacagccagaggcacccatatgacactcacataaatctccttgttttcatagcgaagctgaagattcttgagcagtgactcctccaccaagggttccaggaggacaagatcctccacccccacagaaccttccaggagaggcatgtccagaggggccactgatcctggkaataagaggcacagtttgctgatgtccactcagctttaggggccagtaactgtttgaggggaggatggcagaaggaccaaaagagccttcctctcttcctaccctggccctaaagagagcccccaacctaggagaggcctctggaccagcccaagctaatagggaggctgaaactctcagcaggaggtgggggagatcctctgctgcctgggttacagttggtgggggtggggcaggggtggaacaggaacaccttcctctgaccaccaggggaaggcaggcacccagtgggctacaact

SEQ ID NO: 175145 - DNA, 601 bp, Human
gggttcctgaagatcacagagatctccaagagtggaaaaggagatagcacaggtctatcatagaatcaccagaaaccaaagagacattcttaggggccagacacccacggtgctcacagccagagaggagattgggaggcaaactccagtagggcttaaagtccaccagacactccagtgatgcccacccagagccacttcaggccagtccagcatccaggctgtgatggacccttccccaggccaagccaaggggctctaggtcttctgctcttatagccagctgcacaggcctgatggccccgatcacacaatattacaatggatctgctcacacacctcttatccctagaagactataagttcttcgaggacagggtcatgtcttactcaactctgtatccctagaggctagcataatatttgatcataggtgttcaagagatgttgaatgaatgaataaatgaatgagtgaatgaatgaatgaaaagaaaatcaggaacagggtcctaggtaaggcagatgtagacccaggacagcttcaactagagttcactgaaagttcctgaacacttacaacattctgcctgcttccctgctt

SEQ ID NO: 175146 - DNA, 601 bp, Human
tacaaaagattccatgtctttatttatcataaccttataaggtattattgttcccattttacagataacaaagtcaaatttcagaaggataggtacttaccaagcctagactcaaattccttcttattctactacctttcagtaatagcttctaaatagatggcacttccatgtggataatttgttaataacagctttactgaatataattcacataccatgtacaattcagtggctttttagtatattcaaaaggttgtacaaccatcaccactatctaatttcagaacattttcaccaycccacaaaagaaatcctatacccattattagtcactccccatacccctctccccccagcccttggcattcattgatctacttcccatctctatgaatttgcctattgtggacatttcatatgaatggaatcaaacaaaatgtggtcttttgtgactaccttctttcactcagcataatgttttccaggctcatcaatcttgaagcatgtatcagtacttcattctttttatggacaaataacattcttttgtacagatataccacattttgtttatctcttcatcagttgatggacattt

SEQ ID NO: 175147 - DNA, 601 bp, Human
aatgatctactatgcaagggaaacattttgtcctctgtgttcacatctggggacgatgtagaggaaattgtgatcaaggagaaaggaagctctggcatatgcctagaagttgtttaagagggggaagtagaaaagacttggtttacttctctcttatattcctcttgctcttctttcagggtcatctctatgaacacctgctgcagcttctcattgcagtagttgatcacaaattgctcaaagctattatcctgagagagggagcacaggttagagagctcactccaagactgtttctccrtctcagtcctacctcccctccctcacatcccccctgtgagcctgtccacctctaatcctaggggagcagggtgctgaggtgaggcactctcacctctaatatctcaaaaccgtagatatcaaggactcccattaccttcttcttttccccgatgcccacctgaagaggagagaaagataaatctgaggacaggccccctctgcacaccaggccaggtccttctggagcggatggggttggagtagggggcaaacagaactagcaagagctttgccaaactggaaaggaattgttgtgatt

SEQ ID NO: 175148 - DNA, 601 bp, Human
gcctactctcaccccaaccctaaaatggatcttgggaggttgagctagttaatgtgtggatcactctactcttcaatgaggcttagcctcttcaacagttgttaaacatccagccccaggatcttcacaaggctatttgaccatagaccagatggtgggtgtgctgagaccccttcctgccacaaggttgcctggattgtccactcatgccaaaatgctatctgattctgcccccgagtccaaggcactggggcctggtccctgcaggtagctgccctcttctcctaggacttaagtacaygcagactgaggaaactcttgggggaaagctttgggttgcctcttctcaaacccctctcccaaacctgtgcctccctgctccatccctaacatccaccctaacccctaccacttaccatgctcttgtagatgaaatctgccaaggtgagggcagcctctgaccggaaatatttgcgataattctttcgggcctggcagaaaagtacaagaaaggagccaaagtgaagataggcagattctagaagaggttgtactatttttcaaccacgcaaagacctgagtaagataaagagctgagact

SEQ ID NO: 175149 - DNA, 601 bp, Human
cagtcagggtcctaactatggtcaaaaacccaatcagcggaggtcaattaccaatttgctccagcctctgtccaagatcccatgctcttcctccttctctctggcctttcccaaggtttcattggaagtgcttctccctccctggtttcctccctgacacttctcagaagcactattgctatctgactgaagtctccagaagttactcttctctgtccctgtttttctccccctgggagctgtctgtaagtttgaatatgtaggccttccaggtgggtcttcccatccagcctgacccacrtcctccagaattaggataggtccttcctgagatttactttctgacttgctgacaatagtttcagaggaagtagaaggaagatacaattcgcctactctcaccccaaccctaaaatggatcttgggaggttgagctagttaatgtgtggatcactctactcttcaatgaggcttagcctcttcaacagttgttaaacatccagccccaggatcttcacaaggctatttgaccatagaccagatggtgggtgtgctgagaccccttcctgccacaaggttgcctggattgtccactcatgcc

SEQ ID NO: 175150 - DNA, 601 bp, Human
gagaatggatactagcattagttacagtcaaggcagtggcaaactggaatactcagaaacactgggggaatcagtgcccagtgcccgcaggcttctgtgggggtgtgatttattgagaccctggtctaaacccagcagcttctgggttgacaattagtagctgcctgacaatacacagatgaaagaaaaggaagaagaagggcagtcaggagataacagcaaaatcagattacaggtctcaggtgtgtagcaagaagcatgtatggtgggaaggcagacactctggcaccagcacaagagstgatcaggcaactgaagagacctggaagatggaacttccctgggaaggggaagaggacgagcaaatgaaggctcaggaaggcaaaaaagaggtccagagcttcagagcccccattcctctcttgagctgagggatccagactctcaaacaacaaagaggggctgcaagcaaacatgtcttatgtctgaatgagcacagtcagggtcctaactatggtcaaaaacccaatcagcggaggtcaattaccaatttgctccagcctctgtccaagatcccatgctcttcctccttctctctggc

SEQ ID NO: 175151 - DNA, 601 bp, Human
cagcctgggcgagagagcaagattccatctcaaaaaagaaataggctgggcgcagtggctcacacctgtaatcctagcactttgggaggccgagatgggcgggtcacttgaggtcaggagttcaagaccagcctggccaacatggtgaaactctgtctctactaaaaatacaaaaattagctgggcatggtggcgcatgcctgtaatcccagctcaggaggctgaggcaggataatcacttgaacctgggaggcggaggttgcagtgagctgagatcgcgccattgtactccagcctgggygacaagagtgaaactctgtctcaaaaaataaataaataaataaataaaaattaaaaaaatgagaatggatactagcattagttacagtcaaggcagtggcaaactggaatactcagaaacactgggggaatcagtgcccagtgcccgcaggcttctgtgggggtgtgatttattgagaccctggtctaaacccagcagcttctgggttgacaattagtagctgcctgacaatacacagatgaaagaaaaggaagaagaagggcagtcaggagataacagcaaaatcagattacaggtctc

SEQ ID NO: 175152 - DNA, 601 bp, Human
tggctttttaactacaaaatgggagaaagaaaagagcctacctcacagggttattgaaagtattagagttaatgcatgtaaagagcttaatgcatagtagatgttcaaaagataatgggtaaggccgggtgcagtggctcacacctgtaatcctagcactttgggaggccaaggcgagtgaatcacttgagctcaggagtttgagaccagcctgggcaacatggtgaaaccacatctttaccaaaaatataaaaaattagccaggcgtggtggcatgtgcctgtggtctcagctactgggraggccgaggctgaaggatggcttgagcccgggagatggaggttgcagtgagccgagatcatgcttgctgcattccagcctgggcgagagagcaagattccatctcaaaaaagaaataggctgggcgcagtggctcacacctgtaatcctagcactttgggaggccgagatgggcgggtcacttgaggtcaggagttcaagaccagcctggccaacatggtgaaactctgtctctactaaaaatacaaaaattagctgggcatggtggcgcatgcctgtaatcccagctcaggaggctgag

SEQ ID NO: 175153 - DNA, 601 bp, Human
aggtgtgcagcgcgacaaggcccagaggcctcttccccacccccagagttcccatcctagtcctcccgggcccttcccccacatccacgtatcctctgtcagtgtccacagagcacagtccaggaccaagacatcagcaccacctggggagttgttagaaaggcaaattttggtcctcaccccaagacctgctggatcagagactctgaggagggacacagcacctgggggtgacaatcctgccaggtgattctaaggcacgctcaagtttgagaactgctgcgtgatggaactggctgtrcagggtctgggaggccctcacctctggggatatgaagccttcttgcccttgaacagttcactggcacagagcttttccctcaggatctctacctgcttcggggacagctgatcccggaacctcttgcactgtgaggaaggagggacaggagctaaaatcatagagtgggagggcagggctggggagggaggtgagaaatattgactagaagacactaggagaggagagagactgaggaaaaaggacaggcactagacacctcagggagaggccggggctggaggaccattgaggaggagt

SEQ ID NO: 175154 - DNA, 601 bp, Human
tgcccccactccacctggcagggcgcaaacacagcctgccatctgctctccagatgccagcccacagctctgcactagctgcgggaggagttcagcctgcaggcccttaccttgccattgccacgattgaccttcttcacggcctctgccatcagaacaggcccctcctccccgcctttcagcttctgcagcttggggttcccttgcagcccaatgtagtcaccacagaatggaatggggacactgagaacacatgggaggtgtgcagcgcgacaaggcccagaggcctcttccccacccscagagttcccatcctagtcctcccgggcccttcccccacatccacgtatcctctgtcagtgtccacagagcacagtccaggaccaagacatcagcaccacctggggagttgttagaaaggcaaattttggtcctcaccccaagacctgctggatcagagactctgaggagggacacagcacctgggggtgacaatcctgccaggtgattctaaggcacgctcaagtttgagaactgctgcgtgatggaactggctgtgcagggtctgggaggccctcacctctggggatatgaagccttc

SEQ ID NO: 175155 - DNA, 601 bp, Human
agccatgcgccacgatcagaggggttagagatcctcccacacaggagggcagagggggattagtgctggttcaggaggaagcaactgccatctctgcatggtgccccctcctcactgcacagtcacctccaagcaatgactccccttttttttgtagcgtagcttgctgttgtcaccacctgcagggccctggacgaccttgacagccacactgttctccttgaacctcactgagaacctggagagggaacagaaaaccaagtctagtgcccatcccctcaccccgactcccgcatttccwtgatggcccccccatcatgcgagtcagaggacttgaggccccagagaacctgggtgggggcctgagaaacacctccaagccccggcctgcactgccctacatgcttcgctttctgatcctggtcacgatgaccatcagcctggccatctaccgtaagccgcccctcacccccagttcatggcctcacttctcagtcacggtgactgtaagctgcctctgcgtggcatccagcacagcccggtacattttggtcagcagttcaatcacatgctcgctgaccagcaggaagtcccccttgga

SEQ ID NO: 175156 - DNA, 601 bp, Human
cacacacagaagtgcatttacacagaacacacccccacacataccaacccagttgcctaggcacacctatgtactaccctcttcctgccccaatttccctcatcctcacagactctcaaggagaaggggtaggatggcaatccctctcattcattgaccaagaggggcagaggggacatctcattggccaaggtcttgaaacaagtttgtctcagaagaactcagatactctaactatcctgggctggaactttgtggctccaaacggtgtccagcccatacttggcactcccctgggtgtttttttttttaacggttctggccttttggatatggcacaactgctgccacctgcaaggctgccctggtgataactcccttggcccagcatgtggtgttcaggcagccacttttcccaaattgttgaatactctgcccacctcctataatgagatgctgaacagatttgagctgaagaggcagttaaacttcacacattgaatttgtaataagtcccacccgcaatcatcttaaaagcatttgtaccgatgtaattgctgtcatttcaaaaccttgaaaagacttcctccctatcctcccc

SEQ ID NO: 175157 - DNA, 601 bp, Human
atattcactatgcagtttccacaccagggtcaggtagaaaagatggagaaggagtcaaagcacaagaatgttacaagaacagggaagagaaagggtaacaggagcgtgcgcacctggggattgggacagggaaagaggtcttcctaatgcagtccaggagtccggaagtggagtactgaggacaaaaaacaaaacaaaacaaaaaaaaacactgaaatcacatcttatatcctgtaaaaaagtcccactgaaaacctgctgtggcagcaggagagaaggggagaggcgtctgtgagagagsaaagaacaagtcttgaccctcagcctgccctccaggctttgggcctgaggatggaactctcctagccgcaggtacttgcaccttcccagctgccatatttacattactctacacacctgtgtgcatggccagtggggcccatgtggaccaaagatgtaggaaccaagttcatgccatcctagcaccaccatgagccagacacacacacagccctgcccaaggtgccctactatgaatgctccccctgccttatccagttcctcctcttcccagaaacctcccagaggaagcacaggccca

SEQ ID NO: 175158 - DNA, 601 bp, Human
ttctttctttctttttttttttagacagaatctcattctgttggcaggctggagtgcagtggcacaatcttggctcgctgcaacctctgcctcccaggttcaagtgattctcctgcctcagcctcccgagtagttgggactacaggcatgcgccaccatgcccaggtaatttttgtatttttagtagagacggggtttcaccatgttggtcaggatggtctcgatctcttgaccttgtgatccgcccgcctcagcctcccaaagtgctgggattacaggtgtgagccaccacacctagccttttttttttttttttttgatacagagtcttgcccaggctggagtgcaatggtttcatcttccctgcagcctctacctcctgggttcacctcctgcctcagccgagtagctgggattacagacgcaaacgaccactcctggctatttttttgtttttagtagagacggggttttgccatgttggccaggctggtctcgaactcctgacctcaggtgatctatccgtctcggcctcccaaagtgctgggattacaggcatgaaccaccatgcctggcctttttttttttttttttttgagac

SEQ ID NO: 175159 - DNA, 601 bp, Human
agagcaagagtcagaaatatgtggttctctcctagccatggcactcacctgctttgggaacttgaacaaactacataaccctctgagcatcagattcctcatctgtaaaatggggataataatagtatctacctcaaagagatgttgggaggattaagtgagataacatacataaggtgttaagcacagcgcctggcatataagctgtcaacacgtggtagctggtattactgcacatgtccctgtgggattttgttcagtttttgcaacaggaattctttttctttctttctttctttctttttttttttagacagaatctcattctgttggcaggctggagtgcagtggcacaatcttggctcgctgcaacctctgcctcccaggttcaagtgattctcctgcctcagcctcccgagtagttgggactacaggcatgcgccaccatgcccaggtaatttttgtatttttagtagagacggggtttcaccatgttggtcaggatggtctcgatctcttgaccttgtgatccgcccgcctcagcctcccaaagtgctgggattacaggtgtgagccaccacacctagcctttttttttttt

SEQ ID NO: 175160 - DNA, 601 bp, Human
atagctggtaagaggcagagctaggatttaaacccaggcattctggccctggagcccctcttaactactatgctacaccctctccctaaggaggtgtggcagaggtgacgcccaaaggaaggtaacctgctgggtgtgactgtcttgctccctttagctaacacaccctctggtcacatgagcatttctttcttctctttaaagattctgtctcacacaaaagaaagaaaaagagagaaagagaaagagaaagaaagaaagaaagaaagaaagaaagaaagaaagaaagaaagaaagaaaaaaagaaagaaagaaagaaagaaagaaagaaagaaagaaagaaagaaagaaaagaaaaaaaaaccaaaacataaaataacataatataacataaaataaaagagcaagagtcagaaatatgtggttctctcctagccatggcactcacctgctttgggaacttgaacaaactacataaccctctgagcatcagattcctcatctgtaaaatggggataataatagtatctacctcaaagagatgttgggaggattaagtgagataacatacataaggtgttaagcacagcgcctggcatat

SEQ ID NO: 175161 - DNA, 601 bp, Human
ccacagaaggaagaagagaagctggaagaacttcctgaagatcaggatcggcatcaggaaggtcaggacatttcattcccagaagaaaccccagagggcacaggcacagagacagaggactggctggggtggcctcaccatcctggccccggatgacatgggcaatggtgatgcccccaatctctgagtcgctgaagcggaggagaaaggttccgtcgggctcattgagaagaaggctagtaacgtactgtttgctgatgaagccaatgatcagcctggccgggatgaaggagaggatggrgcatgggcagtgagtatggaggtgactggtgtatggctgctcagactacccagggtggggactcaccggtcagaccagtagctccggagacagcgtttggtgaggtccaggacaccatcaaaccactgccaaaaggtgaagccacggcccagcaggatctcctagggggagagggggaaaggtgtgagccgagggagggccagagctggagcctgtttagggcaggcagtgagctgtgagtgccctcacgacagaatcacagggctgaggatcagaccgaacctgagactccatcaatga

SEQ ID NO: 175162 - DNA, 601 bp, Human; identical to SEQ ID NO: 29898

SEQ ID NO: 175163 - DNA, 601 bp, Human; identical to SEQ ID NO: 29899

SEQ ID NO: 175164 - DNA, 601 bp, Human; identical to SEQ ID NO: 29900

SEQ ID NO: 175165 - DNA, 601 bp, Human
ttgatcaaggcagttatgcccaaggcatccagcatgtccttgcgggaagcgtgatacgcactgcccaggtacagaaagggcaggatttccaccgggccaccctgaaatccagaaatatccaacattcatcaagcttgctcaaagccaaggccagtgcccatacccacaaaaactttctgctggaaaagtcaatttcagataccgagtgaactcagttctgttgctggaggataaataaatagggaactaagcccatttgcctgggcaggaccagcaagttcatttccgtagagcctacaaytggagactcggctccgtcagaccacttaactgtggaataaatcatatccctgtgtcccctccgttataaataatgctgcaggtcactttctatattctccctggcactactcttccatgcctttgccagttcttacttcttccctgtggcagggacacctactaacctgatcgtagagtggggtactgcaggaactgcacccagattccgcgctgtcagggacgctagtactcaggggaaggctgagccccatgggggtcgactgtttgctgcacagctccgggcaggaagccgaaaacg

SEQ ID NO: 175166 - DNA, 601 bp, Human
gatatttaaacatcctgatcttccaagttggaaggatctaaggttctaaagtgatagtatcacttttgcatgtccattcttgttgggcatacaagctgttttaagctgtttcctactggccaggtaatgttttgttaaaatttaggcactaaaaattaggtcaaagcagttgtgtttctttctaggcttttatattaattcaacattaatctaaaaaggaatgagaaaaatgtaaatgataatgtttttgcttgtgttgcagaggtaaacagcaaagatcaggatgaattatagttagtaygttaatattagttggtctaaaccaactctatcactgtatggatggtgtcatttcatttcattgccttgagaaaggcctttcatctgttcaatgtctcctaggatatccgtgattgttcaggacccttaagtgctcttactgaactgaatactaaagtaaaagagaaatttcaacagttgcgtcacagaatacaggtgggtattctcaattcagtcaatgaagggggctctgtcctgggtatatcctctgcttgagagccgtctgggttcttcaaacaccagctgatgggagcagtaaaca

SEQ ID NO: 175167 - DNA, 601 bp, Human
tttgctattggagttaactatatgattttcagcagcgtcaccatacctagctgatctcttcctgccttcatctccagtactgatttaatcatcttaattttttatttttgaaaagatgttccttttacatgttttatgtatgtgtctgtctataagtatcaacattcagtgaaaagtctcagttatgccccagttttgttttttgttccactcttccaaacaggtaaccacttttgttactgatatgtcattccagagtttctctactcaaatatttaaaaagacaaatttcttttttttwaaaatttcttccttgtttctcatctaaaaagtagcatactaacacacagcttttaaaaactttatacttttgtttttttgtttttttttaagacggagtctggctctgtttcccaggctggagtgcaggtgtgatctctgctcactgcaacctccacctcctgggttcaagcgattctcctgcctcagcctcccaagtagctgggattacaggtgtgtgccaccacacacagctaatttttcgtatttttagtacagacggagtttcaccgtgttagccaggctggtctcgatctcctga

SEQ ID NO: 175168 - DNA, 601 bp, Human
tgatttaatcatcttaattttttatttttgaaaagatgttccttttacatgttttatgtatgtgtctgtctataagtatcaacattcagtgaaaagtctcagttatgccccagttttgttttttgttccactcttccaaacaggtaaccacttttgttactgatatgtcattccagagtttctctactcaaatatttaaaaagacaaatttctttttttttaaaatttcttccttgtttctcatctaaaaagtagcatactaacacacagcttttaaaaactttatacttttgtttttttktttttttttaagacggagtctggctctgtttcccaggctggagtgcaggtgtgatctctgctcactgcaacctccacctcctgggttcaagcgattctcctgcctcagcctcccaagtagctgggattacaggtgtgtgccaccacacacagctaatttttcgtatttttagtacagacggagtttcaccgtgttagccaggctggtctcgatctcctgactttgtgatcagcctgcctcagcctcccaaagtgctgggattacaggcgtgagccaccgcgcccggtcaaaacttatact

SEQ ID NO: 175169 - DNA, 601 bp, Human
aaaaggcaagcatctatgttttccctctgtgctggtagatggacatttttttataccattttcctgtgtctgtaacctttcgtgggttttagatttgtggtgatctcagttcagcttctcaacctcagcctcagatggctcagggcttcatttttctgtccctgcacgagctctcaaaacttcaagcgctcaaactgcctattactcgtctttaattaaataggcacagaaattgtgagtatctggaaatgaacagcagtttgatattttaatgatatctaagtgggggatcagtgtgctygtatttcgtcattgtttttcttttcctttcgggcctgccctaggtgacaggagcagcagctctgacgccaggacagccgtgcatcactcccaggctgactattccagctcttgttcccttcccacttttgggccataggggttttccttacttccttgtggacttagctatagatttaaaaggatgtgtgttatatgttacctagcattcctaggtgttctgttttaaaagggtgcttcaagtgctattgtatgcccttggcagaaatagaaatgctcttctgctttcatgttgactttt

SEQ ID NO: 175170 - DNA, 601 bp, Human
ttggcccagtgcggcggctcacgcctggaatcccagcgctttgggaggccgaggtgggcagatcatgaggtcaggagttcgagaccagcttgaccaacatggtgaaacccctctctactaaaaatacaaaaattagccgggtgtggtggcacacacctgtaatcccagctactcgggaggctgaggcaggagaatcgcttgagcccgggaggcagaggttgcagtgagccgagattgctgcactccagcctgggtgacagagtgagactccaccttaaaaacaaaaaaaaaatatttttayttttaaaaaattaaaaaattttggaaatgaggtccttctctgttgcccagtctggagtacagtcatagcttactgcagcctcaggaactcctgggctcaagcgatcctctcacctcagcttcccaagtagttgggactacagcacactccaccgtgcctggctaaatcattctcttttgaaacccctgctaagttgtcattcccatgggttttctctttgtctcttgttcactggtctgcctctgccagatctgtatttgtggctttgcttctgatttgagcaatttgccagcatcatct

SEQ ID NO: 175171 - DNA, 601 bp, Human
cagtctggagtacagtcatagcttactgcagcctcaggaactcctgggctcaagcgatcctctcacctcagcttcccaagtagttgggactacagcacactccaccgtgcctggctaaatcattctcttttgaaacccctgctaagttgtcattcccatgggttttctctttgtctcttgttcactggtctgcctctgccagatctgtatttgtggctttgcttctgatttgagcaatttgccagcatcatcttccctgcaagcagctgtgtatgtaacagtcagctgtcaggaagacacygactggcaaaaacacaggcacagggaggccagtgtaagcagggagggctgtatgagtggtgggcagtgatccagggcttggctatttcacgaatactttatgttatgatggcttttgctttcctgagccaccaagcctactcagattataaacactgagtacagaggagcccttgtataaagtatggtaagttatgccagacacactcagcttagcatgggtttaaagctgggaatggccatccacaatgtagcattacaggccagagcagagaaagctgtcaatttatactttggggct

SEQ ID NO: 175172 - DNA, 601 bp, Human
taatcccagcacttcgggggccgaggcaggaggactgcttgagcccaggagtttaagaccatcctgggcaacaaagcaaaacctcatctattaaaaaaaaaaaaaattagctgggggcatgctgatgtgtgcctgtagtctcaactacttgggaggccaaggcaggagggcagtgggctcgggaggtcaaggctgcagtgagccgtgatcatgtgactgcacctggcctaggagacagaacgagaccctgcctcttttcttttgtttttttttttttttgagacagagtctcactctgtcrcccaggctggagtgcagtggcgcaatctcggctcactgcaagctccacctcccgggttcacgccattctcctgcctcagcctctccgagtagctgggactacaggcacccgccaccacgcctggctcattttttatatttttagtagagatggggtttctccgtgttagccaggacggtctcgatcacctgaccctcatgatccgccggtctcagcctcccaaagtgctgggattacaggcgtgaggcaccgtgcccagccgaccctgtctcaaaaaaaaaacaaaaaaaacaaaaaaaa

SEQ ID NO: 175173 - DNA, 601 bp, Human
cccaaatgaatgtgaggtggttgaggagaagtactgcccctcattcatctctggatcccagggtcctgcagaacccccttgcaaactgtttcaaaatgtaatggattctttaaagtggcaggtgtgaaatggcggagcaggtgctcattaagaccttcagcataaaggtgctattagaaaaccaccctgtcagttcatgtactctgtgttttgatttttgagtatttccagagattagcacaattggtttgagctggctacataagagttctgaagtatgagtttgattcttagagagackcagttagcttttttatagtctatcaacaactgtcaacatttctttttttttttgagacggagtcttactctcattgcccaggctggagtgcagtggcgtgatcttggctcactgcaacctctgcctcctagattcaagtgattttcctgcctcagactcccgagtagctgggattacaggcactcgccatcatgtccagctaatttttgtatttttagtagagacagggttttaacatgttggccaggctggtctcgaactcctgacctcaagtgacccacccgcctcggcctctcaaag

SEQ ID NO: 175174 - DNA, 601 bp, Human
gctggtctcgaactcctgacctcaagtgacccacccgcctcggcctctcaaagtgttgggattacagatgtgagccaccacgcccggtcaactgtcacatttctaactccaggaagctgttcaccaactttccgttatcacccacaagttagcgcaggtgaagactgtagatccgccgtgtcagtcagggctctgctaatccatcatgtttgtgtcattcatgattggtctgtagtatggaaagaacaacaaaccttgaagaaatattttgaaagattggctttttgtgtgtgtgtgtgtktttttttttttttttcttgagagaaggtcttactctgtcacccaggctggagtatagtggtactatcacggctcactgcaacctccacttcccaggctcaggtgatcttcgctcctccgcctcctgggtagctggaaccacaggcatgcaccaccaccatgcctggctaattttttgtatttttagtagagacggggtttctccatgttgcccaggctggtcttgaactcctgggctcaagtgatccccccacctcggcctcctaaagtgctatgattacaggtgtgaaccactgtgcct

SEQ ID NO: 175175 - DNA, 601 bp, Human
agcgcaggtgaagactgtagatccgccgtgtcagtcagggctctgctaatccatcatgtttgtgtcattcatgattggtctgtagtatggaaagaacaacaaaccttgaagaaatattttgaaagattggctttttgtgtgtgtgtgtgtttttttttttttttttcttgagagaaggtcttactctgtcacccaggctggagtatagtggtactatcacggctcactgcaacctccacttcccaggctcaggtgatcttcgctcctccgcctcctgggtagctggaaccacaggcatgcrccaccaccatgcctggctaattttttgtatttttagtagagacggggtttctccatgttgcccaggctggtcttgaactcctgggctcaagtgatccccccacctcggcctcctaaagtgctatgattacaggtgtgaaccactgtgcctggccacgattttttatttcctacaaagtatattaactcagcagctgaagggccagaaatggttgttcaagatactggagatgagtaagtcatggttctccggggatggtaccaattaatacacaggccatagcagtacagccttagaggc

SEQ ID NO: 175176 - DNA, 601 bp, Human
tcactgagagcctcatggggatcagcaggatgatggcccagcaggtccagcagagcgaggaggccatgcagtctctaggtaaagctgggcctggagtaggaagcttctcccagagacgctgctctagggcccttgccctggcacctccactctgggctcctccaccacagcccacacgatgttcactgacttgggtggcttctccctcatgagatgacttgacaccatggtcttatccagtgtgggatgtgctgctcctatttctctttttttttttttttgagatggagtttcgctcttkttgcccaggttggagtgcaatggtgcgatctcagctcaccgcaacctctgcctcctggtttcaagcgattctcctgccttagcctcccaagtagctgggattaccggcctgcaccaccacacccggctaattttgtatttttagtagagacggggtttctccatgttggtcaggctggtcttgaactcccaacctcaggtgatccgcctgcctcagcctcccaaagtgctgggattataggcgtgagatgccacgcccggcccgtatttctgtttactagaagaccccacacccccatcg

SEQ ID NO: 175177 - DNA, 601 bp, Human; identical to SEQ ID NO: 175166

SEQ ID NO: 175178 - DNA, 601 bp, Human; identical to SEQ ID NO: 175167

SEQ ID NO: 175179 - DNA, 601 bp, Human; identical to SEQ ID NO: 175168

SEQ ID NO: 175180 - DNA, 601 bp, Human; identical to SEQ ID NO: 175169

SEQ ID NO: 175181 - DNA, 601 bp, Human; identical to SEQ ID NO: 175170

SEQ ID NO: 175182 - DNA, 601 bp, Human; identical to SEQ ID NO: 175171

SEQ ID NO: 175183 - DNA, 601 bp, Human; identical to SEQ ID NO: 175172

SEQ ID NO: 175184 - DNA, 601 bp, Human; identical to SEQ ID NO: 175173

SEQ ID NO: 175185 - DNA, 601 bp, Human; identical to SEQ ID NO: 175174

SEQ ID NO: 175186 - DNA, 601 bp, Human; identical to SEQ ID NO: 175175

SEQ ID NO: 175187 - DNA, 601 bp, Human; identical to SEQ ID NO: 175176

SEQ ID NO: 175188 - DNA, 601 bp, Human; identical to SEQ ID NO: 175166

SEQ ID NO: 175189 - DNA, 601 bp, Human; identical to SEQ ID NO: 175167

SEQ ID NO: 175190 - DNA, 601 bp, Human; identical to SEQ ID NO: 175168

SEQ ID NO: 175191 - DNA, 601 bp, Human; identical to SEQ ID NO: 175169

SEQ ID NO: 175192 - DNA, 601 bp, Human; identical to SEQ ID NO: 175170

SEQ ID NO: 175193 - DNA, 601 bp, Human; identical to SEQ ID NO: 175171

SEQ ID NO: 175194 - DNA, 601 bp, Human; identical to SEQ ID NO: 175172

SEQ ID NO: 175195 - DNA, 601 bp, Human; identical to SEQ ID NO: 175173

SEQ ID NO: 175196 - DNA, 601 bp, Human; identical to SEQ ID NO: 175174

SEQ ID NO: 175197 - DNA, 601 bp, Human; identical to SEQ ID NO: 175175

SEQ ID NO: 175198 - DNA, 601 bp, Human; identical to SEQ ID NO: 175176

SEQ ID NO: 175199 - DNA, 601 bp, Human; identical to SEQ ID NO: 175166

SEQ ID NO: 175200 - DNA, 601 bp, Human; identical to SEQ ID NO: 175167

SEQ ID NO: 175201 - DNA, 601 bp, Human; identical to SEQ ID NO: 175168

SEQ ID NO: 175202 - DNA, 601 bp, Human; identical to SEQ ID NO: 175169

SEQ ID NO: 175203 - DNA, 601 bp, Human; identical to SEQ ID NO: 175170

SEQ ID NO: 175204 - DNA, 601 bp, Human; identical to SEQ ID NO: 175171

SEQ ID NO: 175205 - DNA, 601 bp, Human; identical to SEQ ID NO: 175172

SEQ ID NO: 175206 - DNA, 601 bp, Human; identical to SEQ ID NO: 175173

SEQ ID NO: 175207 - DNA, 601 bp, Human; identical to SEQ ID NO: 175174

SEQ ID NO: 175208 - DNA, 601 bp, Human; identical to SEQ ID NO: 175175

SEQ ID NO: 175209 - DNA, 601 bp, Human; identical to SEQ ID NO: 175176

SEQ ID NO: 175210 - DNA, 601 bp, Human
aggtgaaacttcgactgaagtcagtttgtcagaaacaccatctcttgctttattcttgaacctaattggtggcttcatagtgcctggttttcatagtaccttgtatgcacaggaggcacccaataaatacctgttgagtgaatagttctattgtctttattaaaagaaaaagatttttggccaggtgccgtggctcacgcctgtaatcccagcactttgggaggccaaggcgggcggatcacgaggtcaggagatcgagaccatcctggctaacacggtgaaacccgtctctactaaaaayacaaaaaattagccgggcgtggtggcgggcgcctgtaatcccagctactcgggaggctgaggcaggagaatggcgtgaacccaggaggcagagcttgcagtgagccgagatcgcgccactgcactccagcctgggcgacagagcgagactccgtctcaaaaaaaaaaaaaaaaaagaaagaaaaagatttttactacttccctaatattttgtgacctgaaccccttttgctccctgggatacatttgctttattagtctaaaattatttttttttaaaagatacatggtagatgaattt

SEQ ID NO: 175211 - DNA, 601 bp, Human
atggtgacccttgattccatttgtatttaaacatctggattccctgctataactttttttttttttttctttgagatggactctcactcttttgtccaggctggagtgcagtggtgccatcttggctcactgcaacctccacctgctggattcaagcaattctcctgcctcagccccctgagtagttgggattacaggtgcccaccaccatgcctggctaatttttgtattttcagtagagaaggggtttcaccatgttggacaggctggtcttgaactcctgacctcaggtgatccgtcygcctcggcctcccaaagtgctgagattacaggtgtgagctgccacacccggccccctgctataacatcttttgccacctatacttagaatgaagtgttgtcttggagcctgttgtacattgtacatgtaagagtaaacttttgaaaacaaatcaaaacacacacagacacattgtacagctatataattttttttttttaagagtcagagagtctcactgtcacccaggctggagtgcagtggctccatcatagctcactgcagccttgaactccaaggctcaagggatccgtccacctc

SEQ ID NO: 175212 - DNA, 601 bp, Human
catttcctctttttaaaatggaaataggcttttctgtggggattttaaaaaaaggaaacattaaagccgaattagtactagttcccctttacctcttgaaaatactgcaaatcaaatttttcaggatacgtgaaggagctgaagtgcttcacactatggtgagttggggtttttttttgagacagtcttcctctgttgcccagtctggagtgtggtggcacaatctcggctcactgaaacctccacctcccaggttcaagcgcttctcgtgcctcaacctcccgagtatctcggactacaggcgcacgtcaccatgcttgactaatttttgtatttttagtagaggcagggtttcaccatgttggccaggctgttaccagacttttggcctcaagtgatcctctcgcctcggcctcccaatgtgttgggataacaggctcgagcagtgcccctagcttgtggtgaatttttaatacaggtgagcatttctgatttaaatgatcaaaaatatcttcaaaaaaataaaaatgggcctgacatggtggctcacaccggcactttgggaggctgaggtgggaggatcacttgaagccagaaaata

SEQ ID NO: 175213 - DNA, 601 bp, Human
ttattgtgcaactgtcagaatttctttagcacaatcccccatacatatttatttatattttataagtgtaatgtataaattatgtatttcaaggaactgaccaactcttactacctgcactgctgccagcctgatccacttggattatgtaattcctctcaactgctttctctgctttctttttgccccgcttcccccagtctctttcatcccagcagagagatcccttagaattggaatcagattttgtcagtcctctcctcaaatccctccaaataactgcccttttctttccttcttyctttatttttctttctttccttctttcttctttctgtctgtctttctgtctttctttctctctctctcttttctttctttcttttttattttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatttttttgtattttcagtagagacggggtttcaccgtgttagccaggatggtctc

SEQ ID NO: 175214 - DNA, 601 bp, Human
tcccccatacatatttatttatattttataagtgtaatgtataaattatgtatttcaaggaactgaccaactcttactacctgcactgctgccagcctgatccacttggattatgtaattcctctcaactgctttctctgctttctttttgccccgcttcccccagtctctttcatcccagcagagagatcccttagaattggaatcagattttgtcagtcctctcctcaaatccctccaaataactgcccttttctttccttcttcctttatttttctttctttccttctttcttctttttgtctgtctttctgtctttctttctctctctctcttttctttctttcttttttattttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatttttttgtattttcagtagagacggggtttcaccgtgttagccaggatggtctcgatctcttgacctcgtgatctgcccgcctcggcc

SEQ ID NO: 175215 - DNA, 601 bp, Human
ggattatgtaattcctctcaactgctttctctgctttctttttgccccgcttcccccagtctctttcatcccagcagagagatcccttagaattggaatcagattttgtcagtcctctcctcaaatccctccaaataactgcccttttctttccttcttcctttatttttctttctttccttctttcttctttctgtctgtctttctgtctttctttctctctctctcttttctttctttcttttttattttttttgagacggagtctcgctctgtcgcccaggctggagtgcagtggcgsgatctcggctcactgcaagctccgcctcccgggttcacgccattctcctgcctcagcctcccgagtagctgggactacaggcgcccgccaccacgcccggctaatttttttgtattttcagtagagacggggtttcaccgtgttagccaggatggtctcgatctcttgacctcgtgatctgcccgcctcggcctcccaaagtgccgggattgcaggcgtgagccactgcgcccggccataacttcccttttcactcagagtcaaagccttttaagagtgaaagtcctttcagaggccaca

SEQ ID NO: 175216 - DNA, 601 bp, Human
atgcccataatctcagctacttgggctgaggcaggagaatcgcttgaacctgagaggcggagtttgcaatgagccaagattgtgccactgcactccagcctggatgacagagtgagactctgtctcaaaaaacaaaaaagacacacagaacttctaaaggatgagttaaaaataaagaaaaataagagttctgggccaggtgtggtggctcacaccagtaatcccaacactttgggaggctgaggcaggagtatcacttgaggccaggagttcaagtacaacctggtcaacatattgagaccccccccccccgaccccacctctccaaaaaaaattaaaaatattagccaggcctggttgtgtacaccagtagtcctagctgctcaggaagctgaggcagaaggatcagttgagccgaggagttggaggttacagggagctatgatcatgccactgcactctagcctgggcgacagagaccctgtctcttaaaaaaacaggagttataatatttggttcccaagttctaggaaatgctcttgctcttcttagggcgtggacatgcctcttggaaaccaaatgatggatgatggagggggga

SEQ ID NO: 175217 - DNA, 601 bp, Human
tgttaagttactatactatatttctggtcttaggttaatttttaatgttgaattatattgttgtttactcagagtcaccaagctcacatgaaattagaaatgtaatgtattgtgaagacacagttgtttcttggaaaacatgctgtgtcttagcacctgactaactgtaaatcttactggcatcatgatataggaaaataaatactatctaagaatcacgagacctaggttcttttaggcaaaaggatacttggcacgattatgttgtagggtggttttgtgagttttaagtaagatgctrtgtgtgaaaacttagagtaaagcacaataaaaatcaaagtaatattatcagtgatttttttttttttttttgagatagagtctcactctgtcgaccaggctggagtgcagtggcgagatctcagctcactgcaacctccacctcccaggttcaagtgattctcctacctcagcctcctgagtaggtgggactacagatgtgcgccaccatgcctggctattttttgtattgttagtaaagacagggtgtcaccttgttggccaggctggtctcgaactcctgacctcaagtgatccaccc

SEQ ID NO: 175218 - DNA, 601 bp, Human
tattgttgtttactcagagtcaccaagctcacatgaaattagaaatgtaatgtattgtgaagacacagttgtttcttggaaaacatgctgtgtcttagcacctgactaactgtaaatcttactggcatcatgatataggaaaataaatactatctaagaatcacgagacctaggttcttttaggcaaaaggatacttggcacgattatgttgtagggtggttttgtgagttttaagtaagatgctgtgtgtgaaaacttagagtaaagcacaataaaaatcaaagtaatattatcagtgatttttttttttttttttgagatagagtctcactctgtcgaccaggctggagtgcagtggcgagatctcagctcactgcaacctccacctcccaggttcaagtgattctcctacctcagcctcctgagtaggtgggactacagatgtgcgccaccatgcctggctattttttgtattgttagtaaagacagggtgtcaccttgttggccaggctggtctcgaactcctgacctcaagtgatccacccaccttggcctcccaaagtgctgggattacaggtgtgagccaccgcccctggccaa

SEQ ID NO: 175219 - DNA, 601 bp, Human
acatatcagttcatctgtaaacatttcaatatgtgtctctaaattttaaaagtacaaccacaataccattatgcacaaaaaacttaattcctttatatcatcaaatatcctatcatatttaaatttccgtaattgtctcattattttacagcttgctggaatcaaggtccacataaagaccacacgtagcaattggtgaatgtctctcaaatttctctttataggcttcttctccatatctttctcttttttcttggaaattttaatagaaaaactgggttgtttgccctttaatgttgcmgtctggtctttgttaattgcatactcatggtggtaacacgttcttctgtattttctatgaattggtagccatatctagaggctgatcagatttagcttcaattttttgaccagtctccttcataagtggtgttgagtacttccaagaggggtacataatgtctgatttttctttgtattattggccatcatttatgatattctgtttctgtaatttcttattcactaattagctagactatatccaaaatagaagccaagtctggtggctcatgcctgtaatctcagcactttgggaagc

SEQ ID NO: 175220 - DNA, 601 bp, Human
tttgttttcccaatatagacatccagttgttgctgcaccagcttttgaaaatcctttctccgtgaaattgctttggcattttcatctaaaattagtgactatatcttatgagtctggctctggattgcctcttctgttcattgatctctttgtctggccttatgataatatactgtcttgagtattgcagagttatgttaaaatcagaaagtgtgagtcctccatctttgtgcttcaagattgttttggttattctaaaatagccacatatattttaaaatcaactaggcagtttctacgaaaaaaaaaaaaacctgttgggattttaattgggattgtgttgaatatatcaatttgaagagaactgacatcttaatgatgttgagttttctaatctcactggtatctccatgtccagcctcatgggatctcttcatttatttaggttttcttttgtttctttcacaaatgttttgtaatttttggtgcagagatctcacatgtctcttggatttttggggttttcgttttttaatagagatggcattttgccatgttgcccaggatggtctcgatctcctgggctcaaacgatctgcctg

SEQ ID NO: 175221 - DNA, 601 bp, Human
ttcatctaaaattagtgactatatcttatgagtctggctctggattgcctcttctgttcattgatctctttgtctggccttatgataatatactgtcttgagtattgcagagttatgttaaaatcagaaagtgtgagtcctccatctttgtgcttcaagattgttttggttattctaaaatagccacatatattttaaaatcaactaggcagtttctacgaaaaaaaaaaaaacctgttgggattttaattgggattgtgttgaatatatcaatttgaagagaactgacatcttaatgatrttgagttttctaatctcactggtatctccatgtccagcctcatgggatctcttcatttatttaggttttcttttgtttctttcacaaatgttttgtaatttttggtgcagagatctcacatgtctcttggatttttggggttttcgttttttaatagagatggcattttgccatgttgcccaggatggtctcgatctcctgggctcaaacgatctgcctgccttggcctcccaaagtgctagcattacaggcatgagccactgcacctagtatgtctcttgttattttaatatatcaagt

SEQ ID NO: 175222 - DNA, 601 bp, Human
agacttggaagggattcagacctcactagacaaagtatggttgagcccaccagatagcaaaggagtttgttggtttggccagaccagggtttgcctggagtttctgggcaagcaattggcctcttctggagtacaggcagggggcgaggtcatcgggggcatggatgtagtgggagtccctgtccccatacgagcaggaggccttcaaggcatgtatgccgggcaggggctttgcttaacatgtggagagggttctgaagttattgccaggccaaggctacaagatcaaagaggtaccacrttctggcctcgagccatagtaggcttcaccagaggttctcacacccactccgcgacctccggcctacgcctgaaatgtccctccagcttcctctactgagaaagcttaacagcgtgctcactttacaggagaaataaagtaattcacttgtttatcacagagcacacattgaattgcacttcatttgcctaatgttcagagctgagaggcaataaattcgtgactgaaacacacactccaaatgtctttgtaagggagagtcctgttcctttttttttcttttcttttcttttttttttt

SEQ ID NO: 175223 - DNA, 601 bp, Human
gttacactgctgggagaggaatgtcttgtcttcatccggttgcctgcgccactgttctggtggcgtctggcactggtgcaagacagagctgtgcttccccgagagtgtgctaagcattcactttggctgcttagttctagtctgggagcagacagagaaaacaaaattaaggtttttgaatgctttggatggagaaaggtgcctgcgtccgtttgttttgtgttgctataaaggaatacatgagactgggtaatttatatttggctcgcagttctgcaggctgtataaacatgacacccgyatctgtttggcttctggtgaggcctcaggaggtttttacttatggcagaaagcaaaaggggggcagccgtgtcatatggccagagagggagcaagagagagagaaggaggtgccaggctcctttaaacaagcagctcttgtgtgcactaacaactacttcactcgttactatggggaggtatattagcccattttcacgctgctgataaagacatacccaagactgggtaatttataaagaaagagaggtttaatggactcacagttcctcgtggctggggaggcctcacaataatggcg

SEQ ID NO: 175224 - DNA, 601 bp, Human
gcaaatgatgatttttccagttctatttttatttatttatttatttattttgagacagagtcttgctctatcacccagtctagagtgcagtggcacgatctcaactcactgcaacctctgcctcctgaattcaagtgattcttctgcctcaggctcccaagtagctgggactacaggtgtgtgctaccacacccagccaatttttggttacttttagtagagatgggttttcaccatgttggccaggctggtctcaaactcctgacctcaggtgatccacccgcctaggcctcccaaaatrctgggattataggcgtaagccaccattcccgtctgatttttcaattgtattattacctctgcatttgatgagctgaaatgcttctataaagataactttcctgccaggcacagtggctcatgcctgtaatcccactactttgggatgctgaggcaggcagatcacttgagcccaggagttcgagaccagcttgggcaatattgtgaaaccttgtctctacaaaaaatacaaaaattagccaggcaaggtggtgcacacctgtagttccagctattcaggaggttgaggtgggaggagaac

SEQ ID NO: 175225 - DNA, 601 bp, Human
cagtggcagtatcttggctcactgaaacctccacctcccaggttcaggtaattctgcctaaacctcctgagtagctgggactataggcacacaccaccacacccagctaatttttgtgtttttagtagagatagggtttcgccatgttggccaggctggtctcgaactcctgacctcaagtgatctgcctgtctcggcctaccaaagtgctcggattacaggtatgagccaccatgcctggcctgaaaattactgttccttaataacagtaacttttattattctacaatgtatataaaawactttttttttttttttttttttttttttggagacatggtctctgtcacccaggctggagtgcatcaccacaacctctgcctcctgggctcaagtgatcctcctacctcagccttctgattatctgggactgtagacacgtgacaccacgcctggctaattttttgtatttttggtagagactcagggtttcaccatgttgcccaggctggtctcaaactcctgagctcaagcgatccaactgccttggcctcctaaagtgctgggattacaggtgtgggcctccatgcccggcaaaata

SEQ ID NO: 175226 - DNA, 601 bp, Human
tttatcttcctggtgtagcacttcctgaaatagatcagcttgcctcagaaactgtcagtagttctctggggcctgcagcaggattttttgttttgttttgttttgcttttctgttttgttttgtttaacctaaggtctctgattgtagagagtacatgccccttgaaatgcgatataaaatgttataagcacacaacttttgccgggtcaccagcggtcccatgagccacaacagataagaacggctaacctgcaggtcatgtccagctctgacttgactgtcaaggccttccctccccartctgccttccttctcactactttcccctccaggccctagtggtgtgggcccttgttcttgacctcattagctttacttggtttttcctgactctcactaccctattacattcattaatttagaaaacaacttagtaaatacactctcccgtgaaaattccttctgctttcttgcctcagttcacccattctctcttaattctttctgatgctttctctttcagtgcccagctggcaaatcctagcacttccttccttggctactttgtttcaaagtgatttcttttctttctgaacatat

SEQ ID NO: 175227 - DNA, 601 bp, Human
cctgactctcactaccctattacattcattaatttagaaaacaacttagtaaatacactctcccgtgaaaattccttctgctttcttgcctcagttcacccattctctcttaattctttctgatgctttctctttcagtgcccagctggcaaatcctagcacttccttccttggctactttgtttcaaagtgatttcttttctttctgaacatatttagctctccagtttttgccattcatttggtacattgccttgaattgttaaatacatgcttaactccttgtatttaatctcctacmatatatagccttacatatcatagtaaagaaggaattattttgcaaatttatctaaaatttttaaacagataaaaattaagcctaatatatcgtttaagaagaatattcacttacttttccccgaacagatttcttggttctagacttaatatttttatgttatcttcattgtcagttttttgtttttttttttttttttgaaacagagtctcactctgttgcccaggctggagtacagtggcatgatcttggcttactgcaaactccgcctcctgggttcaagtgattctcgtgcctcag

SEQ ID NO: 175228 - DNA, 601 bp, Human
tgcccaggctggagtacagtggcatgatcttggcttactgcaaactccgcctcctgggttcaagtgattctcgtgcctcagcctcccgagtagctgggattacaggaatgtgccaccatacccggctaatttttgtatttttagtagagacggggtttcaccatgtttgccaggctggtcttgaactcctgatctcaggtgatccgccccgcctcccagagtgctgagattacaggtgtgagccactgcacctggcccattggcaggtttttgtttgtttgtttgtttgagatggaatctygctctgtcacccagactggagtgcagtggcgcaatcttggctcattgcaacattgacctcccaggttcaagtgattctcctgcctcagcctcccgtatagctgggactacaggcatgcaccaccatgcttggctaatttttgtatttatttatttatttatttatttatttatttatttatttatttgagacggagtcttgctctgtcgcccagactggagtgcagtggtgcgatctccgctcaccgcaatctctgcctcccgggttcatgccattctcctgcctcaggctcccaagtag

SEQ ID NO: 175229 - DNA, 601 bp, Human
aacatggtgaaacccccatctcaacaacaacaacaaaaaatacaaaaatcagccaggtatggtggcacacgcctgtagtcctagctacttgggaggctgagatggaaggaacttgagcccaggaggtggtggttgcagtgagcggtgatggtgccactgcatttactccagcctggatgacagagcaagaccctgtctcaagaataaataaataaataaaaataaaaatttattccaaaatcaaaccgcatgcctttgccatgtaacataatgcacatttacttttattttattttatttatttatttatttatttatttatttatttatttatttatttatttattttgagatggggtcttgctctgtcacccaggctggagtccaatggtgtgatctcagctcactgcaacctccgcctcctgggttcaagccattctccttgccttagcctcccaggtagctgggactacaggcatgcaccactacagctggctaatttttttgtatttttagtagagatggggttttaccatgctggccaggctgatctcgaactcctgacctcaagtgatccacctgcctcggcctcccaaagtgc

SEQ ID NO: 175230 - DNA, 601 bp, Human
tcccaaagtgctgggattacaggtgtgagccaccacgcctggcctaaatttataatctgcctggtactgatacttgtacaaagaggctgttctgctggcctaaggaagagaacagaaaattatccctagattaagtgaaagatattatgaggctttcacactactacaagaaacaagtagctctggtaattaccactccttggcctgatgttgttttcctagtacattgtaaatatagtctgtttagggcatgatggctcatgcctgtaatcccagcactttgggaggcgaggatgggcasaacgcttgagcccaggagttagagcccaacctgggcagcatggtgaaaccctgtctctacaaaaaaatataaaaattagccgaatgtgttggcgtgcacctgtagttccagctacttgggaggctgagatgggaggatcatttgggctcaggagattgagactgcagtgagccgagatcacgccactgcactccagcctggatggcagagcaagaccctgtgtccgaaaaaaacaaaaataaaacaaaacaaaaaaaaagatggtgttgaatttaagctgctagaaaaagaaaagtgtca

SEQ ID NO: 175231 - DNA, 601 bp, Human
tagccagaacggggagcaagctacagggcagcctccagtacaagaccaatgcaaggagcccgctccccaggagcctggccccagagcagagttcgccatgcctgcggaacctcccctccatgctataagagggaagggaaaaatacagactcttgaaactgcggtgaattcattagattccagcacaatcaatctcagtcagcttcattcttcctgctttctgtaacatagagtgttacttgtgctcctcatttcagcagtgtccttggttactggaccttttgccacagccctgcaaaayctggccaaacttgcaccaagttgattatcctgtgtttcatattttgttgagcatctgtgcattttaaagtgttggcttggttaactttctcgatgttaactttttgccttcctgaggaatgtatgaggaccagttaccagaatggttttgttttgcaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcc

SEQ ID NO: 175232 - DNA, 601 bp, Human
ggtaatgaggtggatggtgctgtacaggacgctgttcagggcaggggagagggttccgagggagtcccagagcccgatgtcccgggacagggtactggaactaagttgtgtttgtggatattgggctggggtcccaggtgctctgaggtggggtgaggagtccagagagtcctggagccgtgtcaggggtcctcacttgcaggatgattggtgttatcttagaagatgatggatcttagcagttgagaggtgatacctaacttccgtggcagctctcctgcttagtcccattccttgggtrccccccaggagggtcctgtccttaccgccctccactcctttctttccaggcgcagcaagcacacagtggtggcctataaagatgccatttatgtatttggtggagacaatgggtgagtgagtctcagcatcagtgtttggaccaggtagggagaagtactgtggtcagggactgggcctgtccagctccattactgtcctttcagatgctagctggtgcctctaagcttcagtttccccatctgtgagattccttgcactcacctccctggtcgtggtgaggattaaatgagatcctgca

SEQ ID NO: 175233 - DNA, 601 bp, Human
gggagtcccagagcccgatgtcccgggacagggtactggaactaagttgtgtttgtggatattgggctggggtcccaggtgctctgaggtggggtgaggagtccagagagtcctggagccgtgtcaggggtcctcacttgcaggatgattggtgttatcttagaagatgatggatcttagcagttgagaggtgatacctaacttccgtggcagctctcctgcttagtcccattccttgggtgccccccaggagggtcctgtccttaccgccctccactcctttctttccaggcgcagcaarcacacagtggtggcctataaagatgccatttatgtatttggtggagacaatgggtgagtgagtctcagcatcagtgtttggaccaggtagggagaagtactgtggtcagggactgggcctgtccagctccattactgtcctttcagatgctagctggtgcctctaagcttcagtttccccatctgtgagattccttgcactcacctccctggtcgtggtgaggattaaatgagatcctgcactcatggtcctcagcacagcttccagtgggtggcacatgctcagtatgtggaaatgtcc

SEQ ID NO: 175234 - DNA, 601 bp, Human
tatttcatgcatttttcactttttgtgggggttttcccaaattgctccaaacatcaggcaacaacgtgatgttttgttggtgggcacacctcctttcacataaactgtctccacttaagttgtggctggtttccttatgcagagggtggagtatttgcacatgactagttgtgtccatgtgtcctagccctgcctctcagccccaggaactagcatgaagccctggaaggtctggcctcttactggctctgcagccttggtcctgtaggcctccttggggggcgggcttgaggatggtggkgtagtctggaccccaccaggatctgcatactgggcagaagagcctccttgggcatggtcccctggcttcaagcctgtcttcctcccactctctttccccaggagtagccggtggggcccatttacaaaagcaagtcagagtatgctcctccttggctcatcctcctgtaatgcctccctgcctctctgagtaaaagcccaagtcctcatgagagtctgctgctcctctgccctcagtccctcactgcactggggcggcacgggctgccttgctatgtttggattgtaccaagtgcccccc

SEQ ID NO: 175235 - DNA, 601 bp, Human
catgagagtctgctgctcctctgccctcagtccctcactgcactggggcggcacgggctgccttgctatgtttggattgtaccaagtgcccccctgctcaggcccttgcactgcccattctctcctctcaccttcctgcccctcctctgatgtttcttgtgactgaggccttacttggccatctggaccaactggagaccattgcttcccctccatacctcttaccatcttcatttgttcctgaggcacacagatgttggttattatccatctcttcagtcaaggcagggcctgtgctccytttaccattgtatcctggcatctagaaaactccataaatgtttgtcaaatgaaggaatgaaatgaagaagagatgcctacccacaagcgtttactgcagccttaatgagaaccctccaaaccagaaagggctttagtgtccagtacaaggcagcaagtgggaaatgggggaccttcatcctcaagagtgtccttagcaggtagtttgtgtgacaactgtgtagcaataagcagaaacatttttgctgcagtatgacaaagaaataggatacaaatttgtctcacactagtcttaacttta

SEQ ID NO: 175236 - DNA, 601 bp, Human
gaagagatgcctacccacaagcgtttactgcagccttaatgagaaccctccaaaccagaaagggctttagtgtccagtacaaggcagcaagtgggaaatgggggaccttcatcctcaagagtgtccttagcaggtagtttgtgtgacaactgtgtagcaataagcagaaacatttttgctgcagtatgacaaagaaataggatacaaatttgtctcacactagtcttaactttataaagactgcctgagtacaaagaaagatggcctcctgcggcacgtggggcaagtaagggggggcggsgggtggcggtatcacaatcaccaccagcttctaggctcctggcttcctggctgcatggcctcagacacagcctttgagccactaggctttgttgccatctgtgaaatggaggtgagagagcacccactggtgcagactaagtgagaccgttcagggggcacccagcacaggctgggcatgacggggcgctgggctcctgtcagtttgcccttcttcccaagggctgggtagtgatatgccagctggtagtgttaggtggtgcaatggccagtgaatttgttttctatttgattgtatggc

SEQ ID NO: 175237 - DNA, 601 bp, Human
gcgattctgccgcagcctcccgagtagctgggattacaggcgcctgccaccatgccaggctaatttttttgtatttttagtagagatggggtttcaccatgttggccaggctggtctcaatctcctgacctcaagtgatccgcccgcctaggcttcccaaagtgctgggattacaggcgtgagccaccgagcccagcccattgtctctatttcttttttttaagaagtggcaggaagatcagagagaagcaaagggcctctcctgaggcacgggcaagcacttgcattgcagggtacagcygcagaggaaggggattgggacgtgtgaataggggttctggaggctagggtgaggtgtgagggtgactctggcctttgggccatttcatgccttcatgtcagctgctggttgggctcctggtggccacattcatgctttggtcctgaccccaggcaggctggtgtctgcctgtgtggcagccctggtgcccatatcagttggggagcctcctttgtggtcaccactcttgttcttgggcatcagctggttgcctggctgtgttagtgacccagcccacaacagccccctactctaccctgg

SEQ ID NO: 175238 - DNA, 601 bp, Human
ctggaggctagggtgaggtgtgagggtgactctggcctttgggccatttcatgccttcatgtcagctgctggttgggctcctggtggccacattcatgctttggtcctgaccccaggcaggctggtgtctgcctgtgtggcagccctggtgcccatatcagttggggagcctcctttgtggtcaccactcttgttcttgggcatcagctggttgcctggctgtgttagtgacccagcccacaacagccccctactctaccctggctacatgcagtgcccatctctggggtcactgcagagyagacctggctaatgccaccctctcttccggctgcctttcaggaagaccatgctcaatgacctcctgcggttcgatgtgaaagactgctcctggtgcaggtgggtggccccgtgctccagggccctgcctttcctcctagaacacagtggcacagtgctgggtcccagttgctagcagagtctctctcatcatgggaagctagaaagaagcttccaggaggagataaccacggcctcagggatgccacatccagagccgccctgtcaggctgaggagatcaagtaaccaccccgcacctgc

SEQ ID NO: 175239 - DNA, 601 bp, Human
ggtcactgcagagtagacctggctaatgccaccctctcttccggctgcctttcaggaagaccatgctcaatgacctcctgcggttcgatgtgaaagactgctcctggtgcaggtgggtggccccgtgctccagggccctgcctttcctcctagaacacagtggcacagtgctgggtcccagttgctagcagagtctctctcatcatgggaagctagaaagaagcttccaggaggagataaccacggcctcagggatgccacatccagagccgccctgtcaggctgaggagatcaagtaacyaccccgcacctgcagctgccaagctgggcacacagggcggcacccttctgggctgtccacctctacctcgaggctgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagataga

SEQ ID NO: 175240 - DNA, 601 bp, Human
tgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagatagatagatagatagatagatagatagatagatagatagaaaaaaagatagatagatgatagaaagacaaagagagataatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgatggttagata

SEQ ID NO: 175241 - DNA, 601 bp, Human
ctaggaagatagatagacagatgatagatagatagatagatagatagatagatagatagatagatagaaaaaaagatagatagatgatagaaagacaaagagagatgatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgatggttagatagataggtattaaatgaaattgatggaccccgtgctgtaagatgctgcactgctgctgagagcaggagtgtggatggtcctggagtagcatgaggacctggtcacattctgtgagtggaataagcaatttacaaaatatctgccacttgattccattttaaaaaatttcatggaagcctaagtatgcgtaggaga

SEQ ID NO: 175242 - DNA, 601 bp, Human
ttcaaaatacaaaagtgaaacgtagctgggcgcggtggctcacgcctgtaatcccagcactttgggaggctgaggtgggcggatcacctgaggtcagaacttcaagaccagcctggccaacatggtgaaaccccgtctctacaaaaatacaaaaaattagctgggcatgatggtgggtgcctgtaatcccagctactcaggaggctgaggcaggacaatcgcttgaacccaggaggtggaggttgagccgggatcgtgccactgcactccagccgggacgacagagagagactccgtctcaaaaaaaaaaaaaaaagaaaaaagaaaggcagcacagggatgcagggccaccctgtgggggtgtggacctcatgggtgacccccgctgactctcaccacccctgtgcccaccccagggcctttaccactgggaccccaccggccccccgttaccaccactcggccgtcgtctatgggagcagcatgtttgtctttggtaagcagcctcttgcctcccaggggctgtgtcgccccgaggcccacagacaccctgcccttctgcaggcctggggcatttgtgctcgtgctgtgtacagcaggg

SEQ ID NO: 175243 - DNA, 601 bp, Human
gagagtacttgttctgtctgggccgggcagggggcctggcacagcagggatttgaggcagtggctgccaccccacacagaagttcccgcctcatggccgcacaagtctcctaccctgtgtgggggtggggctcctccctgcagccatcccttccagccaggactaggcccaccctgaccaccagacccaaggggtcctcactggtctgtcctaatacaggttgaatgacatgtggacaattggcctccaggaccgagagctcacctgctgggaggaggtgaggggcgtggggagccagggygcaggtggaggaggtgaggggcatggggagacagggtgcaggtggagggaggtgggaggcagggggagccaggctgggggtcgaggctgctttcttccccttgcaaagcccagcctcgacctgagcctcgctctcctccctggtgacctgcgggccttcacgaccagttcctcactgtggctgcacagtgattcgaggtttggtgctttggatgggcagagtgccacgtgtgtgaggatgtggttttgctttaacgcaccctttatttcagtgcagtgagggccgtctgctatccagtgt

SEQ ID NO: 175244 - DNA, 601 bp, Human
cagtctcgagtgtggtgaaatgtgagcgggccctgtgaggccggggctgagctgtcctctccccctgcaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtgagtactctggccagtggggtggagggaggacggtcagttccctcgaatccttctgaatatgaagaacgcctcttgcacctggtggccrtggtaaccatccttgtgagctctgcaaacagcaggaggttacagcccggagcagggatgtgcggtgcccctggcaggtccccaggatatggctacagcttagcaagataaggcctggcgaggaggcccctggctaggcctccctctgaacgtgaaggacgtccccttcctcgtgaatagcttggtcagtgccaccagtaacagacgtggcctgcatagatctcaaataatggcagaagaccagaggggcctgcaggtcctgagaggtctggcccatgctgcccctggctgctggccagcc

SEQ ID NO: 175245 - DNA, 601 bp, Human
tgttcctacctagtggccccagcccacactcttccatggggggagccctgcgccctgtgccctgccctcccctctccggctccctgagattcgggggctctggggcgcaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggtgtggggtggggtcagcgcratcagggttgggtggggtgtgctcaggcttaggccccctccctgcccaccactgtgagcccctcgcccagcctggggccctggcttgactctgcctgcctgcctgtgcctgtctgccccaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggtagggagccccgttccccttc

SEQ ID NO: 175246 - DNA, 601 bp, Human
ggcaaggaggggtttgcagccaggaggaaccagtgggttcctgaccctcacaactgcccagaggacggggtgggtcattgctttgtgtgacagttgagcacagacatggaggtactccttatgtcacttcagtaggggtctgaacatggagggtcaggatgcctgttaggcctgcaaggccatggaacagcgctacagatgtacagacactatttttctcgggaggggattcatggttttctttggatcctgaatggggcctttgacccactaagtagttcagaatccatttggagagcaygctggcgtgggggcttggggctccagctgcgcccttccctgtccttccctgggagggtgcgggcggaccagcttcctttagtcagctccttaaccaggccccagctacttgtttgcggccccctactactacggcttctacaacaaccggctgcaggcgtactgcaagcagaacctggagatgaacgtgacggtgcagaacgtgctgcaggtagccccccagccccgtgcacatggctgcagctcccactgagtgggtgaaaggggcagcgcctcaaggtccctgccattgcagatcctg

SEQ ID NO: 175247 - DNA, 601 bp, Human
gctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttacraaattgtgtggcagtttctgggactagaatgaatttcatttgtgctcctcggcagggagaggccatacttgcagtgagtcaccccaagacggagctgtttgagaactgcagctgcagcaaggccttccaggttcctgggagttgaaggaaaaggatgctgaggccaggacctgagtgcttgtctccatgttctggccacctcttcctagatttccagggactagcttgttggggctttactacctgctgacatgacccaggaggttgatgattgtcatcatcatccccgtttttcaaata

SEQ ID NO: 175248 - DNA, 601 bp, Human
ggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcartgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagcca

SEQ ID NO: 175249 - DNA, 601 bp, Human
agcggagatcgtgccactgcactccagcctggacaacagagttagactccgtcaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaactyacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttc

SEQ ID NO: 175250 - DNA, 601 bp, Human
cctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttayctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgcca

SEQ ID NO: 175251 - DNA, 601 bp, Human
tacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggayttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttattt

SEQ ID NO: 175252 - DNA, 601 bp, Human
gcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacayttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggccgagcatggtaactcatacctgtaattccagcactttgggaggccaaggcaggagaattgcctgagctcaggagtttgagacctgtctgggcaacatgg

SEQ ID NO: 175253 - DNA, 601 bp, Human
gcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggcygagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaag

SEQ ID NO: 175254 - DNA, 601 bp, Human
agctaagttactcaaagtgccattcagaaactgggcccagttctatttgcagctacatacattagaaatcatttctagaggccgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggyggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaa

SEQ ID NO: 175255 - DNA, 601 bp, Human
aaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagkttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctca

SEQ ID NO: 175256 - DNA, 601 bp, Human
tcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcayctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacgaaagccaattacaacaacaacaacaaaaaaacaacgaattaaacaaccccaaagattgcaca

SEQ ID NO: 175257 - DNA, 601 bp, Human
gccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcrcgccactgcactccagcctgggtgacagagtgagactccatttcaaaaaataaaaacaacgaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagccca

SEQ ID NO: 175258 - DNA, 601 bp, Human
gtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacraaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagc

SEQ ID NO: 175259 - DNA, 601 bp, Human
cagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctkaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtact

SEQ ID NO: 175260 - DNA, 601 bp, Human
tcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcrgtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagt

SEQ ID NO: 175261 - DNA, 601 bp, Human
gctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaaccyggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacct

SEQ ID NO: 175262 - DNA, 601 bp, Human
agcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccmctgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacc

SEQ ID NO: 175263 - DNA, 601 bp, Human
taggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccmcccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaag

SEQ ID NO: 175264 - DNA, 601 bp, Human
gctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggytggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgt

SEQ ID NO: 175265 - DNA, 601 bp, Human
aacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcaygcctataatcccagtgctttggaaggctgaggcaggaggattgcttgaggccaagggtttgagaccagcctaggtaacatagcaagaccccatctacaattaaaaaaaaaaaaaaagacagaaagaaaaaatagccaggcgtggcatgtgcttgtagtccaagctactggggagggaggctgaggcaggaggattccttgagcctgggagtgtgaggctgcagtgagctatgatggcatcgccgcactccagcctgcatgacacagtgagacctggtctcaaaaaccaaataataataac

SEQ ID NO: 175266 - DNA, 601 bp, Human
ccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaagacagaaagaaaaaatagccaggcgtggcatgtgcttgtagtccaagctactggggagggaggctgaggcaggaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagt

SEQ ID NO: 175267 - DNA, 601 bp, Human
actctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttgg

SEQ ID NO: 175268 - DNA, 601 bp, Human
ggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgyctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggtt

SEQ ID NO: 175269 - DNA, 601 bp, Human
ccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggrtcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgcc

SEQ ID NO: 175270 - DNA, 601 bp, Human
gacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcaycgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctag

SEQ ID NO: 175271 - DNA, 601 bp, Human
agacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttgagatggaatctcgctctgtcgcccttgcttgggtacagtggcatgatctgggctcactgcaacttccgcctccgggattcagacgattctcctgcctcagcctcccga

SEQ ID NO: 175272 - DNA, 601 bp, Human
gtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacrcatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttttgagacagattctcgctctgtcaccagactggagtgcagtggcaccaacttggctcactacagcctccgcctc

SEQ ID NO: 175273 - DNA, 601 bp, Human
tgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtytgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaac

SEQ ID NO: 175274 - DNA, 601 bp, Human
aacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtctgagacaaagtcttactctgtcacccakgctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacc

SEQ ID NO: 175275 - DNA, 601 bp, Human
atctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggmaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgct

SEQ ID NO: 175276 - DNA, 601 bp, Human
tgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgyagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggct

SEQ ID NO: 175277 - DNA, 601 bp, Human
tctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttmcagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcg

SEQ ID NO: 175278 - DNA, 601 bp, Human
aagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcrtaccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccga

SEQ ID NO: 175279 - DNA, 601 bp, Human
gtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgtctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagg

SEQ ID NO: 175280 - DNA, 601 bp, Human
gtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctrtttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctg

SEQ ID NO: 175281 - DNA, 601 bp, Human
gcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatrctgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgcc

SEQ ID NO: 175282 - DNA, 601 bp, Human
aggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgcygattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtct

SEQ ID NO: 175283 - DNA, 601 bp, Human
aacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccarccccaccagaggtcaagctgataacgtgtagcccaaggccaccatcatatatcacattgttagcatagtctgtctgacctggtctaagcttaggctcacttaagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcacc

SEQ ID NO: 175284 - DNA, 601 bp, Human
gcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttragcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaag

SEQ ID NO: 175285 - DNA, 601 bp, Human
tggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaagragcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaa

SEQ ID NO: 175286 - DNA, 601 bp, Human
tgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagag

SEQ ID NO: 175287 - DNA, 601 bp, Human
aggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatrcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaaggaggaattctcctt

SEQ ID NO: 175288 - DNA, 601 bp, Human
ctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggyggagaagaggggtagtggttggaaggaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgac

SEQ ID NO: 175289 - DNA, 601 bp, Human
agcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagraggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggccca

SEQ ID NO: 175290 - DNA, 601 bp, Human
gaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgc

SEQ ID NO: 175291 - DNA, 601 bp, Human
gcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctrgctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgcctttttttttttttt

SEQ ID NO: 175292 - DNA, 601 bp, Human
gcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcscagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagcta

SEQ ID NO: 175293 - DNA, 601 bp, Human
gatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccaktattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgg

SEQ ID NO: 175294 - DNA, 601 bp, Human
gtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacataytttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctg

SEQ ID NO: 175295 - DNA, 601 bp, Human
tttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttggga

SEQ ID NO: 175296 - DNA, 601 bp, Human
atacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgmctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctg

SEQ ID NO: 175297 - DNA, 601 bp, Human
aaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagacccygtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaacc

SEQ ID NO: 175298 - DNA, 601 bp, Human
tgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagcca

SEQ ID NO: 175299 - DNA, 601 bp, Human
gtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccrgtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttacctttttttt

SEQ ID NO: 175300 - DNA, 601 bp, Human
ctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttaccttttttttttttttttaattttaattatactgtttttctctttcttttcttttcttttttagaaatggagtctcgctttgttgcccaggctagtctccaactyctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgtt

SEQ ID NO: 175301 - DNA, 601 bp, Human
ggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagyccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatg

SEQ ID NO: 175302 - DNA, 601 bp, Human; identical to SEQ ID NO: 24722

SEQ ID NO: 175303 - DNA, 601 bp, Human; identical to SEQ ID NO: 24723

SEQ ID NO: 175304 - DNA, 601 bp, Human; identical to SEQ ID NO: 24724

SEQ ID NO: 175305 - DNA, 601 bp, Human
cggctagcacctgcatggaactgtaggaagagagaggatctctgaccaatgcccattccatctgagaagccagctagcacctgcacaggactgtggggagagacaggaggaactcggagcaatacccattccatctgaggagacggctagcacctgcatggaactgtggggagagagaggatctctgaccaatgcccattccatctgagaagccagctagcacctgcacagaactgtggggagagacaggaggaactcggaacaatgcccattctatctgaggtggcggctagcacctgcrtggaactgtgaggagagacaggaggaactcggagcaatgcccatgccatctgaggaggtgactagcacccgcgtggaactgaactgcatgcagccccatgacctcactcccgcctcacaacaactctgagatggcattttttccattttgcagatgggtcatttgaggctcttggaatgtggtctttgtacaatgagaataataaactcccctttttatcttcctcaggccagcagctcaggcacagacacacaccatctgtgatgaagcagctttccaggcatttcctcaggccagttt

SEQ ID NO: 175306 - DNA, 601 bp, Human
gtacagtggggagagacagggggaactcggagcaattcccattccatctgaggtggcggctagcacctgcgtggaactgtggggagagacaggaggaacccggagcaattcccattccatctgaggtggcggctagcacctgcatggaactgtaggaagagagaggatctctgaccaatgcccattccatctgagaagccagctagcacctgcacaggactgtggggagagacaggaggaactcggagcaatacccattccatctgaggagacggctagcacctgcatggaactgtggggmgagagaggatctctgaccaatgcccattccatctgagaagccagctagcacctgcacagaactgtggggagagacaggaggaactcggaacaatgcccattctatctgaggtggcggctagcacctgcatggaactgtgaggagagacaggaggaactcggagcaatgcccatgccatctgaggaggtgactagcacccgcgtggaactgaactgcatgcagccccatgacctcactcccgcctcacaacaactctgagatggcattttttccattttgcagatgggtcatttgaggctc

SEQ ID NO: 175307 - DNA, 601 bp, Human
tcttcccaccttgggctcccaaagtgctaggattacaagcaagagccacagcacctgacctcctcatttttaaatagtagcaacaaatttgagtttcgaaaaaattactgtgaggacaaacaaaacatctgtaggctggacatggactgagggctgccaaaggaataccttaaataccctagagaatgtactgacctttggagtcaaggggccagtaaaaaaattccatctaaggatgtgagggtaagtacagtggggagagacagggggaactcggagcaattcccattccatctgaggyggcggctagcacctgcgtggaactgtggggagagacaggaggaacccggagcaattcccattccatctgaggtggcggctagcacctgcatggaactgtaggaagagagaggatctctgaccaatgcccattccatctgagaagccagctagcacctgcacaggactgtggggagagacaggaggaactcggagcaatacccattccatctgaggagacggctagcacctgcatggaactgtggggagagagaggatctctgaccaatgcccattccatctgagaagccagctagcacct

SEQ ID NO: 175308 - DNA, 601 bp, Human
ccttttctgtatattctgtttttaaagtatcaggggaaaaggggaggcatgaacactgctaagagccattaaacatttatcttaaacacaacactgtctaaatctgacatgacccaatcaacatcatcacaatgttcaatcaagcacagagaagctttcaacctaatactcaaaggtaatcaaagcccttgaaatgtaatgagatgaatctgcagagctgacatagtgaaagtctaaccaaagtaggctggtgccgtggctcacgcctgtaatcccagcactttgggaggcccaggtcggrggatcattaagtcaagagactgagaccagcctggccaacacggtgaaaccacgtctctactaaaaatacaaaaattacctgggcgtggtggcgcacgcctgttgtcccagctactcgggaggctgaggcaggagaatcacttgaacccaggaggcagaggttgcagtgagttgagactgcaccactgcactccagcctggcaacagagtgagactccatgtcatttaaaaaaaaaaaaaagaaagtctaaccaaagtaatctttatgtctaattttattaggttgggaaaggaaggacca

SEQ ID NO: 175309 - DNA, 601 bp, Human
aaaaaaataaaaaaaataaaaaaaaaattagctgggtgtggtggcaggcacctgtagtcctagctactcaggaagctgaggtgggaggataacttgagcccaggagttcgaggctgcagtgagctgttatcatgccactgcactcctgcctgcgtgtcagaacgagactctgtctctaaaaaagaaatgttggaaacctcctcctctaaggaaaatacagaaatggtggccaagtcaaggaaagcctttcacctctacatggtgcatccccttaataaaggaccacagggcattatgaagrccatggagcaaaatggaaaaatgcttacaacacagagtggaatatctttactagtattacaaggatctaaaaaaaggattccaaggacagaaggaaacagaaaaatgtgaaaacagctggtagacactactctggtaatgagaatatggtgattcttcacccaactccccttttctgtatattctgtttttaaagtatcaggggaaaaggggaggcatgaacactgctaagagccattaaacatttatcttaaacacaacactgtctaaatctgacatgacccaatcaacatcatcacaa

SEQ ID NO: 175310 - DNA, 601 bp, Human
cttggcaaaatgtttaagaaatcttttaaggatgctcttttagccaataatgagccacacagaattttcttctaaggaaacgatctaaaagggaaagaaaatgctcagagatttccccacagcttaatttgccaaaatgaaatgttgggaacaggccaggtgcggtggtcactgcctgtaatcccagccaccttgtggtggctgagacatgaggatcacttgaggccaggagttcaagaccaacctgagcaacacagaaagaccccatctatacaaaaaaactaaaaaaaataaaaaaaawaaaaaaaaaattagctgggtgtggtggcaggcacctgtagtcctagctactcaggaagctgaggtgggaggataacttgagcccaggagttcgaggctgcagtgagctgttatcatgccactgcactcctgcctgcgtgtcagaacgagactctgtctctaaaaaagaaatgttggaaacctcctcctctaaggaaaatacagaaatggtggccaagtcaaggaaagcctttcacctctacatggtgcatccccttaataaaggaccacagggcattatgaagaccatggagcaaaatgg

SEQ ID NO: 175311 - DNA, 601 bp, Human
ggaaagctacttggcaaaatgtttaagaaatcttttaaggatgctcttttagccaataatgagccacacagaattttcttctaaggaaacgatctaaaagggaaagaaaatgctcagagatttccccacagcttaatttgccaaaatgaaatgttgggaacaggccaggtgcggtggtcactgcctgtaatcccagccaccttgtggtggctgagacatgaggatcacttgaggccaggagttcaagaccaacctgagcaacacagaaagaccccatctatacaaaaaaactaaaaaaaawaaaaaaaataaaaaaaaaattagctgggtgtggtggcaggcacctgtagtcctagctactcaggaagctgaggtgggaggataacttgagcccaggagttcgaggctgcagtgagctgttatcatgccactgcactcctgcctgcgtgtcagaacgagactctgtctctaaaaaagaaatgttggaaacctcctcctctaaggaaaatacagaaatggtggccaagtcaaggaaagcctttcacctctacatggtgcatccccttaataaaggaccacagggcattatgaagaccatgga

SEQ ID NO: 175312 - DNA, 601 bp, Human
gcctcccgggttcaaacgattcttctgcctcagcctcccaagtagctgggactacaggcgcccgccaccacacctggctaattttttgtatttttagtagagacgaggtttcactatgctggccaggctggtcttgaactcctgacctcaggtgatctgcccacctcagtttcccaaagtgctgggattacaggtgtaagccaccacactggctcacagattttagaaatgcctacaaaagcaatcaccatagctaaaaatcaatctagggatgtgcatggttttggatttttttctttcyttttttttttttttttgagatagggtcttgctctatcgccccaggctggagtacgctggcatgatcatacccttgacctctcaggctcaagtgatcctcccaagtggctagaaatacagatatgcgccaccatgcccagctaatttttttattttttgtagagacaggggtctcactatattgcctacactggtgtccaagtcctgggttcaagcgatcctcccaccctggcctcccaaagtgctgggattacaggcgtgagccacctaacctggtcatatatatttaaagggaccttgg

SEQ ID NO: 175313 - DNA, 601 bp, Human
acagtggcgcacacttgtagtcccagctactcaggaggctgaggcgagaggatcacttgagcccagaagatcatacccaagcctgggcaacaaaatgaaatttcacctctgaaaacaaaaattttttaaattttttttaagacagatggcaggagacagggtacaggcagtgctgtgccccagatcaaccaccacagcaattatgtgccacactagtgatcgacacccaggctggctcctcagcaagtcgtggtcataccctgccgtgtaactaacaccatgaggtctcaatttgacagtrtattagtctaactggaacctcatgctttggaaaaaaaattctccctactccttaaataatgcaaaccacacataagaatgaaggtgaatgcacacttaaatcctgctaaactaggccactatacccagcaaatgcctcgggcagacaaagggctcctggaaaaaggggccctggttgtctcctgtaccactgcctaagccataactttaccccatctgggaacaatctgaaaaataaaacaatgagaaggcttggcatgttcattccaagctattcagttgctttaaattagcttaacgt

SEQ ID NO: 175314 - DNA, 601 bp, Human
cctgtgagtttaagagggggtgggagcccggcacagtggcgcacacttgtagtcccagctactcaggaggctgaggcgagaggatcacttgagcccagaagatcatacccaagcctgggcaacaaaatgaaatttcacctctgaaaacaaaaattttttaaattttttttaagacagatggcaggagacagggtacaggcagtgctgtgccccagatcaaccaccacagcaattatgtgccacactagtgatcgacacccaggctggctcctcagcaagtcgtggtcataccctgccgtgwaactaacaccatgaggtctcaatttgacagtatattagtctaactggaacctcatgctttggaaaaaaaattctccctactccttaaataatgcaaaccacacataagaatgaaggtgaatgcacacttaaatcctgctaaactaggccactatacccagcaaatgcctcgggcagacaaagggctcctggaaaaaggggccctggttgtctcctgtaccactgcctaagccataactttaccccatctgggaacaatctgaaaaataaaacaatgagaaggcttggcatgttcattcca

SEQ ID NO: 175315 - DNA, 601 bp, Human
ggccttccattgctcctctggcgagaaccttgtacttagaactgccccaaacacaccaaggcatggccccggcatctggtgccagctagccagctccactcttcagactttcatatccctggcctgtgagtttaagagggggtgggagcccggcacagtggcgcacacttgtagtcccagctactcaggaggctgaggcgagaggatcacttgagcccagaagatcatacccaagcctgggcaacaaaatgaaatttcacctctgaaaacaaaaattttttaaattttttttaagacagayggcaggagacagggtacaggcagtgctgtgccccagatcaaccaccacagcaattatgtgccacactagtgatcgacacccaggctggctcctcagcaagtcgtggtcataccctgccgtgtaactaacaccatgaggtctcaatttgacagtatattagtctaactggaacctcatgctttggaaaaaaaattctccctactccttaaataatgcaaaccacacataagaatgaaggtgaatgcacacttaaatcctgctaaactaggccactatacccagcaaatgcctcgggcagac

SEQ ID NO: 175316 - DNA, 601 bp, Human
aaagaccctaactctacaaaaaaatataaaaataaattaactgggcatggtggtgtgtgcctctagtcccagctactcaggaggctgaggtgggaggatcacttgtgcccaggagtctgaggctgcagtgggctagaatcgtgtcaccgtattccagcctggaaaacagagcaagaccctgtctttaagaaacaaacaaacaaacaaaaaacaaatagttggtttaacgccttgtccaagtactccctaaaaccacccccattatactggtgaggcccacacaggaaacatcctcagcaaraacccagactcgtacagctgtataaggcaccttcagatgacaggggtgtggtaagatcagcagggaggtctccaaccactgtctgtacctgggatggttccccagatatgccccatgtccccagcaagccttcaaaacctcaggataatgaaaaaatgtccctataatgatgtttagggaaccctgatttttaaaatgtcccaacagtaatattcaaagtgccacacttatatacaacacctgtgtcagtcagaaagtacacggaccttaaagacacaagatatgaacacgttcaagtct

SEQ ID NO: 175317 - DNA, 601 bp, Human
gtggtctgctgctgctgctgcatgaccttggggatggcggcggacggctcctgagccttcccttccttgaactcgctgaccttgtggcggtagtaggcatggtaagggtcattggggttcagaaagttgaacttggggttgttgatctcgttctgtcggatcctagcttcaaattcaggcccgtttctggaggaagaaaaaacaacaagaataaacaccactcccttgtgcctgctgtgatctagaacactgcccattggaacgtccttcttgccaccacccactgctcaaaccagcccakccctcagcagacgtcctcctctagcttcctggcattggcgatcagtgccatctgcctcattcagcttgaaccaggccacctctgccacagggtttccctgaacccagtcattccttagctccttttccagttctgccatttccaaaaccatctaggctatcgctcatttcttttaataaaatttactttaaaaaaaatctatttaagatggagaatacatattactacttcaaataaaaaaaaatcagtatgcctttaccaacaaaaggtagtcaaaagtgaacataatgaaaacaaagt

SEQ ID NO: 175318 - DNA, 601 bp, Human
gaagaaactgaggtagcctgaggtcctaggcctcattgcaacgcaaggtcttagaacctgacttcaacctttatagcccactgcaaaaggagggactgccttttccaccatggttcaggagtgcagaaggcaggtctggacaggaggaaaaacatgtcagcctctctcttcattcataatcctaatagtccctagtgctgggcctcagcacagggaaggtggtatcaggggaggccaggatggaggggtcctgggaagaagagatagaagggaagggatggcacaaggaggagcccacagsccacactgcatccttcagcacagccaagtaggaagtgctgccctcacatcacggcactgccctcacaccctgagcaaggccttgaataaatcacacgtcccccaactctcaggttcctcatacagcctctgtgaggagtcaatgagacaagactcctgaagtaccaagcacagagcttgacaagcagtgctcgggaaatgccaactaacatcagtactttgctgtctgggcctcggtctgcctctgagagatggggataacgacctcacttctctccctgggtggttgtgagatttggag

SEQ ID NO: 175319 - DNA, 601 bp, Human
gaggtagcacaggtactgtgaatcctctttacagatgaagaaactgaggtagcctgaggtcctaggcctcattgcaacgcaaggtcttagaacctgacttcaacctttatagcccactgcaaaaggagggactgccttttccaccatggttcaggagtgcagaaggcaggtctggacaggaggaaaaacatgtcagcctctctcttcattcataatcctaatagtccctagtgctgggcctcagcacagggaaggtggtatcaggggaggccaggatggaggggtcctgggaagaagagayagaagggaagggatggcacaaggaggagcccacaggccacactgcatccttcagcacagccaagtaggaagtgctgccctcacatcacggcactgccctcacaccctgagcaaggccttgaataaatcacacgtcccccaactctcaggttcctcatacagcctctgtgaggagtcaatgagacaagactcctgaagtaccaagcacagagcttgacaagcagtgctcgggaaatgccaactaacatcagtactttgctgtctgggcctcggtctgcctctgagagatggggataacgac

SEQ ID NO: 175320 - DNA, 601 bp, Human
attctaattatgtacttaaaagtgagtagagttaggaaattctcaagtcctttcaagtcagatctttgaggtgttgtttctggatatgaagaagagatgtacagaccatcccactgtaaagggaaggaaaacaacctccatgacatgtgtagcaagaaaaatgtgccacaggcaaagctgtcagtgcactttgcaataaattaataatctgattattttaaatgccagaactgacttgtcctgattcttgattgcagctctgtcaaatgataattgagttcttagggtctggagtaaaaaygccagagctcaagccccagccctgccacctcctagctatgtgaccctggccatgctaacttcactgcacctcaattttctcttctgtaaagtgaacatagcaatagtggctaccttataggctaccggagattaaatgagaagatgctgcatacataatttcttagtgatgttagttatactgacttacatgacatcaaagtgtctctcaacacctatttaaatgctgtttccaatttaaggcactttataagctgaagaaccaaagttttagggtcaaatgtggtttaaatctcagcat

SEQ ID NO: 175321 - DNA, 601 bp, Human
gggagggaagttccctagagggtgagccagaggcaaaggtattccttatcaaagacccacctatttgccctgtctgagctccccaagggctggggccatgtctgttttctctccagctatctccagaggcccatctagggtctggcaagtacgtattgaatctaagttgggcaaagtggtagaactgaagtcttttgggagcagggaggagacagcactgataaagccctctgagagattctactgctctctgggaacacctgcaccaggtttcccgggaagtctgagttcctggctcccyatctggagtcactcctcacagacctaccttgctcattgggttggaagtccactgtttccaccaccacaaaatcatgccagtcgatctgagcataggccacccgctccttctccttctcctcttcttccttcttcctctcacgttcctggaatttggcccattccactcggtaacacacctgcagagatgggaaacagcttggtgctacgctgaagcagggtctgctcctgatgaggctaccacctccagggctttcatcaaagtcagcgcctccttcggaacagaatggaagtatggttc

SEQ ID NO: 175322 - DNA, 601 bp, Human
ttgcggacaatgacttggtctggagttgggggcagaggtggaggcatgggtgtctctgggggtgggggcactttctgcccttcttcttcatcatctgaaccctgaaaagcaaagcaatggcaggactcagagaggggctgaggccacctccctgtagctgagcctggcaggtctctgggtggcaaggagccttggcctctgccagccagcatccatgtgctaagcctcccagggcagctgaggccagccggcagcaggccaagctgcttcctcacagcatgaatgggagtgctgaggccayggtcctagcactcctcccaggcatttccagcagctggcaccaggcagtcccaagaggccaagggcacttaacatgccggggggggacagtgccaagggggcgaggggtgggggcggcgagtcgccaatcaatggtagctgctcacacagcaatgctgggagggagagaaaaagtcatttcccacagacaggggccctttcttctcaggctgtgcacaaattatttccgagtgggggagaacagtctggttctggagactccatgcctgcttagagggcctggcttgaagggggtagggat

SEQ ID NO: 175323 - DNA, 601 bp, Human
agaagtccaatgcgcatgtgttcctgcattttgctggcggggatcttctccccagtaatgggggacacaagatactcatctggagcaggggctggaggcaagggcttggaggctaaaaggaaacagatgtttcagtaagaacactggtgggcagccacctgagttaagagggtggtatttcatgcgtgcatcattcatcaaggcatctattcagtgccactcttgtacctggcactgtgaaaggcactagggcaccagagatgactgggccctgttcccaccatgaaacctgtaacagacrggcttgcaatgcttttacaataagctgcacctcaagccctcctagaaagacgggtgtgaggaacacatgagggcacacaggacttcctgggcagcccgagggttgggaagcaggccctccctacctttgggatcataatccttgcggacaatgacttggtctggagttgggggcagaggtggaggcatgggtgtctctgggggtgggggcactttctgcccttcttcttcatcatctgaaccctgaaaagcaaagcaatggcaggactcagagaggggctgaggccacctccctgtagct

SEQ ID NO: 175324 - DNA, 601 bp, Human
aaagtcagttccagggtagatgctggcttactgtgggtggtcggggcactgaagtgatgggtggagccgagctggggatgttggtggctgaagatggtggcggtggctgttgagggatttcattgggcttgctggggccaatcttctctttagtgtcatcctctggcaccaggcctttggccttgtgaatggcctcaatctgctcctggagggtgatgttggcctgggcagcctgctgggtccgggccatgctgcctgagtggccatcccaggtcacctgcaagtgaaagcaaagccacartgcttctggaactaagaccaagtatggaagacggggggcagagaaggcactaggttccactttagccgcaccttttcctctggcttctggatctcctcctcaccgatcttcttaccaatggctgtttcctctacaccgaagatgtcagtacgccgctcagccaactgcttcaagctgctctcaatatccagacctgtacagtcacaaaacagaggcagaggatagaaagagaaaataaaccaggtgtcctgacaagagagcagcttttctggtgtgcagggaggaggctggttccatggg

SEQ ID NO: 175325 - DNA, 601 bp, Human
cagcctgggcgacaagagcaaaacttcatctcaaaaaaaaaaaaaaaagaggccgagacctcgactaagtctctcctggagacaagccaacagtcctcaaagacccaataagccctgcagcccttctctgacgccaactggtttctcatatttgccacttacctccctccctgttccaaccctcctccacaaacagatcaagagagaggttcccacttgcatttaaagggctctttctctttcaaactgacccacccaacactcaggccccactaaaaggcagctgcacttctcagccaayagtgtccgacctcaagaatgaagctctaaaaaagtcagttccagggtagatgctggcttactgtgggtggtcggggcactgaagtgatgggtggagccgagctggggatgttggtggctgaagatggtggcggtggctgttgagggatttcattgggcttgctggggccaatcttctctttagtgtcatcctctggcaccaggcctttggccttgtgaatggcctcaatctgctcctggagggtgatgttggcctgggcagcctgctgggtccgggccatgctgcctgagtggccatccc

SEQ ID NO: 175326 - DNA, 601 bp, Human
cccagctacttgggaggctgaggcacgagaatcacttgaactcgggaggcggaggttgcggtgagccaagatcatgccattgcactccagcctgggcgacaagagcaaaacttcatctcaaaaaaaaaaaaaaaagaggccgagacctcgactaagtctctcctggagacaagccaacagtcctcaaagacccaataagccctgcagcccttctctgacgccaactggtttctcatatttgccacttacctccctccctgttccaaccctcctccacaaacagatcaagagagaggttcccacttgcatttaaagggctctttctctttcaaactgacccacccaacactcaggccccactaaaaggcagctgcacttctcagccaacagtgtccgacctcaagaatgaagctctaaaaaagtcagttccagggtagatgctggcttactgtgggtggtcggggcactgaagtgatgggtggagccgagctggggatgttggtggctgaagatggtggcggtggctgttgagggatttcattgggcttgctggggccaatcttctctttagtgtcatcctctggcaccaggcctttggcct

SEQ ID NO: 175327 - DNA, 601 bp, Human
ctgggcatggtggcgcatccctgtaatcccagctacttgggaggctgaggcacgagaatcacttgaactcgggaggcggaggttgcggtgagccaagatcatgccattgcactccagcctgggcgacaagagcaaaacttcatctcaaaaaaaaaaaaaaaagaggccgagacctcgactaagtctctcctggagacaagccaacagtcctcaaagacccaataagccctgcagcccttctctgacgccaactggtttctcatatttgccacttacctccctccctgttccaaccctcctycacaaacagatcaagagagaggttcccacttgcatttaaagggctctttctctttcaaactgacccacccaacactcaggccccactaaaaggcagctgcacttctcagccaacagtgtccgacctcaagaatgaagctctaaaaaagtcagttccagggtagatgctggcttactgtgggtggtcggggcactgaagtgatgggtggagccgagctggggatgttggtggctgaagatggtggcggtggctgttgagggatttcattgggcttgctggggccaatcttctctttagtgt

SEQ ID NO: 175328 - DNA, 601 bp, Human
gctgacagtacttggcccgtggtccctgaactaatggcctggaaaatgatgcaagagatactgacctgttggcacaatcatggggggtgggcggggggccataataggaggggccgagggaggcatgggcaccacgttgattctgggcgcgtggatgatgggcggcatgggggcgatcactgagcctgggggcagccggaccacagatgccattgggggccggggcatgacgggtactgcggagacaactgtagtacgaactggaggtggcatctgtgcaggaaagagacccacagattamaggaagccaaagttggactccaaggtcacacacagttggcaactggctgcctgcagctctgaggatggaggttagacaactacgtcctggccccctgggactgagaaactgtggcctacactgggcgtccaataggaactgagctgctgagagcccgaggatgacactctctctacttgggacttggcgggtcaaactcgacctgctactttggcaaacactgaaagagtcactaaagaggctgagaccttggccaggcacagtggctcatgcctgtaatctcagcactttgggaagcta

SEQ ID NO: 175329 - DNA, 601 bp, Human
ctgtttgcgctctggacttagcaaatacaggagcttgtgagaaggtagggtgttggggactggaggcctctcattcctcccactgtttcctttcttcccaccaattacgctcctcccctttgtcaacatttgactcaaaagctcaactccccaaaaagttggcccctcaccaactccatggagctctgactctgaaatcacaagacctttagggatcacttagcccaacagcctcaatggatagagataactgaggcccagagcagggatttgttcaagttcagagaagaagaacattaaygcctccatgtgacctggcatcaggcggggctagactatcacctccaagtcaggctgcctgaggtcatactggcagggatggcccaaccactggatcaggaacccaccagagcatgcctaagtcttgtcactaaatctctatgcccagtcattgaggcaaagaatcttacagatcccacacaagactctactgtgaccccaccagagccttgcattgttgggcacacctgccccaacactcccagccagcatcatgacttctaggatggattcagatggccacacccagatatcactccac

SEQ ID NO: 175330 - DNA, 601 bp, Human
atttgaattcccaaactgagtaagagcgaaacaaatatgcaggcaaggcaaagcctcaggggggctcctgggtctggggcagggggtgggagacaggagaggcaaaatggcagggacttgacagcaggttcctcttgtctacttcttcctcccgcctctctccttgagggccaggtggatgactgcgccattggccatgttgtagtaagccagtgagttggaatctttgatgaagataccctggaaaacagacagcgtgccttagcgtggggcaacccagccttggggataccgctgcaaycttacaactgtgcacttggtctgtttgcgctctggacttagcaaatacaggagcttgtgagaaggtagggtgttggggactggaggcctctcattcctcccactgtttcctttcttcccaccaattacgctcctcccctttgtcaacatttgactcaaaagctcaactccccaaaaagttggcccctcaccaactccatggagctctgactctgaaatcacaagacctttagggatcacttagcccaacagcctcaatggatagagataactgaggcccagagcagggatttgttcaagt

SEQ ID NO: 175331 - DNA, 601 bp, Human
ggaaagggtcaggggaatgaacctctgcaggacaatttgaattcccaaactgagtaagagcgaaacaaatatgcaggcaaggcaaagcctcaggggggctcctgggtctggggcagggggtgggagacaggagaggcaaaatggcagggacttgacagcaggttcctcttgtctacttcttcctcccgcctctctccttgagggccaggtggatgactgcgccattggccatgttgtagtaagccagtgagttggaatctttgatgaagataccctggaaaacagacagcgtgccttagcrtggggcaacccagccttggggataccgctgcaaccttacaactgtgcacttggtctgtttgcgctctggacttagcaaatacaggagcttgtgagaaggtagggtgttggggactggaggcctctcattcctcccactgtttcctttcttcccaccaattacgctcctcccctttgtcaacatttgactcaaaagctcaactccccaaaaagttggcccctcaccaactccatggagctctgactctgaaatcacaagacctttagggatcacttagcccaacagcctcaatggatagag

SEQ ID NO: 175332 - DNA, 601 bp, Human
gttctgcgtcccatgaatacagattggggaaactgaggccttgcgaaagagaagggctcccacaagctctcctttcgaggcatgggcactgattcccattctatcccccgtgcgagaccgcctctatcatctgggagtgcatttcacgagtttgccctgagtggagaagcagaggccggggagcgcggtgaacagagttgggctgaaagtaagagacctggattcgagacttcgccaccgacagacaattgtgcgttctgggccaaatctcttccctgtgctgggcctcagttttctcgtstctaaaacggggcagtgtttttcaaaatatggttcttacaccatctgctttgtaattctctgagatgccggctttacagcgcgggactcaattcagacttctggtttagaatctgaacttatgcgtaggggggtcctgtatatactaatgtttgaagctcattgattttaagtgctttcctgctgtgagcactagatatccattcttcgctttgaggcagctggtgccagttcaggaactttgaaagaactggaatggttagctcagtaaagagagcactggaagggaattaacttttta

SEQ ID NO: 175333 - DNA, 601 bp, Human
aaaataaaaaagttgtgaaatgcttattcagatgttatccaggtactgggtaaaatgatcttaatttgttggagtttttagaacttctcgatctaaaagtttccttttaaagaagtgtctgaattgacattctcataagtatgttcttcaggccactggtctgaagaagtggctctgaaaaaaggatttgatgctaataataagtttgagaaagccacataccattattctttcttggagcttctcaatgtgtaataccacattaaaaccactgagaggtcctgcaataaggaaatgtgcyttataagccaagataataacttgttccatttgtttaatctacttgatgtcaaatctttttttttttttaattgaagcacacgttagcaaattctgacctagagtggggatctgcatactatatataggctgtgaaccaaacctggacctactgcttgtttatatggtctgtgagctaagggtgctttttacatttttctttctttttttttttttttttaagacggagtctcgctctgttgcccaggctggaatgcagtggctccatctcggctcactgcaagctccgcctcctgggttc

SEQ ID NO: 175334 - DNA, 601 bp, Human
ttggagtttttagaacttctcgatctaaaagtttccttttaaagaagtgtctgaattgacattctcataagtatgttcttcaggccactggtctgaagaagtggctctgaaaaaaggatttgatgctaataataagtttgagaaagccacataccattattctttcttggagcttctcaatgtgtaataccacattaaaaccactgagaggtcctgcaataaggaaatgtgctttataagccaagataataacttgttccatttgtttaatctacttgatgtcaaatctttttttttttttaattgaagcacacgttagcaaattctgacctagagtggggatctgcatactatatataggctgtgaaccaaacctggacctactgcttgtttatatggtctgtgagctaagggtgctttttacatttttctttctttttttttttttttttaagacggagtctcgctctgttgcccaggctggaatgcagtggctccatctcggctcactgcaagctccgcctcctgggttcatgccattctcctgcctcagcctcccgaatagctgggactacaggcgcccaccccgatgactggctaa

SEQ ID NO: 175335 - DNA, 601 bp, Human
taccattattctttcttggagcttctcaatgtgtaataccacattaaaaccactgagaggtcctgcaataaggaaatgtgctttataagccaagataataacttgttccatttgtttaatctacttgatgtcaaatctttttttttttttaattgaagcacacgttagcaaattctgacctagagtggggatctgcatactatatataggctgtgaaccaaacctggacctactgcttgtttatatggtctgtgagctaagggtgctttttacatttttctttctttttttttttttttttaagacggagtctcgctctgttgcccaggctggaatgcagtggctccatctcggctcactgcaagctccgcctcctgggttcatgccattctcctgcctcagcctcccgaatagctgggactacaggcgcccaccccgatgactggctaattttttgtatttttagtagaggtagggtttcactgtgttagccaggatggtcttgatctcctgacctcgtgatctgcccgcctcagcctcccaaggtgctgggattacaggcgtgagccaccacgtctggcctgctttttacatttttaaa

SEQ ID NO: 175336 - DNA, 601 bp, Human
ctgagaggtcctgcaataaggaaatgtgctttataagccaagataataacttgttccatttgtttaatctacttgatgtcaaatctttttttttttttaattgaagcacacgttagcaaattctgacctagagtggggatctgcatactatatataggctgtgaaccaaacctggacctactgcttgtttatatggtctgtgagctaagggtgctttttacatttttctttctttttttttttttttttaagacggagtctcgctctgttgcccaggctggaatgcagtggctccatctcrgctcactgcaagctccgcctcctgggttcatgccattctcctgcctcagcctcccgaatagctgggactacaggcgcccaccccgatgactggctaattttttgtatttttagtagaggtagggtttcactgtgttagccaggatggtcttgatctcctgacctcgtgatctgcccgcctcagcctcccaaggtgctgggattacaggcgtgagccaccacgtctggcctgctttttacatttttaaatgatgggaaataaaagaagaataatattacataggtgacaattacaggaaga

SEQ ID NO: 175337 - DNA, 601 bp, Human
gggactacaggcgcccaccccgatgactggctaattttttgtatttttagtagaggtagggtttcactgtgttagccaggatggtcttgatctcctgacctcgtgatctgcccgcctcagcctcccaaggtgctgggattacaggcgtgagccaccacgtctggcctgctttttacatttttaaatgatgggaaataaaagaagaataatattacataggtgacaattacaggaagataaaatttcagtgttcatttcagtcacacccatttatttatattcatatatatttacatattgkctttgggtgctttaatgctactcagtggagttgattacttcccataaaaaccatatggtccacagagtctaaagtatttactctatggccctttatggaaaaaaaattgccaattcctgacctgcatcgtgtacattttttttttttgagacagtgactcgctctgttgcccaggctggagtgcagtggcacgaacatagcctactacagccttgacctcctgggctgaagccatcttcccacctcagccacccgagtagttgggactacgggcacacaccaccacacccagctaacttt

SEQ ID NO: 175338 - DNA, 601 bp, Human
gccaccatgcccagctgttttttgtatttttagtagagtggggtttcaccatgttgggcaggctggtcttgaagtcccaacctcaggtgatccacctgcctcggcctcccaaagttctgggattacaggtgtgccaccacacccggcctgcatttgcactaaaatttattttttttttaattgtttgtttttgagatggaatttcactcttattgcccaggctggagtgcagtggcgcaatcttggctcaccgcaacatctgcctcccaggttcaagcgattctcctacctcagcctcccraggagctaggattacaggcatgcaccaccacgcccggctaattttgtatttttttttttttagtagagacagggttgctctatgttggtcaagctggtctggaactcccggcctcaggtgatctgtctgcctcagcctcccaaagtgctgggattacaggtgtgagccactgcgcctggccatttgcactaaaatttatgagggttccagtttctccgcatccacaacacttgttattgcccactaaaaaaattatatctctcctagtgggtgtgaagtgatatctcattgtggttttga

SEQ ID NO: 175339 - DNA, 601 bp, Human
cagaaatgaggttgtcatccaagatatgataagactagtcagggagccttcattttgggtgccactctgctgtatgtctggttataggcagggagtagaggagtcagtggtggtttgaatgctcaggactagctgctcatagctacataactacagtgctcctaggcctatcttgaccctacagcatttggccataaccaaaccatcttggacacataccttgaaacaaacaaaagcttcagtaatgtaaattgtgaaagtagtatgtgcttattttattattatttttttttagagatggagtcttgctctgttgcccaggctggagtgcagtggcacagtgttgactcactgcagcctccatctcccagattcaagcaattctcgtgcctcagttcctgagtagctagaattacaggcaagtgccaccatgcccgactaatttttgtatttttagtagagatggggtttcatgatcttggccaggctggtctcgaactcctgacctcaagtgatccgcccacctcagcctcccaaagtgctgggattacaggcatgagccaccatgccctgccgatgtgctcattttagacattttggg

SEQ ID NO: 175340 - DNA, 601 bp, Human
gcaatcctcttgcctcagccccctaaagtgctggaattacagcagtgagccattgtgcctggcccattttaattatttttaaatgtacaattcagtggcattaagtaaattcacaatgttgtataaccatcaccactatttctaaaactttttcagcataccaaacagaaactctacccatgaagcaataactcctcattctctcctccccccagctcctggtaacctctgatccactttctatctgtatgaatttgcctattctggatatttctaataagattctaataagaaaatcacmcaatgtatgaccttttatggaaacgtaggggggttttttcctttttttttttttttttttttgagacagtctcactccgttgtcacccaggctgagtgcagtggtgtcatctcagctcacttcaacctccgcatcctgggttcaagcaattattgtgcttcagcctcccaaatagctggaattacaggcgctcaccaccacacctggctcatttttgtatttttagtagagatggggttttgccatttgcccaggctggtctcgaacgcctgacctcaagtgatccgcctgccttggctt

SEQ ID NO: 175341 - DNA, 601 bp, Human
tcttgcaaaagtgaaactctgtgtctattaaacaataactccctatttcttcttccccctagccactgccaaccactattccactttctgtctctatgattttgtttactctaagtacgtcatataagtagaatcatacagtatttgtcctttttatttttgaagatgaggcctaaccgtgtggctggtgtcagactcttgggtttaagtgaactttctgcctcagcctcccaagtagctggggttatgtgtgggcaccactgcacccagcttagtatttgtcttcctttgactgacttayttcacctaacatgatgttcttgaggttcatttatgttgtagcatatgtgagaatttttcttcctttttaagataaaatgattttccgttgtatgtattttgcttatccattcatctgtcgatgcaaacttggattgcttccatgtttcagctattgtgaatactgctactgtgaacattgatgtatagctatttctttgcgaccttgctttcaattatttgggtacatacctagaggtagaattgctggatcatatggtagttcagtttttaatttttttgaggagcctctgtgctgttt

SEQ ID NO: 175342 - DNA, 601 bp, Human
gtgatgttgagcacccttctgtgtacttttgggacatttgtatttcttctttgaagaaatgtctctattcaagtcctttgcccccccgccccaccaccaccctttaaaaattttttttgagacagagtctctctctctcttgcccaggctggagtgcagtggtggaatctgggctctgcaacctccacctcctgggttcaagcaattatcttgcctcagcctcgcacgtagctggaagtacaggcgtgtgccaccacacctggctaatttgttttgtatttttagtagagacaaggtttcrccatgttgcccaagttggtctcaaacttctgacctcaagtgatctgcctgcctaagcctcccaaagtgctggaattacaggcctgagccaccatacctggccccacttttgaatcaggttgtttgttgttaagttttaggagttatctatgtattcaggatattaattccttttcagatatatgatttgcaaatattttctcccattctgtgaattgccattttactctattggtagtgtctttttatgcacaaaatttttaaatttttatgaaatccaatttgtctactttttcttttg

SEQ ID NO: 175343 - DNA, 601 bp, Human
agtccatctcttcatttcattggtcgttgggaacaaagctcccgagtgttggatccttgtcttccagctggcctaaggacatgcaaagattagaagcagcacttctatgttcattgagccagattgtgtctgcttctgtggaaatggcctaggggactcactggccattctgtcctgggtccagttgccaggttaattcctgtgatagtttctatagcacctgactctgatactcgctctcttaattgctcctcagaagtgccttgtgatgtaacagtgatgtggttttttgttttgtttktttgtttgtttgtttgagacagagtcttgttcagtcgcccaggctggagtgcagtggtgcaatctctgctcactgcaagctccgcctcccgggttcatgccattctcctgcctcagccccccgagtagctgggactacatttgcctgccaccaggcctggctaatttttttcgtatttttagtagagacgaggtttcaccgtgttagccagatggtctcgatctccttaccttgtgatccacccgccttggcctcccaaagtgctgggattacaggcatgagccaccacctctggccaga

SEQ ID NO: 175344 - DNA, 601 bp, Human
gtgatagtttctatagcacctgactctgatactcgctctcttaattgctcctcagaagtgccttgtgatgtaacagtgatgtggttttttgttttgtttgtttgtttgtttgtttgagacagagtcttgttcagtcgcccaggctggagtgcagtggtgcaatctctgctcactgcaagctccgcctcccgggttcatgccattctcctgcctcagccccccgagtagctgggactacatttgcctgccaccaggcctggctaatttttttcgtatttttagtagagacgaggtttcaccrtgttagccagatggtctcgatctccttaccttgtgatccacccgccttggcctcccaaagtgctgggattacaggcatgagccaccacctctggccagatgtggtttttattttttatttattttatttatttattgagacagagtctcactctgtcacccagggtggagtgcggtagtatgatctcagctcactgcaacctccacctccagggttcaagcgattcccatgtctcagccttccaagtaactgggattacagacatgtgccaccacacccagctaatttgtattttttagt

SEQ ID NO: 175345 - DNA, 601 bp, Human
tgacctcagatgatccacccaccttgtactcccaaagtgctgggattacaggtgtgagccaccacgcctggccaggtttttattttttaatatttatttatttatttttgagacaaggtctttgtatgctgcccaggctggtctcaaactcttgtcctcaagcaatcctcctgcctcagcctcctgagtagctggcatgttccactgtgcctggcatgtgggggtttttaaagatggacaggtctctgaatacaggagtggatcctgggcaaagcctaaggaagtttgttgttttttcttracactatcatctctgccaaggcacttcttagtgtgagaagctttttgttttttaatagttacattctgacttggttataaactccttgagcacaggaaccaggaccttctctgatttacttatttatttatttatttatttatttatttatttttgagacagagttttgttgcccaggctggagtgcaatggcgccatcttggctcactgcaacctccgcctccttgggtcaagtgattctcccgcctcagcctccctagtagctgggattacaggcgcccaccactatgaccagctaat

SEQ ID NO: 175346 - DNA, 601 bp, Human
gagaagctttttgttttttaatagttacattctgacttggttataaactccttgagcacaggaaccaggaccttctctgatttacttatttatttatttatttatttatttatttatttttgagacagagttttgttgcccaggctggagtgcaatggcgccatcttggctcactgcaacctccgcctccttgggtcaagtgattctcccgcctcagcctccctagtagctgggattacaggcgcccaccactatgaccagctaatttttttttttttttggtgtttttagtagagacagrgtttcactatgttggccaggctggtcttgaactcctgacctcaggcgatccacccgccttggcctcccaaagtgctgggattacaggcgtgagctactgcacccagccctgatttatttttatcatgggtctggtagttggcattctctaagtgtttgccaaacagcactggtaacaaatacaatggaggtggctcaaggcacaagagcaatttgtaaaagtcaatattatagacttttcaaaatggtatcattttggttttatctttaatcacagttggtcctagtcaggaccttctgt

SEQ ID NO: 175347 - DNA, 601 bp, Human
agagacagggtttcactatgttggccaggctggtcttgaactcctgacctcaggcgatccacccgccttggcctcccaaagtgctgggattacaggcgtgagctactgcacccagccctgatttatttttatcatgggtctggtagttggcattctctaagtgtttgccaaacagcactggtaacaaatacaatggaggtggctcaaggcacaagagcaatttgtaaaagtcaatattatagacttttcaaaatggtatcattttggttttatctttaatcacagttggtcctagtcaggwccttctgttgaaagaagtgagaggctgggcatggtggcttgtgcctgtaatcccagcactttgggaggccgaggcaagcggatcacctgaggtcgggagtttgagaccagcctgaccaacatggagaaacaccatctctactaaaaatacaaaattagccaggtgtggtggtgcatgcctgtaatcccagctactcaggaggctgaggcaggagaatcgcttgaacctaggaggcggaggttgcggtgagccaagattgcgccattgcactccagcctgggcaacaagaacgaaactcca

SEQ ID NO: 175348 - DNA, 601 bp, Human
gctgggcgcggtggctcatgcctgtaatcccagcactttgggaggccgaggcaggcgcatcacctgaggtcaggagttcaagaccagcctggccaacaaggtgaaactccatctctactaaaaatacaaaaattggccagtcatgatggtgcacacctgtggtccccgctactcaggaggctgaggcaggagaatcacttgaacccaggaagcagaggttgcagtgagccaagatcttgccactacactccagcctgagcaacagagtgagaccccgtctcaaaaaaaaaaaaaaaaaaaagcaaaacccttattttttaaacttttctcatgacaaagggatggctggaacaattattccccatttgcaggtaaggacactggcatagtgagtgacagacctgagccttaggctaagtcctctggctccagattatttctttcatggtgttatactagaaattcacagcccttgactggtatctgtccagtctgaagagcttttctttaaaacactattttcctcagctgtattggtttgattgaaattaaatccccttcattcattcacataccttaatcaaacatctacttcctgtca

SEQ ID NO: 175349 - DNA, 601 bp, Human
gaagagcttttctttaaaacactattttcctcagctgtattggtttgattgaaattaaatccccttcattcattcacataccttaatcaaacatctacttcctgtcaggaactgtgctgttggccctaggaggtatctcactggagtgggtaatagttcagtggataaccaaacctctgtgtgagtatgttatctttaatagggagaaatttgagaaaacttgaaactacttctggttgcagatccctcaatttttttttcatttgtgtaagagttttgggtaatacttaaaaaaaaaaaattgactctaagttatgtaacatttccagttctgaacagcatgttttgctgttataggatactgattttccacaactctagttggctatattgagttgtacagttctaattgctcctgggcatcagatctgtcaactcattcacacacacacagacacacacacacacacacacacacacacacacgtatgtatatatcaggtgctcctgaggcacctagccctgtgctgagtaaggaacctggaagctgggtctgcgcttgacaagacgcacaagaacagatcactgagttaccatttgt

SEQ ID NO: 175350 - DNA, 601 bp, Human
acggggtttcaccgtgttagccaggatggtctcgatctcctgacctcgtgatccgcctgcctcagcctcccaaactgctgagattgcaggcgtgagccaccgtgtccagcccatcctgtttttttcacttaacattatgtcatgtaattgaaattcctacgtaagcaaaatctctgtggaagcattatttttagtggctgtgtaatctattatgtggacgtaccagtttatttaaccaggtaatgggagctagttggggagaaaaagagacgttaaaatcatggagccctttggaaggttmggcagatctgggttaggtaccctatagggtatgtgagccaggcaggccagggctgaagggcactgagagtcaaaggcttttcttcttcccttagtcccagcccttgctgccttaccatgaattatgcacttgttccttgtactgtgtctacatcctccccagcattccctgtcttcaggtactatgtacacacttctgtcagttcccagtacactgggttgccttgttggttcacttgtctgtgtctccctttagactgaaaaaaaagttttatttctgtatcttgaatgcctggcaaat

SEQ ID NO: 175351 - DNA, 601 bp, Human
ttcctgcagggatattcaactctcgtgttctctttcttgctcaattcctgtgaggtgggccagaccaagtagaccaaaggccagctctgggaaggtaatatattgaagatactgggtcagtcaacttcagccgccaggctctgtgttcctacaggatcattaagtattgcaaatccgcgttagtcccagcaccacatgtgttgccctggacatctcaaagttaggactgttttttaaaactaggtgtgaacttatttcttaaaatgatcagctgtgttccagttggactaaatgctgattratctgaattcagcagatttgtcccttaccccccaagtttatctgacctctctgtagtccctgtggattgtagctggataggccctgaggtttctgtccttctaaaatactgtattttgttggtattgctttgtgctattgatagagctgtaccctcttctagagctgggtttccaaaactctgttaattagagaatcatctagggtagaaagtgagggctacattaaaagcatacagattcttaggcctgatctaggtccagatcctatttaaatctctgaagggatctgggaaccagat

SEQ ID NO: 175352 - DNA, 601 bp, Human
ggatcacctgaggtcaggagttcaagagcagcctggccaacatggcgaaaccctgtctctactaaaaagtacaaaaattagctgggcgtggtggtgggcacctataagcccagctactcaggaagctgaggcagggagaattgcttgaacccgggaggtggaggttgcagtgagccgagatcacaccactgcattccagcttgggtgacagactgagacttgtctcaaaaaaaaagaagaaaaaaaagtaatacagttgagtatgttcttccacattgttaaagactttttttttttttttaatacaatcagagtctcgctctaattgcccaggctggagtgcagtggtacattcatagctctctgcagcctcaaactcctgggcataagtaatcctcctaccttggcctcccaaagtactagggttacaggcatgagccaccatgcctggcctaaagccattttctaatacctatattcattattgtaacatatgtaaaatacttcacattttatgatttcctttttaaaaatgttcttgtgaaagtaatacttatttgttataaaacattgaaacagggtaagaatataataattcaat

SEQ ID NO: 175353 - DNA, 601 bp, Human
actgcattccagcttgggtgacagactgagacttgtctcaaaaaaaaagaagaaaaaaaagtaatacagttgagtatgttcttccacattgttaaagactttttttttttttttaatacaatcagagtctcgctctaattgcccaggctggagtgcagtggtacattcatagctctctgcagcctcaaactcctgggcataagtaatcctcctaccttggcctcccaaagtactagggttacaggcatgagccaccatgcctggcctaaagccattttctaatacctatattcattattgwaacatatgtaaaatacttcacattttatgatttcctttttaaaaatgttcttgtgaaagtaatacttatttgttataaaacattgaaacagggtaagaatataataattcaatgtctcctagcccttataatcccagaaataactgttgatggtttaatgtgtattttctaggcattttctctctctctctgtgtgtgtgtgtgtgtgtgtgtgtgtgtgtgtgtgtgtgtgtgtctgcctgtctgtctgtgtatggatccacacacatacatactcatatacatacttagtttttaccc

SEQ ID NO: 175354 - DNA, 601 bp, Human
gggttacaggcatgagccaccatgcctggcctaaagccattttctaatacctatattcattattgtaacatatgtaaaatacttcacattttatgatttcctttttaaaaatgttcttgtgaaagtaatacttatttgttataaaacattgaaacagggtaagaatataataattcaatgtctcctagcccttataatcccagaaataactgttgatggtttaatgtgtattttctaggcattttctctctctctctgtgtgtgtgtgtgtgtgtgtgtgtgtgtgtgtgtgtgtgtgtgtctgcctgtctgtctgtgtatggatccacacacatacatactcatatacatacttagtttttacccaaataagtttatatacatactcttctacaacttaatctttttaaaaaataccttttattggggctaggcatggtggctcactgggaggctgaggcaggagaattgcttgagcccaggagtttgagactaccctgggcaacatagaccttgtttctacaaaataatttaaaaattagctgagcatggtggtgtgcacctgtagtcctagctgcttgggaggctgaggcaggggatt

SEQ ID NO: 175355 - DNA, 601 bp, Human
ttgcgggactactcacaatagtaaagacttggaaccaagccagatgtccaacaatggtagactggattaagaaaatgtggcacatatacaccatggaatactatgcagccataaaaaatgatgagttcatgtcctttgtagggacgtggatgaagctggaaaccatcattctcagcaaactatcgcaaggacaaaaaaccaaacacctcatgttctcactcataggtgggaaatgaacaacgagaacacttggacacaggaaggggaacatcacacacctgggcctgttgtggggtggggrgagggggaagggatagcattaggaggtatacctaatgtaaatgacgagttaatgggtgcagcacaccaacatagcacatgtatacatatgtaacaaacctgcacgttgtgcacatgtaccctagaacttaaagtataataaaaatatatatatatttaaaaaaatgtgtctctagcagatcaggttttgtttaaaaaaaaaaacacaatatcattattatacccaacaaaattaacagtaattcctttttttttttttttttttgagacagggtttccactctgtcacccaggctggagt

SEQ ID NO: 175356 - DNA, 601 bp, Human
gaaaccatcattctcagcaaactatcgcaaggacaaaaaaccaaacacctcatgttctcactcataggtgggaaatgaacaacgagaacacttggacacaggaaggggaacatcacacacctgggcctgttgtggggtggggggagggggaagggatagcattaggaggtatacctaatgtaaatgacgagttaatgggtgcagcacaccaacatagcacatgtatacatatgtaacaaacctgcacgttgtgcacatgtaccctagaacttaaagtataataaaaatatatatatatttwaaaaaatgtgtctctagcagatcaggttttgtttaaaaaaaaaaacacaatatcattattatacccaacaaaattaacagtaattcctttttttttttttttttttgagacagggtttccactctgtcacccaggctggagtgcagcagcacaatcacggctcactgcagcctccacctcccaggcccaagtgatcctcccacctcagcctcctgactgtctggggctacaggtgtgtaccaccacacccagctaattttttatttttatttatttattttttttgagacagagtcacta

SEQ ID NO: 175357 - DNA, 601 bp, Human
cccagccaacaataattccttcatatcgagtaatacctaggctaaacagtttttgtcaatcatgtcacaagtgtctttgtacagttggtttgtttgaatcttgttccaataagacccacatactacaagtggttggaatatctcgtatctcaatctataaccccaatcctgtccatgctatttattttttgtagaactttattgtttgtcctgtagaaagtcccacattctggatttggctgatgacatcttcatggagtcgtttaatacttgcacctatcctccatattttctgtaaatrggtaatttattttatttattattattattattattattattattattatttttgagatggagtctctctcttgtcacccaggttggagtgcgatgacacaatctcagttcactgcaacctccgcctcccgggttcaagcgattctcatgcctcagcttctcaagtagctgggattacaggtgtgtgccaccatgcccagctaatttttgtgtttttagtagagacagggtttcaccatgttggccaggcttgtcttgaactcctgatctcaggtatccacctgcctcggcctcccaaagt

SEQ ID NO: 175358 - DNA, 601 bp, Human
gagtctctctcttgtcacccaggttggagtgcgatgacacaatctcagttcactgcaacctccgcctcccgggttcaagcgattctcatgcctcagcttctcaagtagctgggattacaggtgtgtgccaccatgcccagctaatttttgtgtttttagtagagacagggtttcaccatgttggccaggcttgtcttgaactcctgatctcaggtatccacctgcctcggcctcccaaagtgctgggattacaggcgtgagccaccatgcctggctggtaattcattttagatgcttgatyagtgtctgagttttaacgcaaacatgtttcattggtggtgctgtgtacttctgttgcatcacatcaggaggctgatgtgactgatctgactttatggttgtctttccaaaatctatatgcataatttttaatttttttttttttaattttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgttt

SEQ ID NO: 175359 - DNA, 601 bp, Human
cggctgggaggtggaggttgtagcgatccgagatcacgccactgcactccagcctgggcaacattgagcactgagtgagcgagactccgtctgcaatcctggcacctcgggaggccgaggctggcagaccactggcggtcaggagctggagaccagcccggccaacacggcaaaaccccgtctccaccaaaaaatatgaaaaccagtcaggtgtggcggcgcgcgcctgcaatcccaggcactcggcaggctgaggcaggagaatcaggcagggaggctgcagtgagccaagatggcggcwgtactgtccagcctcagctcggcatcagagggagaccgtgcaaaggggagacgaggaccgtgcaaaggggagagggagggggagggggagggagagcaatttttaattttttaagatttttttttttttttaaaaagaaacacacataggttgggtacttaggattgattgttgagctggaataatgaggaaagatagtaatgtggccctcaaaagtgggttttatcctaagatgaagagagcacatgtaatatgaagaagaggaaggtcagagagaaggtcttggagccgaggccagcg

SEQ ID NO: 175360 - DNA, 601 bp, Human
ctggcggtcaggagctggagaccagcccggccaacacggcaaaaccccgtctccaccaaaaaatatgaaaaccagtcaggtgtggcggcgcgcgcctgcaatcccaggcactcggcaggctgaggcaggagaatcaggcagggaggctgcagtgagccaagatggcggcagtactgtccagcctcagctcggcatcagagggagaccgtgcaaaggggagacgaggaccgtgcaaaggggagagggagggggagggggagggagagcaatttttaattttttaagatttttttttttttttaaaaagaaacacacataggttgggtacttaggattgattgttgagctggaataatgaggaaagatagtaatgtggccctcaaaagtgggttttatcctaagatgaagagagcacatgtaatatgaagaagaggaaggtcagagagaaggtcttggagccgaggccagcgcacgaaactggtgccgccagcatccagctacccttctgggacattatgtaaaatgatgtaactgagtgaaaaagtggtgagctggcctcctctctctgctcaagtcactgagctggtatcgtggtgaggga

SEQ ID NO: 175361 - DNA, 601 bp, Human
gccaccttcctgtttgaccttggacaaggtacttacacacattctgcctcattttacagggtcgtttgcaagcattaaatgactcaaaatatgtaaaaggcttagaagagcacatagcttgcagtaaatactatgtgttagctatgactataattgttactatattttatgtttatatatagatagatacactcatcaaaatgaagtgtcaaggtcggtgtctgttccagccttgacggttacaggagccctttctggctctgagaacctaggtgctaggtgaaggtcggattttggttttgtgtgtgtgtgtgtgtttttttttgtcttgagattttgagctgaaccttgaaaggtcgatcaaaaaatgctaggtaaaggcgaagggtgtgtgtgtcactccaaggcagggagtttctagggacaggcacatgcactgttggactcatctgagacccttgaggctactgtatacctctcacagcactctggatgagggtctgggagtgttaggaaaaataatggttacagtagtgttgagccagattatcaaacccagattcgactaaagggacatagaggtaatgaatatttttgagca

SEQ ID NO: 175362 - DNA, 601 bp, Human
ccaccttcctgtttgaccttggacaaggtacttacacacattctgcctcattttacagggtcgtttgcaagcattaaatgactcaaaatatgtaaaaggcttagaagagcacatagcttgcagtaaatactatgtgttagctatgactataattgttactatattttatgtttatatatagatagatacactcatcaaaatgaagtgtcaaggtcggtgtctgttccagccttgacggttacaggagccctttctggctctgagaacctaggtgctaggtgaaggtcggattttggttttktgtgtgtgtgtgtgtttttttttgtcttgagattttgagctgaaccttgaaaggtcgatcaaaaaatgctaggtaaaggcgaagggtgtgtgtgtcactccaaggcagggagtttctagggacaggcacatgcactgttggactcatctgagacccttgaggctactgtatacctctcacagcactctggatgagggtctgggagtgttaggaaaaataatggttacagtagtgttgagccagattatcaaacccagattcgactaaagggacatagaggtaatgaatatttttgagcag

SEQ ID NO: 175363 - DNA, 601 bp, Human
cgtgtgaagaaaaggccgtttaaacaatatttaagggattttaagttggcaacagcgtaaaacatcaatttattggtgaataaatagaatggagcagagatttttgttcttgaggctcttgccctaattaccatcttgtgtaaaagctgttgtgatccacattctcctagaaattcaggatacttcagggtatcgtaaaaccaggacttgaaatgattgacaaaattaagaattcaaagacaggatacccctgatttgattatgtgaatgtatcaaattatcacatataacataaaaaatrtgtacagctattatggctgggctcagtggctcacacctgtaatccaaacactttgagaggccatggtgggaggatcacttgagcccaggagtgcaagatgagtctgggcaacatagtgaggccccactatgtttaaaactagtcaggcatggtggcggtacctgtagtcctagctactcgggagactgaggtgggaggaaggcttgagcccaggaattcgaggctacagtgagctatgattgtatcactgcactccagtctaggcgacagagagagaccctgtctcttaaaaatatatat

SEQ ID NO: 175364 - DNA, 601 bp, Human
ggctgggcgcggtggctcacgcctgtaatcccagcactttgggaggccaaggtgggcggatcacaaggtcaggagatcgagaccatcctggctaacacggtgaaacccgtttctactaaaaaaaaaaaaaaaaaaaaaaattagccgggtgtggtggagtgcacctgtagtcccagctgctggggaggctgaggcaggagaatggcgtgaacccgggaggcagagcttgcagcgagctgagatcgcgccactgcactccagcctgggtgatggagcaagactctgtctcaaaaaaaaaatrtgtgtgtgtgtgtgtgtgtgtgtgtgtttgtgtttgtgtatgtatttattaaattttataattataaattttaagattataaattatgtattttatgtatatattaactatacatatatttaaatgtacagctgttgtatatctttttttttttttttttttttttttttgtggagacagccttgctctcttgcccaggctggagtacagtggtgcagtcttggctcacttgcaacctctgcctcctgggctcaagtggttctcctgtctcagcctcccaagtagctgggactgcaggaa

SEQ ID NO: 175365 - DNA, 601 bp, Human
cagtctggatggtgcatccctgagcaaatctgctagcttccctgtactttggtttcctcatctgtaagatggagatgatggtactgcctcataggttaatgtgaccgtccagtgacattaagaaatgaaaaggtattcagccacagcgtggcacacagtacagtcatgcagtacataatgacattttggtcaacaatggattacatatccaacagcggttccataagatgatgatggacctgaaaagttcctataatctagtgattttaaaatgttatagagcagtgcgttaccttttctrtgttaggtatgttggattttttgtttgtttgtttgttgtttttttgaggagtctcactctgttgcccaggctggagtgcagtggcgtgatcttggctcactgcaacctctgcctcccaggttcaaacgattctcctgcttcagcctcccgagaagctgggattacacatacgtgccaccacacctgactaatttttgtatttttagtagagacggggttttaccatgttggccaggctggtcttgaactcctgatctcaggtgatccaaccgcctcagccttccaaagtgctgggattac

SEQ ID NO: 175366 - DNA, 601 bp, Human
ctgggattacaggcatgagccaccacaccttggctctatgttaggtatgtttaaatacacaaatatttaccactctgttacagttacctatgatactcacatgctattcaggtttgtagcttaggagcaataggctatactatgtagcctaggtgtgtagtaagctatttcagctaggtttgtgtaagtacactctgtgatgctcacaatgatgaaattgcctaatgacacatttctcagaattatccctgtcgttcagtgatacatgactatcgttgcttaataaatgggaggaatggtsgtcgttataaagcctgactttcccctgagggtcatccattcacctccacttctcccctagagcctttaagggaacttgccagtggagatctgccatgatttggggttattctccactcagtttagaatgacattgcaagattaatgttggagtcagatgttatggccaggaagattgtgtatttggtttgtgaagctaaactgtggttcaggaattggaaaaggaactatcctttgagttcaaagtgtactcagctaaagatacttggtatgtgaggtacagaagccatgcctgcatttt

SEQ ID NO: 175367 - DNA, 601 bp, Human
ggattacaggcatgagccaccacaccttggctctatgttaggtatgtttaaatacacaaatatttaccactctgttacagttacctatgatactcacatgctattcaggtttgtagcttaggagcaataggctatactatgtagcctaggtgtgtagtaagctatttcagctaggtttgtgtaagtacactctgtgatgctcacaatgatgaaattgcctaatgacacatttctcagaattatccctgtcgttcagtgatacatgactatcgttgcttaataaatgggaggaatggtggtygttataaagcctgactttcccctgagggtcatccattcacctccacttctcccctagagcctttaagggaacttgccagtggagatctgccatgatttggggttattctccactcagtttagaatgacattgcaagattaatgttggagtcagatgttatggccaggaagattgtgtatttggtttgtgaagctaaactgtggttcaggaattggaaaaggaactatcctttgagttcaaagtgtactcagctaaagatacttggtatgtgaggtacagaagccatgcctgcattttcca

SEQ ID NO: 175368 - DNA, 601 bp, Human
tatgttaggtatgtttaaatacacaaatatttaccactctgttacagttacctatgatactcacatgctattcaggtttgtagcttaggagcaataggctatactatgtagcctaggtgtgtagtaagctatttcagctaggtttgtgtaagtacactctgtgatgctcacaatgatgaaattgcctaatgacacatttctcagaattatccctgtcgttcagtgatacatgactatcgttgcttaataaatgggaggaatggtggtcgttataaagcctgactttcccctgagggtcatycattcacctccacttctcccctagagcctttaagggaacttgccagtggagatctgccatgatttggggttattctccactcagtttagaatgacattgcaagattaatgttggagtcagatgttatggccaggaagattgtgtatttggtttgtgaagctaaactgtggttcaggaattggaaaaggaactatcctttgagttcaaagtgtactcagctaaagatacttggtatgtgaggtacagaagccatgcctgcattttccactgtcctggcctacatagtaggtacacagtaga

SEQ ID NO: 175369 - DNA, 601 bp, Human
tatttaccactctgttacagttacctatgatactcacatgctattcaggtttgtagcttaggagcaataggctatactatgtagcctaggtgtgtagtaagctatttcagctaggtttgtgtaagtacactctgtgatgctcacaatgatgaaattgcctaatgacacatttctcagaattatccctgtcgttcagtgatacatgactatcgttgcttaataaatgggaggaatggtggtcgttataaagcctgactttcccctgagggtcatccattcacctccacttctcccctagagyctttaagggaacttgccagtggagatctgccatgatttggggttattctccactcagtttagaatgacattgcaagattaatgttggagtcagatgttatggccaggaagattgtgtatttggtttgtgaagctaaactgtggttcaggaattggaaaaggaactatcctttgagttcaaagtgtactcagctaaagatacttggtatgtgaggtacagaagccatgcctgcattttccactgtcctggcctacatagtaggtacacagtagatatgtgttaactaaataaacgagagaa

SEQ ID NO: 175370 - DNA, 601 bp, Human
tgtgaagctaaactgtggttcaggaattggaaaaggaactatcctttgagttcaaagtgtactcagctaaagatacttggtatgtgaggtacagaagccatgcctgcattttccactgtcctggcctacatagtaggtacacagtagatatgtgttaactaaataaacgagagaaagaaattaaaaatgtgggccagacacggtggctcacacctttaatcccagcactttgggaggccaaggtgggcggatcacctgaggtcaggagtttgagaccagcctgactaacacggtgaaaccmcgtttctgctaaaaatacaaaaaattagctgggcgtggtggcacacacctataatcccagctactcaggaggctgagacaggagaatcgcttgaacctgggaggtggaggttgcagtgagctgagtgagctgcactccagcttgggcaacaagaacaaaacttcgtctcaaaaaaaaaaaaaaaaaaaagtggagttgaatacttttctttcaattctgtagatatcattttttttttgtatgtggtgttagattatagaaagggcaatgaactagaagtcaggagacttttttttttaa

SEQ ID NO: 175371 - DNA, 601 bp, Human
ggtatgtgaggtacagaagccatgcctgcattttccactgtcctggcctacatagtaggtacacagtagatatgtgttaactaaataaacgagagaaagaaattaaaaatgtgggccagacacggtggctcacacctttaatcccagcactttgggaggccaaggtgggcggatcacctgaggtcaggagtttgagaccagcctgactaacacggtgaaaccccgtttctgctaaaaatacaaaaaattagctgggcgtggtggcacacacctataatcccagctactcaggaggctgagrcaggagaatcgcttgaacctgggaggtggaggttgcagtgagctgagtgagctgcactccagcttgggcaacaagaacaaaacttcgtctcaaaaaaaaaaaaaaaaaaaagtggagttgaatacttttctttcaattctgtagatatcattttttttttgtatgtggtgttagattatagaaagggcaatgaactagaagtcaggagacttttttttttaatcctgatgcagttcattttatgtttctgagctttggtttcctcatttgaaaatggagagagattggacagcagctctc

SEQ ID NO: 175372 - DNA, 601 bp, Human
acagtagatatgtgttaactaaataaacgagagaaagaaattaaaaatgtgggccagacacggtggctcacacctttaatcccagcactttgggaggccaaggtgggcggatcacctgaggtcaggagtttgagaccagcctgactaacacggtgaaaccccgtttctgctaaaaatacaaaaaattagctgggcgtggtggcacacacctataatcccagctactcaggaggctgagacaggagaatcgcttgaacctgggaggtggaggttgcagtgagctgagtgagctgcactccarcttgggcaacaagaacaaaacttcgtctcaaaaaaaaaaaaaaaaaaaagtggagttgaatacttttctttcaattctgtagatatcattttttttttgtatgtggtgttagattatagaaagggcaatgaactagaagtcaggagacttttttttttaatcctgatgcagttcattttatgtttctgagctttggtttcctcatttgaaaatggagagagattggacagcagctctctaagctgaaggtaaccctttctgtcaagtagcatccccatcctttctattacttaaagatgc

SEQ ID NO: 175373 - DNA, 601 bp, Human
cacacatcccttgtgagcccgaggagactatgaacccactgaaattgagtgtaaaatagtgtgtagtacatgtgtatgtgaatgcccccatcaattttttgcacagggtgtccttagcttttattggattccttcagatgttgtaacctctcacagggtgatttgtagagaagctgggtctgtgtggtctgagccctggggatttcacatatactgagatctcaggggcagaggctggggtcttatctccattgcgttatttattttctgtgatttttaccccagtttttttttaatttcygataccagtaatccctacagaacctcaatgggcatgcagtgctccatagtttactcctgttttctcattctgctactaccactccacccatcaagtgtttctgctaatgaaaacatttttcttcctttccccttttctccttctccttgatgactggttgccctggggactctggcagttggccgtgtttacatcaggtaagatgcatttcattttactttgtctttcatcagctctggttgcacaagagagccctagtctcaggagactgctttcagaagctgcaatctgccctgcttg

SEQ ID NO: 175374 - DNA, 601 bp, Human
gagactgctttcagaagctgcaatctgccctgcttgtgggctcatttgcttacttacccccacagccttctttacatacctgtccactgacagacacttgatgaaatcgggatggtcctaattctgccacagagggcctttttggatctcagttactcatttataaattggattggattgatagtatgttagttaggtcctttttatttttgagattctgcttctattaaaacagtgcctcctatcatatcaacagtcccccagcccttaaaggttatgaaaatattaggaaggggaaaayttttttggtgtcaacaaagagcttttgtgaggagagaaaagtctattttcctagctttagcacctacttggtgagacagagctgggcctggcattcacaagtggctgtgaataatcacagcctgctgaaagtctccctggtcgtcagcagtagagtaccacactcgtaggtggcctgggaatgtgggggaggacagaagttccagactgctaaagcttcagaatctggatgggagaaagaaggtgggaacagggctgcacattctgtccccagcgggacctggtagtacatattgactat

SEQ ID NO: 175375 - DNA, 601 bp, Human
tcaaaaacaagcaaaaaacaaacaaaaacaaaccaaaaacattttttatcacttgtttttttaagaaaattaatttttttttttttttttgagacagtctcattctgtcgcccaggctagagtgcaatggtgagatctcggctcactggaacctccgcctcccgggttcaagcgattcttgtgcctcagcctcctgggtagctgggattacaggtgcacaccaccacacccggctagtttttttgtctttttagtagagacaacggagtttcaccatgttccccacgctggtcttgaactsctgacctcaggtgatccacccgcctcagcttcccaaagtgctgggattacaagcgtgagccaccgcgcctggcctaaacaaaaaattttaatgtaaccagtgaaagggcctgagaaacccaaaacgggattttttttatattgaaagaaataggtgaatgcaaaaaatcaatgaaagtacacaaaaagcattaagcaaatttagataatgagcaaaacctatcctttagcatgtggtaagtcaccagaaaatgatcagcttatctcctgattctgatgcctgggatacacagttgttggg

SEQ ID NO: 175376 - DNA, 601 bp, Human
tcattctgtcgcccaggctagagtgcaatggtgagatctcggctcactggaacctccgcctcccgggttcaagcgattcttgtgcctcagcctcctgggtagctgggattacaggtgcacaccaccacacccggctagtttttttgtctttttagtagagacaacggagtttcaccatgttccccacgctggtcttgaactgctgacctcaggtgatccacccgcctcagcttcccaaagtgctgggattacaagcgtgagccaccgcgcctggcctaaacaaaaaattttaatgtaaccmgtgaaagggcctgagaaacccaaaacgggattttttttatattgaaagaaataggtgaatgcaaaaaatcaatgaaagtacacaaaaagcattaagcaaatttagataatgagcaaaacctatcctttagcatgtggtaagtcaccagaaaatgatcagcttatctcctgattctgatgcctgggatacacagttgttgggaaaatgctataaaaatgagaaattggccgggcgcggtggctcatgcctgtgatcccagcactttggcagaccaagggaggaagatcacgaggtcaggag

SEQ ID NO: 175377 - DNA, 601 bp, Human
tttaatgtaaccagtgaaagggcctgagaaacccaaaacgggattttttttatattgaaagaaataggtgaatgcaaaaaatcaatgaaagtacacaaaaagcattaagcaaatttagataatgagcaaaacctatcctttagcatgtggtaagtcaccagaaaatgatcagcttatctcctgattctgatgcctgggatacacagttgttgggaaaatgctataaaaatgagaaattggccgggcgcggtggctcatgcctgtgatcccagcactttggcagaccaagggaggaagatcmcgaggtcaggagtttgagaccagcctggccaacatggtgaaaccctgtctctactaaaaatacaaaaattagctgggcgcagtggtgggcgcctgtaatcccagctacttggaaggctgagacaggagaattgcttgaacccaggaggcaggggttgcagtgagctgagatcatgccactacactccagcctgggtgacagagcaagactctgtctggggaaaaaaaaatgagaaatcacagaaagaagaatatgactgacaggaaaatacagttgctcctactgggaaggtggggattt

SEQ ID NO: 175378 - DNA, 601 bp, Human
taattgtgatgattttttttcttttttttgagacagagtcttgctctgttgcccaggctggaatgcagtggtgcaatctcggctcactgcaacctccgcctcccgggttcaagcgattctcctccctcagcctcccgagtagctggaactacaggcatgcgccaccatgtctggctaatttttgtatttttagtagagacggggtttcaccttgttggccaggcttctcttgaactcctgacctcaggtgatccacccacctccgcctcccaaagcgctgggattacaggcatgagcaccrcacccggccaattatgatgatatttaaaggcaattttgattttaccactggtaggtatttgctgaatggtaggagaaggaatgggagtcaggttccttgagatgttccctgctcatgctggtgtttcccagtttgaggcctctggcctgtgttgttctggtggctctggctgatcactctggtgggtcttgggccatccacatgcatttttctctcctgtttgcagtggttggagaccagacctaacagacaggtgtgtcctgtttgcaaagctggcatcagccgagacaaggtcatccc

SEQ ID NO: 175379 - DNA, 601 bp, Human
actgcaacctccgcctcccgggttcaagcgattctcctccctcagcctcccgagtagctggaactacaggcatgcgccaccatgtctggctaatttttgtatttttagtagagacggggtttcaccttgttggccaggcttctcttgaactcctgacctcaggtgatccacccacctccgcctcccaaagcgctgggattacaggcatgagcaccgcacccggccaattatgatgatatttaaaggcaattttgattttaccactggtaggtatttgctgaatggtaggagaaggaatggsagtcaggttccttgagatgttccctgctcatgctggtgtttcccagtttgaggcctctggcctgtgttgttctggtggctctggctgatcactctggtgggtcttgggccatccacatgcatttttctctcctgtttgcagtggttggagaccagacctaacagacaggtgtgtcctgtttgcaaagctggcatcagccgagacaaggtcatccccctctatggaaggggcagcactgggcaacaggaccccaggtgaggactcaggatgcctctcccaaccacttctccccttggatgt

SEQ ID NO: 175380 - DNA, 601 bp, Human
ataactaagccctcaattgagtattcatgggttgagtgatttgagggggtgagactcaaaaataatagcattgggtatttgcccaagaatagtaggagatagagctgaagttaataggggaaggtcagagaaaccatgaacctcagcccttactgctgacaacccaccctctgttccagtatggatttgggatttctgttatctgtaacaggcccagggaaggcatctggccatgattcctaaccgatctgagtcaggatctctgtaagaggagtaggctgtagtgcaatctggtgaatawctcataacgagttgattttctccctggttctctatacacgtgggaagaacagttgcaggtagaatgaagagttcgtatttggagaattaatctggcataagttcatgtcctggacaagaaagaggctatggccctgaccctgttggtaaagagctccaggtcctcacagggagcaactcaaagcaatttgtaatagacttattttacaccatttctgtttcagagagaagacccctcctcgtcctcaaggacagaggccagagccggagaatagaggggtgaggaacattctaggagaag

SEQ ID NO: 175381 - DNA, 601 bp, Human
aatccagaggtaaccactggaaacattttggttctattttcttttccatttttctataattatatatacacacaaattttacaaatctgtgcgtgtattttacagatgtgtgtatactttttacagtttttgttttttgttttttacaatatgtggctcctgttttgtaaccctctcttaaaatttcatttgttctacagatacttagtaccttctttgtgtgagtgggagtcttttagtattatcttgagattttacattgccagcaatattttactaactagctgtttagcatttagtygtgtggatttaacataattcaatcctttgttagacattagcggctttctttttccaagttaaaaaaaatcctgatgaacttacagataaatttgtgagcatgttcattattattttattaggataagacagggtctcactctgtagcccaggctggagtgcagtggtgtgatcacagttcactgtagcctcgacctcctgggctcagtctacctcagcctcccatgtagctgggaccacaggtgcacggcaccatgcccagctagttttttgagtttttttttgtctttcttttttttgt

SEQ ID NO: 175382 - DNA, 601 bp, Human
taaccctctcttaaaatttcatttgttctacagatacttagtaccttctttgtgtgagtgggagtcttttagtattatcttgagattttacattgccagcaatattttactaactagctgtttagcatttagtcgtgtggatttaacataattcaatcctttgttagacattagcggctttctttttccaagttaaaaaaaatcctgatgaacttacagataaatttgtgagcatgttcattattattttattaggataagacagggtctcactctgtagcccaggctggagtgcagtggygtgatcacagttcactgtagcctcgacctcctgggctcagtctacctcagcctcccatgtagctgggaccacaggtgcacggcaccatgcccagctagttttttgagtttttttttgtctttcttttttttgttttgttttgtttgggtagaaacaaggtctcactatgttgcccaggctggtctctaactcctgggctcaagcaatcctcccacctcagcctcccaaagtgttaggattacaggcgtgaaccactgtacctggcttaggataaattcttagaagtaagattactggcta

SEQ ID NO: 175383 - DNA, 601 bp, Human
aaaagaaaagaaaaagaaaagcatgtgttttcagatcaaattgacctagttttagatctaaactgtactccttggtcaagttatttcacctctccaagcctcagtttggtcatctgtgaaatgcagatgaagccaatgtaaaaattaaacatgatttatatgtcctagtgcttaacatggtgcctagcacagagctcacgctttaaaaaagggagttatttattcacagtattgttcctgctgaatcttttcatgtgaaagatgatgcagtgtagaacatgcacatggaaagaaaactgasggtgatataccaaactgctgatagtggttatttcagaggtaaagtggagtggctgcgaagtgggaaggtgaatagaagatctctgactctgtcaattatttctgtaatatgtgagtttcttatagcaagtatatattacttttataaccagaaaacattatagtgttttaaaatgtaaaaattctatgtaacagtattaaaagaaattttaatccgtaacttgtccatatacctacatattgtcatgtagttgtgaccacagtgttcaaacaattttgtctgataacttggtcacaagag

SEQ ID NO: 175384 - DNA, 601 bp, Human
tctgtctagcttccttcaggacacaacatgaggctggtcagaagcagcctcagccctgtgggaaccatgcctaggtctaccaactgctgctgcagttctccctcctactgcttgaaagtgccatccgcattcggtatagagcccttgctctataggtgcaagccacctctatgaggtgggtgccttgaactcttatcacagtctgacacccaagccaagatccttactgtggagcctgcagagatgccatgatcggttgagctctgcctgcacttgttggagcttcatgtgcactggacayagcatatggtacagaagtgaccattgtgtggttcacgccaagagcttatgccctaaagatggtaactgggtcatcccagttattctcatccccaccctggtccttggtacacagcaggtgatctataagtctttcttgactgcctgcctgcctgcctgtctgtcttcgtgaatccatcagagcatctagctgaggaatctcagcaccaagatatcttgggaatgccttttttttttttttttttttttgagatggagtctcgctctgtcccccaggctggagtgcagtggcacaatctcg

SEQ ID NO: 175385 - DNA, 601 bp, Human
gacagggtttcactgtgttagccaggatggtctcgatctcctgacctcgtgatccgcccgcctgggcctcccaatgtgctgggattacaggcgtgagccaccgcgcccggccctggggatgccctttcttactttatctgccttgaaggtttatcctctgttcacatttgtttttcagaggaagtataccccaaaagatagggtgtactctgccctgaagaaagggcaaattcctgtgaagccagcaagaacctgcctgatagcttgcatccttctaacctggtcgaaggctaaccttggmttccccagctaagcagagttccacagccaggctagactctggattactttatccccctgccacagtcacagttttcccttgtcatgcttggtacaatttgcccatcctggacacagattcttttatcctccttcccccaaagtcaggacagggagctctaaatggtagcttttcctaaagcagagaggagtggagacttaggttctcaccccagttctgcctctaccttgaaaaacaagtcattttgcctgtctggatcctagttctcttctggaaaaggaaggcaatccctgtggggcc

SEQ ID NO: 175386 - DNA, 601 bp, Human
aaaggaaggcaatccctgtggggcccttgagaggcagtgtgtggagaggctgcagagctctgccactaatttctgagcctttcaatcttgaacaggtcacctcaaacctatgtttcagctgcttcctactcaaaatggaaataataatatccaccaaataataacatgtacaaaacacttagcagatagaagatacttaacaaatagtaggcttgctttcattatttcctgcaagagtttcctgttaatcacctggtttatttgcatgtgcaggccaaaccttttatgataaattggaccrtgtcttgtccttattgttattgttccacatagtttcattttgcctgatattatttggggtttagaaattttttttggctgggcgcgatggctcatgcctgtaatgccaacgctttgggaggctgaggtgggcggatcatctgaggtcaggagtttgagaccagcctggctaacatggtgaaaccctgttcctactaaaaatacaaaaaaaaaattagccgggtgtggtggtgcgtgcctgtaatcccagctactcaggaggctgaggcagcagaatcgcttgaacctaggaggtggaggt

SEQ ID NO: 175387 - DNA, 601 bp, Human; identical to SEQ ID NO: 80287

SEQ ID NO: 175388 - DNA, 601 bp, Human
tttatccacaaactggataatcttcttaggctgcatactgccagtaccaaactttgttagcattaactcagtttggtaggtactgccagcctaggtcagtttacagtggggggcagtaatagggtttatttaactaactgtgtagtaaactttgtggcctaaaggcaaaggaaaggagtcggacctgactggcaaacaggttttacccatttaaagtaatattccaagagcaaatggactagtgtctattttgtttggcttttaaaatatttttgttaggaacatctgtgtctttttttttaaattttctgttaatttttttattgatatgttctaggaaagggtgtgacatttttcatctgttattcctatgaaaaggtattctgttgaaatgtttaatttccttggttagaggctatgaatgagggttatgcagcttcactttttggaaaccagggtgactagattactgaatttaactattgattagccacataatgatgaaaagggaatcttggcctgggtatcacacagtaatggataatctgcttcctggggctttgctttggtggctatggcagctgagttggagtggtagatg

SEQ ID NO: 175389 - DNA, 601 bp, Human
ctttaatgcttttacctttaaaaagaaaagaaagcatgttgagctgggcagtggcagagcatgtatatcacccctccacaccatgttttgagtagctcttggtttatgtcgacaacctaattagtttgttagtaagtactaccaccatctaagtgtggtcagaagaatgggaaattccccaggtttgcaggtgactggtgctgttaattttttctgtccccaacaacatgtatatatatttttaaatttaaccctgatccttagagcacccaacaactttttgttgttgttgttgttgttgttttgagatggagtttcactcttgttgcccaggctggagtgcaatggcacgatcttggctcactgtaacctttgcctcccaggttcaagtgattctcctgcctcagcctcgtgagtagctaggattacaggcatgtgccactacacctggctaattttgtatttttagtagagatggcggtttctccatgtgggtcaggctggtctcgaattcccagcctcaggtgatctgcccgcgtcggcctcccaaagtgctggaattacaggtgtgagccaccacgcctggccaacaacttttaaa

SEQ ID NO: 175390 - DNA, 601 bp, Human
gcacaccagcctgagtgacagagtgagaccctgtctcaaaagggactttaatcgcctgacttcatcacagtatatgctataactgggtaaaagtgtgtgtgtgtgagagagagggattttcagtcccctccttctcgtgtaagaaaagcaagtgttactttctttactctcagtgaaattgctgtcgttgaaatggattatttaagtcatcttgtggagtagctatatcagcttgagtttgtttccagattgaaatttggcaattttggggctgagtgcagtggctcctgcctgtaatccyggcaatttgggaggctgaggccagagacttgcttgagcctaggagttcaagaccagcctgggcaacatagcaagacccccccatctctattaaaaaaatttggcaattttatttgaaaatgttataagagttactcagtactgtttatcaaattgtccctttagtctactacacactctgtgttccatcccagctcatctatttccttttacttgcttggtggtaattgtgttttatgacaatgtgttaatctcaattgaggtagttgtcttcaccgcagttggaacagtagttgactac

SEQ ID NO: 175391 - DNA, 601 bp, Human
gggtcttgctctgtcatctaggatggagtgtagtgtcaccatcacagttcactgcagccttgacctactgggctcaagcggtcctcccagcgcagcctcccagtagctgtgactacaggcacatgtcaccactcctggctgatgtttttaagttttgtatagaaggtgtgtctttggctggtcttgaactcttgggatcaagcgatccttctgccttggtctcccaaagtgctgggattacagatgtgagccatcgtgcccagtatagtgagttttcttaaacttagttttcataccactsttctaagtcttgaggccttaaacttcaatcatctttaatttgctgctgcttggttgttgttgcctactcttccatgcacagacatacttaatcagtgattattatgcctttactatttaaggaactgtgagagttaacaaagtttgtgacctccaagtgtgcacaatcaatcaggtactcatatcacttcagtacaaggcaatcagtgataagtcggttttgcctatagagattgtagagaagttcagaggaggcaagggactactactgatccaggccatcagggtacagcatgttgaa

SEQ ID NO: 175392 - DNA, 601 bp, Human
aattaaaaaaaatcaggctgggtgcaggggctcatgcccataatatcaatactttgagaggctgaggcaggaggactgcttaaagccggaagttaaagactaggctgggcaatatagtgagaccccatcctatgaaaaaaaaataggaaataataaaataatttttacaaaaaacaaaatataaacacaaaaaaagtttttcttctagaaaaaataactaatttacatctcaataagataaaaacaatccaacttaaaaataggcaaaagagactggaccccgtggctcacacctataatyccagcactttgggaggctgaggcgggcggatcgtgaggtcaagagatcgagaccatcctggccaacatggtgagaccccgtctctactgaaaataaaaaattagccgggcatggtggcacatgcctgtagtcccagctactcgggaggttgaggcaggagaattgcttgaacccggcaggcgaaggttgcagtgtgccgacatagcgccactgcactcgaacgtggcaacagagtgagactctgtctcactaaaaaaaaaaaaaaaaacaacacaaaagatatatacagagacttcacag

SEQ ID NO: 175393 - DNA, 601 bp, Human
gcttaaagccggaagttaaagactaggctgggcaatatagtgagaccccatcctatgaaaaaaaaataggaaataataaaataatttttacaaaaaacaaaatataaacacaaaaaaagtttttcttctagaaaaaataactaatttacatctcaataagataaaaacaatccaacttaaaaataggcaaaagagactggaccccgtggctcacacctataattccagcactttgggaggctgaggcgggcggatcgtgaggtcaagagatcgagaccatcctggccaacatggtgagacmccgtctctactgaaaataaaaaattagccgggcatggtggcacatgcctgtagtcccagctactcgggaggttgaggcaggagaattgcttgaacccggcaggcgaaggttgcagtgtgccgacatagcgccactgcactcgaacgtggcaacagagtgagactctgtctcactaaaaaaaaaaaaaaaaacaacacaaaagatatatacagagacttcacagaaaaaaggtacaccagtggcaagtaagtacgaaaaaagatgctcaacatcagccattagggaaactgaaaactacaa

SEQ ID NO: 175394 - DNA, 601 bp, Human
gcacatgcctgtagtcccagctactcgggaggttgaggcaggagaattgcttgaacccggcaggcgaaggttgcagtgtgccgacatagcgccactgcactcgaacgtggcaacagagtgagactctgtctcactaaaaaaaaaaaaaaaaacaacacaaaagatatatacagagacttcacagaaaaaaggtacaccagtggcaagtaagtacgaaaaaagatgctcaacatcagccattagggaaactgaaaactacaatgagataccactatacactcactatgaggggtaacattaraaagactgaccataccgtttgttggtaaggatgtggaacaactagaactgtatcatacgtggatacatggctaggagaaatgtgaaatggtacaatcactttgagaaacagtgggcagtttctttaaatttgtaaatattggctgggtgcagtggctcaagcctgtaatcccagcactttggaaggctgaggtgggggatcacttgagatcaggagtttgagaccagcctggccaacatggcaaaacctggtctctactaaaaatacaaaaaattagccagatgtgatggtgtgtgcctg

SEQ ID NO: 175395 - DNA, 601 bp, Human
cacctataatcccagctactcaggaggctgaaacatgagactcacttgaatccaggaggcaaaggttgcagtgagccaagatcgcgccactacactccagcccgacggagcaagactctgtctcaaaaaaaaaaaaaaaaaaaaaattataagcaactgtaaatcaaactgatatgaatccttccccaagatcatttttaaagtatgtacagtgcaaagcagggctcttgagtgccagttacttaggtgtgttcattttataacaatttagcaagctgtacttgtgcccttccataaatayattatacatcaatttaaagtttgccaaaaatataggcgaaatgcttaaacttaaaaactttaaactatatgcatgtatatgtacctagactagggtaacaatggttccagggcagggaaggaggcagctaagaaaggacggccactgtataccctctgataacttttaaattgatctgatgtgtacctgtaatttatttcaaaaagtattttcttaactgagaccatttgcaactctctttaagtcaacattttcttttttttttctagtatcagaagattttatttttttacttttatt

SEQ ID NO: 175396 - DNA, 601 bp, Human
gtatttttagtagagatggggtttcactgtcttagtctcgaactcctgatgtcgtgatccacccccctcggcctcccaaagtccaaagtgctggaaatacaggcatgagccaccacacccgagctttttctttctttcttttttttttttttttttcttttttttaagacaggtcactgggtcactctgttacccaggctggggtacagtggcatgatctcggctcactgcagtctgccttctgggtttaagcgattcttatgcctcagcgtactgagtagctgggactagaggcatgcaycaccactcccagctaattttttattttttagtagagacgggatttcactatgttggctggtcttgaacttctggcctcaagtggtccgcccacctcagcttcccaatgtgttaggattacaggcgtgagccactgccctcagccttaataccaatattatcatcaatcaataagtggtagcttttctgtggtatatccagacaatggcatattattcagtactaaaaagaaatgtgctatcaattcatgaagagatgtgaagaaaactttaagttttcacttagtgaaagaagccaattt

SEQ ID NO: 175397 - DNA, 601 bp, Human
caggagttcattacaagtctgggcaacatagggagaccccgtctctgccaaaaaaaaaaaattagctgggcatggtggtgcgcacctgtaatcccagccactcaggagactgaggtgggaggatcgcttaagtccaggagttccaggctgcaatgagccatgatttcaccactgtactccagcctgagaaacagagggagaccctgcctcaaaataaataaattaaattgggggaaaaaaaaagaaacataattgaaaaaaataatagaggattttctttttctgttttttttttttttttgagacagagtttcgctcttgttgcctgcccaggctgcagtgcaatggcatgatctcggctcactgcaacctccacctcccgggttttcaagagattctcctgcctcagcctcccgagtagctgggattacaggcatgcaccactaagcctggctacttttgtatttttagtagagatggggtttcaccatgttggtcaggctcgtctcgaactcctgacctcaggtgatctacctgcctcggcctcccaaaatgctgggattacaggggtgagccaccatgcctggccaatagaggattt

SEQ ID NO: 175398 - DNA, 601 bp, Human
aaaaagaaaaagccaggcacggtgggtcacgcctgtaatctcagcactttgggaggccgaggcgggtggatcacttgaggtcagaagatcaagaccaccctggctaacatggtgaaatgctgtctctactaaaaatatgaaaagccaggcgtggtggcgtgtgcctgtagtcccagttactcaggaggctgaggccggagaattgcttgaacctgggaggccgagactacagtgagtcaagactgcaccattgtactccagcctgggtgacagagcgagactccatctcaaaaaaaaaaaatgatatttttagttttggtgttctggtaatttacctacattagatggtacctgagatgggcccaacaactagactagaaagcagtggagaaacaagggagaagatggagaaaaaacagtatgtctgaaaccaagggaaattagtctgaaagactgataaaaagacggtgattaagaactgaatatcaggttaagaaatttggagccaggcatggtggcacacacctgtaattctagcactttgtgaggcccacttgggaggattgcctgagaccaggagttcaagaccagcttgggcaat

SEQ ID NO: 175399 - DNA, 601 bp, Human
tttacctacattagatggtacctgagatgggcccaacaactagactagaaagcagtggagaaacaagggagaagatggagaaaaaacagtatgtctgaaaccaagggaaattagtctgaaagactgataaaaagacggtgattaagaactgaatatcaggttaagaaatttggagccaggcatggtggcacacacctgtaattctagcactttgtgaggcccacttgggaggattgcctgagaccaggagttcaagaccagcttgggcaatgtggcaaaactcttgtctccacagaaaatytttttttttgagagagtctcgctgtgttgctcaagctggagtgcaatggcacaatctcgctcactgcaacctctgcctcccaggttcaagagattctcctgcctcagcctcccaagtagctgggactatatagatgcccaccaccacgcctggctaatatttgtatttttagtagaaccggggtttcaccatgttggtcaggctggtctcgaactcctgaccttgtgatccgccggcttcagcctcccaatgtgctgggattacaggtgtgagcaactgtgcctggccaaaaaaaaaaaa

SEQ ID NO: 175400 - DNA, 601 bp, Human
cagtgctttcgggctacacccttgtttacagtgacaacaaggtggtattggagtgttacagggtcacagagaagaccttcaattatcaattagaggttttaaatttaaatttaccctggcttttaaaggaacagggtacactgttttctctttactgcttctctctctgactctgtctctctctttctctctttgactccctctttgtctctctgcctctctctctttcctctgctggtctttccctgcctctgccagccacttatgccgctgttctcccctctccttgcccttcccctargggaggaaccggcaggagtggagctactctttcttcccctgagaagaaaggaaaggggagttctgaatattttccttactaccggaggtttgtgtgaggttcaaccccctgaaatttgcggaaggctcaacccctcaaaccagtggtgtcttgtcttggctttcctggaagactcaacctctcaaaccagggatgtcttgccttgcctgccctggaaggctcaaaccctcaaattagggatgtcttgtcttgccttgcctgccctggaaggctcaaaccctcaaactagggagtgtcttg

SEQ ID NO: 175401 - DNA, 601 bp, Human
tagcccgtgaaaaagctgaccctcccaccctggccttttaatatgcaaatgcaggggcgctatgatgttctacacacgtggggatatgtgggggaggccatgttgccaggaacttgtggggaaagggcaagaaggctgaggcaatctccatgtttgggtggacccattttctaatggcctgcatttgcatatcaaaggttgttggcctggctctaagagctgaggctttacgagaaacttttccagagatgctttaaaaaaaaaaaaaacgagcccggcgcggtggctcacccctgtaatsccagcactttgggaggccgaggtgggcggatcacgaggtcaggagatcgagaccatcctggctaacacagtgaaaccccgtctctactaaaaatacaaaaagccaggcgtggtggcctacacctgtagtcccagctactccggaggctgaggcaggagaatggcataaacccgggaggcggagcttgcagtgagccgagatcgcgccactgcactccaggctgggcgatagagcgagcctccgtctcaaaacaaaacaaaaaaccacgaaaacttcccaaggaccccttttcctataaca

SEQ ID NO: 175402 - DNA, 601 bp, Human
gtctacggaagacattttactcctgttaaaagcagaaacttcctgttcccagaagaggcctacagcctgatttctactaggtggcttaggaataccatgtgtttgccagaatgtagagagagagagacatttattgaattactgcctgccgtgattcacaatcttttctaacatacctgtttccctgaactgtaaagactcctgcatgttagacacacggagagagggtaagagaccgaggatagaaagagaaagaaagtttggcgacagggtagctggaagagagccttgaaattaaagracagatttaaagttgaaatccattccatacccaccactctgatggttgaatttcctttcctggcccatgcaccaaaatgatacggctctaatgagtgggggaacaccagggttcttggtcctcatgccagtttagataaaatgacttgggcacacgtggagtggttttaaggagcagaaggtttaatagataagaagtgaagggacaagtgaagggagaagacagaaagaggaagctccctggtacagagacagagggagggggctccaaagccaaaagaggaggtccccccagtataca

SEQ ID NO: 175403 - DNA, 601 bp, Human
tattataactttgctaaattaattttagtagcttttatgtagtttgcttaggattgtatatataggtgatcatgtctgtgaataaagacagtttaattccttcccttccagtcagcataccttttttttcttgctctattgttatggcgagtacttctagtacattgttgagtagacatctttgttttgttctcagtgttcggggtgaatattaagatgttatgggtctgctgatctgctttgtattagtatagtattgtttctagaatttcatataaatcccatgtaatcataaagtatrttgtgtcagcttcttttttttctttacgtatattttgttgctgttgttgtgtcatacttcttttgcttagtctaattccctgagattcattcatgttgttgcatatatgagttcttattttgtttctgagtatgtatatagtatatagacaatacatatgggcagtttgtttatttaccagttgagcaacatttcttagctattatgaatagagccgctgtgaacatttgaatacaaaccttagcgtgggcagaaggtttcattttcttggacaaatatctaggaggtggaattgctgga

SEQ ID NO: 175404 - DNA, 601 bp, Human
ggtatcccattgtgattttaatttgaaatgtcattcagcttctttggtgaagtgtctgttcaaatcttttgcctccttttcctttcctttttcttttctcctcccccttctgttttgaaaatcaggttgcttttctgttactgaattcttagaaaaaactgagttcttaggaaaaaaactcatttttttaaatgttctcgatatccatcttttattagatatggtttgcagatattttctcccaggctttgttggtacaattctaattgatcagctgagtctctgtagtaatgctccattgcttggtcatatgtatattttgaggaataacaagtgttttaaagctcaaaataacagttatgctaacatatactataagctgcattctttaatccatatatagggaaagaaaaacctagattgttaatccggaacatttacattcttaaacatagtaaattgtctactgtacttaactatgttaaatacttttaaatggcctagagcttcatctttttatctaataaaaatgaataaataattccttgtctgtttcattatttattattactaactaaaatgaaaaactatgaatatattg

SEQ ID NO: 175405 - DNA, 601 bp, Human
ttcctttcctttttcttttctcctcccccttctgttttgaaaatcaggttgcttttctgttactgaattcttagaaaaaactgagttcttaggaaaaaaactcatttttttaaatgttctcgatatccatcttttattagatatggtttgcagatattttctcccaggctttgttggtacaattctaattgatcagctgagtctctgtagtaatgctccatttcttggtcatatgtatattttgaggaataacaagtgttttaaagctcaaaataacagttatgctaacatatactataarctgcattctttaatccatatatagggaaagaaaaacctagattgttaatccggaacatttacattcttaaacatagtaaattgtctactgtacttaactatgttaaatacttttaaatggcctagagcttcatctttttatctaataaaaatgaataaataattccttgtctgtttcattatttattattactaactaaaatgaaaaactatgaatatattggtctggtataaacctaatgaaaagttgccaaaataaaaaaacacttaatcttgcctataagcttttgccattgttccc

SEQ ID NO: 175406 - DNA, 601 bp, Human
taataaaaatgaataaataattccttgtctgtttcattatttattattactaactaaaatgaaaaactatgaatatattggtctggtataaacctaatgaaaagttgccaaaataaaaaaacacttaatcttgcctataagcttttgccattgttccctctctaaccctcactgaaaaacccaatctttatggcttacctctattagtatacaatatattacttttgcatcaagtatatacacatactgtcttgtctttttgttctttctatgcgtaactgttctactgacttgaattagkttttgaatgcttgctgtgtaagctgatgagaaaaaaaaatcagctttacaatgtgatatttgtcacatttagcaattatattaaattattgtaacactatattacctaagtatctacctggacacttttttttctttttctttttgaaacggagtttcgcttttgttgcccaggctgaagtgcaatggtgtgatcttagctcactgcaacctccgcttcctgggttcaagcaattcttgtgcctcagcctcccaagtagctggaattacagccaccacgtccagctaattttgtattttt

SEQ ID NO: 175407 - DNA, 601 bp, Human
taataacatgcaggcacgcttatactgctggattcattgcaactgcagttgcactctgagtggaatttgaagctactcttatcagtgataaaatggcatgtagcttttaatgagcagtgcatatattttcacatctaaggtattgtatgtttgtttcatctctgcctgaatagtgtggccataaacactgaaattgtaaaattatttttaaaacttctgattccaaaattcctgattgtttcaaatggttttgattgttttatttcagtagattatgtatctgagaagatatataatcatscttttagttacagtgctgcatacataaaattttacagggttttatacatacagaagaatgatgagaaaattaaagttttaaaaggatttgtatagaggagaaaattgagacaaagttttaaaaagatttgcatagctcagtattttggtttgattcaataaatttttaatgatttaactttttttttttttttttttgagacagagtcttactctgtcacccaggctgtagggccgtggcacgatcttggctcattgcaacctccgcctcctgggttcaagcatttcttctgcctcagcc

SEQ ID NO: 175408 - DNA, 601 bp, Human
tttcacatctaaggtattgtatgtttgtttcatctctgcctgaatagtgtggccataaacactgaaattgtaaaattatttttaaaacttctgattccaaaattcctgattgtttcaaatggttttgattgttttatttcagtagattatgtatctgagaagatatataatcatgcttttagttacagtgctgcatacataaaattttacagggttttatacatacagaagaatgatgagaaaattaaagttttaaaaggatttgtatagaggagaaaattgagacaaagttttaaaaagatttgcatagctcagtattttggtttgattcaataaatttttaatgatttaactttttttttttttttttttgagacagagtcttactctgtcacccaggctgtagggccgtggcacgatcttggctcattgcaacctccgcctcctgggttcaagcatttcttctgcctcagcctcccaagtagctgggattacaggctcccgccaccatgcctggcgaatttttgtatttttttagtagagacaaggtttcaccatgttggtcaggctggtctcaaactcttgccctcaagtgatccac

SEQ ID NO: 175409 - DNA, 601 bp, Human
aaaattatttttaaaacttctgattccaaaattcctgattgtttcaaatggttttgattgttttatttcagtagattatgtatctgagaagatatataatcatgcttttagttacagtgctgcatacataaaattttacagggttttatacatacagaagaatgatgagaaaattaaagttttaaaaggatttgtatagaggagaaaattgagacaaagttttaaaaagatttgcatagctcagtattttggtttgattcaataaatttttaatgatttaactttttttttttttttttttgagacagagtcttactctgtcacccaggctgtagggccgtggcacgatcttggctcattgcaacctccgcctcctgggttcaagcatttcttctgcctcagcctcccaagtagctgggattacaggctcccgccaccatgcctggcgaatttttgtatttttttagtagagacaaggtttcaccatgttggtcaggctggtctcaaactcttgccctcaagtgatccacctgccttggtctctcaaagtgctgggattacaggcgtgggccactgcgcctggccaacaattttaactatt

SEQ ID NO: 175410 - DNA, 601 bp, Human
gtggctcacacctgtaatcccagtactttgggagactgagggcaggcagatcacttgaggtaaggagttcaagatcagcctggccaacgtggtgaagccctgtctctactaaaaatacaaaaattaaccgggtttggtggtggtcacttgtaatcccagctactcgggaggctgaggcagaagaatcgcttgaactcaggaggcagaggctgcatgcagtgagccgagattgtgccactgtactccagcctgggcgacggagcgagactatctcaaacaaacaaacaaacaaacaaacaacaaagaaattggggaattcaagatatataaatgaacctttaaactgcacttttgcagagaggaatttaagggttcaaagtgatgaaacagatgtattacagatatctttctgtgtttttacacttgcacatcactgacattttggaagtaaagccatattaatgcagaagtatatctcttctggactgttgggctagatttgagcaagaataatgttgtgacataacagtgttctccatcccttccctgtgatctgctcctcccttgtacagtctcatccttcctcttgacctttcctgta

SEQ ID NO: 175411 - DNA, 601 bp, Human
agtctgggcaacgtggcgaaaccccatctctaccaaaaatccaaaaaattgtctgggtgtggtggcgtgcacctgtagtcccagctgttgggtggctgaggtgggaggatcggttgagcctgggaaatggaagttgcagtgagtagagatcatgccattgcactatagcgtgggtgacagagtgagactccatctctctcttttttttttcttaatttataaaaaaaggtgtttggatagttattttccttatatccagtgtaagaatcattacaaggtctggctgtgttgcccaggcttttttttttttttttctttttaaataattagcgttattattattcttagtttttgagtcagggtcttgctttcttgccagacttgagtgcagtagtgcagtggcacaatcatggctcactgcagcctcaaactcctgggctcaaggaattttcccacctcagcctcctaagtagctaggctcacttcttccgtgcctcgctgcccaaacccctagggggagcatgcagacggacaggtcgtgaggagtgtttttgggctttgactccatagcagcatctagggttgagtgtttccagctcct

SEQ ID NO: 175412 - DNA, 601 bp, Human
tttgactccatagcagcatctagggttgagtgtttccagctcctgaagccccagtggccgtgtgttacagtgtgctctttcagttttgtggtctacaggtggcttgtgccaatcagctgagttacactctctgccttatcgcaaggatagagggctctctgtatcccaggttcttgccctagtgtgctggaaagatcggatcacacacggacttggagaatgagtgcaaggtttttttgctttttttttttgagaccgagtctcactctgttgccaggctggggtgcagtggcgcaatctyggctcactgcagcctcctcctcccaggttcaagtgactctcctgcctcagcctcccgagtagctgggattacaggcatgcaccaccacatctggctaatttttgtatttttaatagagatgaggtttcaccatgttggccaagatggtcttgatctcctgaccttgtgatccgcccatctcagcctcccaaagtgctgggattacaggtatgagccactgcgcccggccgagtgcaaggttttattgaatggtggaagtagctctcagcagatggatggggagccataagagggatggag

SEQ ID NO: 175413 - DNA, 601 bp, Human
gcagcatctagggttgagtgtttccagctcctgaagccccagtggccgtgtgttacagtgtgctctttcagttttgtggtctacaggtggcttgtgccaatcagctgagttacactctctgccttatcgcaaggatagagggctctctgtatcccaggttcttgccctagtgtgctggaaagatcggatcacacacggacttggagaatgagtgcaaggtttttttgctttttttttttgagaccgagtctcactctgttgccaggctggggtgcagtggcgcaatctcggctcactgcarcctcctcctcccaggttcaagtgactctcctgcctcagcctcccgagtagctgggattacaggcatgcaccaccacatctggctaatttttgtatttttaatagagatgaggtttcaccatgttggccaagatggtcttgatctcctgaccttgtgatccgcccatctcagcctcccaaagtgctgggattacaggtatgagccactgcgcccggccgagtgcaaggttttattgaatggtggaagtagctctcagcagatggatggggagccataagagggatggagagggaaggtgat

SEQ ID NO: 175414 - DNA, 601 bp, Human
ctgtaactgcaattggaagagctttggaaaaatgatttgtggacacataagatactttttaaaaacataattttctctgcctccttaaagaagtttgtgtttcttaaataaccagcattattactattcttttttttttttcttgagacacctgtcacccaggctagagtgcagtggtgtgacctcagctcactgcaacctctgcctcccgggttcaagtaattctcctgcctcagcctcctgagtagctgggattacaagattacaggcgtgtgccaccatgccagtctaatttttgtawttttagtagagacagggtttccccatgttggccaggctggtctcgaactcctgacctcatgatcctcccaccttggcctcccaaagtgttgggatttcaggcgtaagccactgtgcccagccactattcttctctttcagatgaatctaaaagatgtttagttttcagaaactggagaagatgttatattctcacttttccctgttaagtttcagcatctgttctggctgttttactttttctcaaaccttttatttagaacaaaaacttggatgaattgatttcaagacttcactttgc

SEQ ID NO: 175415 - DNA, 601 bp, Human
caaggcagtgaaggattaattgccaaataaattgtacaaataattgcttttggagttcagaggaagaaatgattgtttggggctggggtaatctagggaaggatgtaaatgaattcctgggagatattttcagttagtgagattatttactttacctttaaaatcatattaatgtttgttacaaatggaactgcaaactgtttgaacatgaactattgtatcttaatttttttaaatctccatatgagagtgcaggagctactaccccagagaaaagtagatcatgctttctacatgtatytgcttctattgtatcaagtagatggagaaagtactcagttttagaagaaaaatctttgggtgaaaaaaaagaggaactccctgtccctaaattccttcaatgtcactcttgccacgttttcaatcagttgtactttgtgagtcattgccgaggtcactttttgtgacttgtagcattcatgattaacttctaaagggtggaaacaagcattaatcccctttacatcactaatgttctctctgtcccccctccccctcctttccccactctcccctcccccctcccctcccctcccctccc

SEQ ID NO: 175416 - DNA, 601 bp, Human
gtttttatgcgacctaagtttctgttaatataggttttctcttcatctcttttttccttccaatttatcaaattattttttgccctgtagagtttttttgttttttttttttttttttttttttttttgttgttgttgttgttggagggacagagacttattctgtcacccaggctggagtgcaatgctgtgatcatagcttattgtagtctcaaactcgttggctcaagcgatcctcccacctcagcctcccaagtagctgggattaaaggtgcacaccaccatgccagctacattaaawtttttttttttttttggtggaaaaggggctcttgctatgttactcaggctggtctggaactcctggcctcaagtgattgtcctgtcttggcctcctaaagtgctgggattacaggcacaagtaaccgtgcccggcttcctgtagagtttcttattgtctggattttgcaaagtatgtctttgtggtggtttttcagtgtgtcctctgtcctctctctctctatttttaaaatggtagttagctttcaagtcttgatcagtttctggttcagttattttttacaagcatattcattatctg

SEQ ID NO: 175417 - DNA, 601 bp, Human
tgtcacttttcttttggtcacatagaccaactttgatacagtatgggaggggactgcttaagttcatgaatacctagagatgggtgtcactggggatgtcatcttggtgctggctactacagtgagactacttcccagggagtgtggtttatcagaagacacatgacgtctgtttttctttgagttgttaatattagcagatactataaagaaaaactttttctttctttcttcttcttcttttttttttttcctttggagagagtcttgctctgttgcccaggctggagtgcaatggtgkgatctcggctcaccgcaacctccacctcctgggttcaagtgattctcctgcctcagcctcccgagtagctgggactactggtgcgcaccaccacgcctggctcagttttgtgcttttagtgtagacggggtttcaccatgttggccaggctggtctcgaattcctgacctcaggtgatccacctgccttgtcctcccagggagctgggattacaggcgtgagccactgtgcccagccaagaaaagctttttctaatcaagtatttggtcacctggtgtgggtacagtttacataggaaag

SEQ ID NO: 175418 - DNA, 601 bp, Human
gtgtcactggggatgtcatcttggtgctggctactacagtgagactacttcccagggagtgtggtttatcagaagacacatgacgtctgtttttctttgagttgttaatattagcagatactataaagaaaaactttttctttctttcttcttcttcttttttttttttcctttggagagagtcttgctctgttgcccaggctggagtgcaatggtgtgatctcggctcaccgcaacctccacctcctgggttcaagtgattctcctgcctcagcctcccgagtagctgggactactggtrcgcaccaccacgcctggctcagttttgtgcttttagtgtagacggggtttcaccatgttggccaggctggtctcgaattcctgacctcaggtgatccacctgccttgtcctcccagggagctgggattacaggcgtgagccactgtgcccagccaagaaaagctttttctaatcaagtatttggtcacctggtgtgggtacagtttacataggaaagatgtgatatatgttagactctatttactagtatttaaaataacaagttggtttactagtattctcctgtggtaaaaaacattt

SEQ ID NO: 175419 - DNA, 601 bp, Human
aaaatccttatgtaatagacttagtgcccccccaattttttggttattttctgttggtttcttactttgaatactattgaaattacctagtaacttctttttcttcccaagcatttgatttaaagtaatatctttttctttcagttgatatcaggtaatcagccagttttttttccagtttttatctcttcatacttcagtttatggatagttgtgctctagctacaatgttggaacatatagtcattatgtagtataaagtgtcacttagaaccctcattcaggtttttacagataaatrtatatttaatgcccactaccatttttatgttgatatggactttccagttatttgggtcatctggaattcattttctctaataaattcctcaggaagagcttatgggaacagtattccttgtgttcccctatgtttgagaagtttgtctgcagctttaatagttaaaagctggcttggtgatgataaaattctgttccacagtatctgaaatatgtcattccactgtcttctggcacagagcatagctgttacagtatgatgatgtcgacctgtttttctttgagcaatgtagcttttttt

SEQ ID NO: 175420 - DNA, 601 bp, Human
aatgcccactaccatttttatgttgatatggactttccagttatttgggtcatctggaattcattttctctaataaattcctcaggaagagcttatgggaacagtattccttgtgttcccctatgtttgagaagtttgtctgcagctttaatagttaaaagctggcttggtgatgataaaattctgttccacagtatctgaaatatgtcattccactgtcttctggcacagagcatagctgttacagtatgatgatgtcgacctgtttttctttgagcaatgtagctttttttttttttttgtaattgtttagatatccataggattttttttttttttttttgagaaagagtctcactttgttgcccaggctagagtgcagtgacaggatctcggctcactgcaacctctgtcttccgggttcaagggattctcctgcctcagcctccctagtagctggaactacaggcatgtactaccacgcccagctaatttttgtatttttagtagagatagggttttgccatgttgtctaggctgatctcgaattcctgacctcaggtgatccacctgctttggcctcccaaagtgctgggattac

SEQ ID NO: 175421 - DNA, 601 bp, Human
tccagtaccgttcttcatccagtgcaggcacattcttgcctttgggtatgccctttcttggaatgtttctgtcatatgtctgattaagttcctcatctctttaaagtctcaattcttacactcttaatgaggcccacccttaccaccctatttaataccggaacctctgaccttatagcactaatgctctaatatattaatactttacttatttattgtgtttaattataaagcatatgctccacaagaacaagaatcctagtccccattgctcactgacatatctcaaacacttaggtargtgtctggcatatggtagatgttcatcattcatttgtcgagtgaataaacacactctgtatttccttgaaagggtgacgtcctaaagcccttctcttaccccatctgtggcgttaagatgtttttctgggtcacagcatatcgtttctctttaaaccctgtggtgggagtactttaggaaagttcctagtttttgttgattttattttatttttatattattattattattattattattttagacggagtctcgctctgccacccaggctagagtgcagtggtgcgatctcggcttact

SEQ ID NO: 175422 - DNA, 601 bp, Human
cattttttaaattttttgtagagatgggggtctcaccacgttgcctagggtggtctcgagctcttgggctcaagtgatcctcccacctcagcctccaaaagtgttagattacagtcctgagccatcatggacttaactatccttaattttgtatcacctatggagaacatgtattaactttgtaataaaaaagtttttaggcctggtgcagcagctcttgcctgtaatgccagcacattgggaggctgaggtgagaggatcacttaagcccaggagtttgaggccagcctgggcaacatgrcaagaccccagattgacaaaaaattaaaaaaaaaaattagctgggcatgatgtggttaaaaaaaaatttatctgggcacaggatgacaggtacctgcggtcccagctacccggaaggctgagacatggcaatcacttgagaccaggaggttgaggctacagcaaactatgatctgtctgctgcactccatcctgggcaacagagcgaagactctgtctcaaaaaaaaaaaaaaaaaaaaagtcttctgtattttgtataaattggtggtggttggatctagaggcttgagcacagatgat

SEQ ID NO: 175423 - DNA, 601 bp, Human
caaacctttgttctcttaaattcttcttctttcttctcttttttggagacagagtcttcctctgtcaccaggctggagtgtagtggcacaatcaaggcttattgcagcctctacctcccaggctcaagaaatcctcccaccttagcttcttaaatagctgggactacaggcgcacgccaccaccatgcctggctaatttttgtaattttttgtagagacatgatttcaccatgttgcttaggctggtctcaaactcctgagctcaagcagtctgcctacctgggcctcccagagtgctggrattacaggcgtgagccactgtgctggctgttcttttaactttttaagttggcctgagaaagcttgcagagccttattctccagatgtctctttttacaattattcttctaactgccaaaagaagtaagaagtctcccgttttactgtgttgtatttcaatttttttttttttttaaaagggtttgaagtccaggcgcggtggctcacacctgtaatcccggcactttgggaggccgaggtgggcagatgacctgaggttgggagtttgagaccaacctgaccaacatggagaaaccccat

SEQ ID NO: 175424 - DNA, 601 bp, Human
ccaggcgcggtggctcacacctgtaatcccggcactttgggaggccgaggtgggcagatgacctgaggttgggagtttgagaccaacctgaccaacatggagaaaccccatctctactaaaaatacaaaattagtcgggcatggaggcacatgcctgtaatctcagctactcgggaggctgaggcaggagaattgcttgaatccgggaggcagaggttgctgtgagctgagatcgtgccattgcactccagcctgggcaacaagagcaaaactccgtctcagaaaaaaaaaaaaaaaaaaaggtgggggggtttgaaacacatgggcaattagaaatactggtgtcagagtttaacaagtgaatgactctcaatgactgattaacaaacgacctattagttggtttctaagtgtgttttcatcagaattgaggtggaagttaatcaaattgctctctgagagatcatgaaaacataatttttgatggtagttcactgagactcttatcatgtaattaagattatactgaaagaattgaatgacatcgctttcacataactccttccatgtatttaatctacttatgtcagcacattttaat

SEQ ID NO: 175425 - DNA, 601 bp, Human
gcaattagaaatactggtgtcagagtttaacaagtgaatgactctcaatgactgattaacaaacgacctattagttggtttctaagtgtgttttcatcagaattgaggtggaagttaatcaaattgctctctgagagatcatgaaaacataatttttgatggtagttcactgagactcttatcatgtaattaagattatactgaaagaattgaatgacatcgctttcacataactccttccatgtatttaatctacttatgtcagcacattttaatcttacaaaaaatgagtgcatgtcaktggtgggagaaggacaaaacatcttgctcattgtagcgaacagattcactgacagtgaaaagtgtatttttatgtatatattacccaaatttgtaatatgtttatgttttgaacaattacatcctaataatgatcatagtaactcagaataagatgtttttcaatacttagaccttatgatcagatggaatttaattatttcagtttatatatcttttttcagatataggataataaaatacattcaagcataaaatggcatttcctcatgattaaattctggggaagaagaacggaaat

SEQ ID NO: 175426 - DNA, 601 bp, Human
atcctaataatgatcatagtaactcagaataagatgtttttcaatacttagaccttatgatcagatggaatttaattatttcagtttatatatcttttttcagatataggataataaaatacattcaagcataaaatggcatttcctcatgattaaattctggggaagaagaacggaaattttatatttcaggagaaaggaagagttgtagaatttctgacttggagatgatctaggttcttttcaatatgtaagagtgatataacaccttattaaaatgctaatgctcataatatcttgsaagtgactacttcgtaactaaattgatgaaaaatttaaatgtcaacttgcaaatgttctggggcccatagtttttcaagaatcttctggtaggtacttgagcaaaaacattcaagtcctttggtacctgtttgttgtcaggctccgtgctggctgtgttggtgatgtaatgacacgttccctgaattgacacattcccatctttcaagcagtagactttctacaacaaccaacttaatttatgtctgaagcaaagacgtataactgtacacactaaagatctttacatttcgtgttttta

SEQ ID NO: 175427 - DNA, 601 bp, Human
gtaactcagaataagatgtttttcaatacttagaccttatgatcagatggaatttaattatttcagtttatatatcttttttcagatataggataataaaatacattcaagcataaaatggcatttcctcatgattaaattctggggaagaagaacggaaattttatatttcaggagaaaggaagagttgtagaatttctgacttggagatgatctaggttcttttcaatatgtaagagtgatataacaccttattaaaatgctaatgctcataatatcttgcaagtgactacttcgtaamtaaattgatgaaaaatttaaatgtcaacttgcaaatgttctggggcccatagtttttcaagaatcttctggtaggtacttgagcaaaaacattcaagtcctttggtacctgtttgttgtcaggctccgtgctggctgtgttggtgatgtaatgacacgttccctgaattgacacattcccatctttcaagcagtagactttctacaacaaccaacttaatttatgtctgaagcaaagacgtataactgtacacactaaagatctttacatttcgtgtttttataaacagaattacaaatg

SEQ ID NO: 175428 - DNA, 601 bp, Human
tgtttatgtggcaagtaattagcagtttttaaaatgttttgtgactaactccacaaggttagaattgactgtagaaatagctgctgaaagaatatagagtagaaattgattttgcaatattttgaacctgggcttcaagtagactctggactttttcagtgagaaggaagggttaatgtgcaaaatattttgctttgaagttttcttttcccctttttttgtttgagatggggtctcactctgtcacccaggctgtagtacagtggtgtgatctcagctcactgcaacctccgcctcctgsgtgcaagtgattctcccgtctcagcctgctgagaaactgggatcacaggcgcctgccaccatgcctgactaattttttgtatttttaatagagatggggtttcatcatgttggccaggctggtgaagctttctttaacatgtcccattctatagcccaggaaagcattacagtctcaaaagatggtggacatcaatgtttattaaaacattgtttttaaaagtttacaaagtagaatatatgtgaaaagtgaaagctttagaattaaatcctttcatacccatttccgtgcatatataaa

SEQ ID NO: 175429 - DNA, 601 bp, Human
attagcagtttttaaaatgttttgtgactaactccacaaggttagaattgactgtagaaatagctgctgaaagaatatagagtagaaattgattttgcaatattttgaacctgggcttcaagtagactctggactttttcagtgagaaggaagggttaatgtgcaaaatattttgctttgaagttttcttttcccctttttttgtttgagatggggtctcactctgtcacccaggctgtagtacagtggtgtgatctcagctcactgcaacctccgcctcctgggtgcaagtgattctccygtctcagcctgctgagaaactgggatcacaggcgcctgccaccatgcctgactaattttttgtatttttaatagagatggggtttcatcatgttggccaggctggtgaagctttctttaacatgtcccattctatagcccaggaaagcattacagtctcaaaagatggtggacatcaatgtttattaaaacattgtttttaaaagtttacaaagtagaatatatgtgaaaagtgaaagctttagaattaaatcctttcatacccatttccgtgcatatataaacacacagtttttacttt

SEQ ID NO: 175430 - DNA, 601 bp, Human
tgattacaactaaaaatatactgctagtctacaaacccagtctagttaaggatgccataacaaagtgccacagaccgagtggctaaacaaatttattttcttagagttctggaggctagcattccaaaatcagaagtcagcagggttgcttccttctgaagcctctttctttgacttgtagatggctgacatctccctgtgtcttcacatggttttctctctgttctctttgtctaaatttctttctttttttttttttttgagatggagtctgtctcttgttgcccaggctcgagtgcarcggcgcaatctcggctcactgcaacctccccctgctaggttcaaacgatttctcctgcctcagcctcccgagtagctaggattataggcatgcacctccacgcccagctaattttgtatttttttttttttttttttttttttttttagtagagatggggtttctccatgttggtcaggctggtctcaaactcttgacctcaggtgatctgcctgcctcggcgtcccaaagtgctgggattacagacgtgagccaccgcgccggcctaaatttcctcttacaagggcgccagtcatattg

SEQ ID NO: 175431 - DNA, 601 bp, Human
catcttttaactagtttcttgtgttactattttgtcattgaagagctctttatatattttggaatgtaaattctcgatgtgttaaacatttttctcacgatctggcttgctttgatttaaaaattttttttatttcaataattttgagttataggtggttttggttacattaatgagttcttttgtggtgatttctgagtttttaggtgtacctgagcagtgtacactgtgcccaatatgtagtcttatccctcattctttttttttttttttttttttgagatagggtctctgtcacccrggctggagtatagtggtatgattttggctcactgcagcttgacttctggggctcaggcgatcctcctaccgcagcctccagcctcctgagtagctgatatcacagatgcatgccaccatactcagctacttttttgtattttttgtagagacagggtttcgccatgttgcccaagctggtctcgaactcctgaggtcaaaggatctgcttgcttcagcctcctaaagtgctgggattatgggcatgagctactgggactggccaattttttttttttttcaagttgactttttttttttt

SEQ ID NO: 175432 - DNA, 601 bp, Human
ttgaagagctctttatatattttggaatgtaaattctcgatgtgttaaacatttttctcacgatctggcttgctttgatttaaaaattttttttatttcaataattttgagttataggtggttttggttacattaatgagttcttttgtggtgatttctgagtttttaggtgtacctgagcagtgtacactgtgcccaatatgtagtcttatccctcattctttttttttttttttttttttgagatagggtctctgtcacccaggctggagtatagtggtatgattttggctcactgcakcttgacttctggggctcaggcgatcctcctaccgcagcctccagcctcctgagtagctgatatcacagatgcatgccaccatactcagctacttttttgtattttttgtagagacagggtttcgccatgttgcccaagctggtctcgaactcctgaggtcaaaggatctgcttgcttcagcctcctaaagtgctgggattatgggcatgagctactgggactggccaattttttttttttttcaagttgacttttttttttttttttaaagctacacggtctcgatctgttgcccagact

SEQ ID NO: 175433 - DNA, 601 bp, Human
gtggcatgttcatagctcactgcagcttcaaattcctgggctcaagtgatcctcttgcttcagcttccccaagaagctaggactataggcctgtgccagcacacccagctaattttttttctttttctttttttttttatttcatagagacaggatcttgctatgttgcctgggcttttctccaactctaagcctcaagtgatcctcttgcctcagcttcccaaagtgctgggattacaggcatgagccactgcacctcgcttaggctatttttttaaagagcagtttaaggttataggaraatggagaggagggtacagagatttcccatatgtgcatgtcttcctccattatcagcaactccctgccagagtggtggatttgttatagttgatgaatttatgctgacacatcatcacctagagttcatagcttacattagggttaattcatagaatgttgtatattctgtgagtttaggcaaatttacaatgatctaccattaaaatatcatacagagtagtttcactaccctaaaaaatctatgccccacctattcatcccctccttccccgtaatctcaggcaaccattgatcattt

SEQ ID NO: 175434 - DNA, 601 bp, Human
ccacaagctttgtctacatttctcatacttctttgtttagagtactggaagtagattctggatcgaagactactgctggatgttacgaattattttcctaatctatcctttttatattacattaaggagtttaacattttgtagagcttaaaaagttttttggtggcatcatttttgttttatttaaaaattacaacaaaattatttgtcattttaccacttaaaagtcagtgattttgggtgatgataatgtgtcagtgtagtttcaccagttgtaacaaactcaccactctgatagggkatgtttatgatggggggaggagatgcatatgtagaaggaatagataggctatctctgtacttggtctcaattttggtgtgaacctaaaactgctctaagaaatcaaaaagggaaaaaaatggtacagtaattaaaccatgccctcaattcagttgcatattaaatttgagtgcaggctgggcatgatggcttatgcctgtaatcccagcagtttaagtggctgaggcatggctgggcacagtagctcatgcctgtaatcctagcactttgggaggctgaggcaggcagatcacctgaggt

SEQ ID NO: 175435 - DNA, 601 bp, Human
gaagctgaggcacgagaatctcttgaacctgggaggcggagcttgcagtgagccaagatggtgccactgcactgtagcctgggctacagagcgagattctgtctcaaaaaaaaaaaaaaaaaaaagaaaaaagaaaaaggctgaggtgggaggatcacttgaactcaggagtttgagaccagcctgagcagcatgaggaaatcttgtctctacaaaaactacacaaattagccaggtgtggtggcatgcgcatgtggtcctagctacttgggaggttgaggcaagaggattgcttgagtcygcctgagggtgaggctgcagtgagccatgtactccatcctggggaaagagcgagaccctgtctcaaaaaacgaaaaaaaaaaaatttatgcacctttctccgtttttttccccaagtatgagcagatacatctatataaacattgttctcacacattaaaacaatcatgttattttgcttgcattttttttttcaattattgtagcatgggcatccttttaggtaattgtatatggacatctactgcattattttcaatggctatgtaatatactgttgttggatgtcctttatttagtc

SEQ ID NO: 175436 - DNA, 601 bp, Human
ggagcttgcagtgagccaagatggtgccactgcactgtagcctgggctacagagcgagattctgtctcaaaaaaaaaaaaaaaaaaaagaaaaaagaaaaaggctgaggtgggaggatcacttgaactcaggagtttgagaccagcctgagcagcatgaggaaatcttgtctctacaaaaactacacaaattagccaggtgtggtggcatgcgcatgtggtcctagctacttgggaggttgaggcaagaggattgcttgagtctgcctgagggtgaggctgcagtgagccatgtactccakcctggggaaagagcgagaccctgtctcaaaaaacgaaaaaaaaaaaatttatgcacctttctccgtttttttccccaagtatgagcagatacatctatataaacattgttctcacacattaaaacaatcatgttattttgcttgcattttttttttcaattattgtagcatgggcatccttttaggtaattgtatatggacatctactgcattattttcaatggctatgtaatatactgttgttggatgtcctttatttagtcattcatctgttaattcagcaaagaactattgagtacc

SEQ ID NO: 175437 - DNA, 601 bp, Human
tatttttagtagagacgaggtttctccacgttggccaggctggtcttgaactcctgacctcaagtcacacgcctgcctcggcctcccaatgtgctaggattacaggcatgagccacggtgcctggccccagatgtctctcttaatgagtggctgagctgtatgttttttttactctcagagacatggctttcccttatccagaggcagtgtcactggtagggaggatctcgattatttagtctttgtaactgccctgctgttttagataggtagggcagggctgggcacagtgactcacayctgtaatcccagcactttgggaaactgaggtgggcagatcgcgtgagcccaggaagttggagatcagcctgggtgacatggtgaaactctgtctctactaaaaccacaaaaattagctgggcatagtgtcatgcacctgtagtcccagctacttggaaagctgaggcaggaggatcacttcaccctgggaggcagaggttgccttgagctctggtcatgccactgcactccagcctcagcctgggtgacagactgaaaccctgttccaaaaaaggaagaaactgaggagggaggtggggt

SEQ ID NO: 175438 - DNA, 601 bp, Human
gtgggtgaatcacctgaggtcaggaatttgagaccagcctggctaacatggtgaaaccctgcctgtctctattaaaaatacaaaaatgagccagacatggtggaggcgcctgtaatcccagctacttgggaggctgaggcacaagaattgcttgaactcgggaggcggaggttgtagcgagctgagattgtgccactgcactccagcctgggtgacggagagaccctgtctcaacaacagcaacaacaaaagtcaatcctctcaaaaccctgctgctcatggctgggcgcagtggctcacrcctgtaatctcagcactttgggaggccgaggagggcggatcacaaggtcaggagatcaagaccatcctggctaacacggtgaaaccccgtctctactaaaaatacaaaaaattagctggacgtggcggcgggtgcctgtagtcccagctactcgggaggctgaggcaggagaatggcacgaacccgggaggcagaggttgcagtgagctgagatcacgccactgcgctccagcctggttgacagagtgagactccgtctcaaaaaaaacaacaaaaaaaaaaccctgcggctcctttaag

SEQ ID NO: 175439 - DNA, 601 bp, Human
atacaaaaatgagccagacatggtggaggcgcctgtaatcccagctacttgggaggctgaggcacaagaattgcttgaactcgggaggcggaggttgtagcgagctgagattgtgccactgcactccagcctgggtgacggagagaccctgtctcaacaacagcaacaacaaaagtcaatcctctcaaaaccctgctgctcatggctgggcgcagtggctcacgcctgtaatctcagcactttgggaggccgaggagggcggatcacaaggtcaggagatcaagaccatcctggctaacayggtgaaaccccgtctctactaaaaatacaaaaaattagctggacgtggcggcgggtgcctgtagtcccagctactcgggaggctgaggcaggagaatggcacgaacccgggaggcagaggttgcagtgagctgagatcacgccactgcgctccagcctggttgacagagtgagactccgtctcaaaaaaaacaacaaaaaaaaaaccctgcggctcctttaagaactatgtttatgtgatattctaagtctttttttatgatttcgacaatgttcacagaatcttcactggggtagatgc

SEQ ID NO: 175440 - DNA, 601 bp, Human
agagaccctgtctcaacaacagcaacaacaaaagtcaatcctctcaaaaccctgctgctcatggctgggcgcagtggctcacgcctgtaatctcagcactttgggaggccgaggagggcggatcacaaggtcaggagatcaagaccatcctggctaacacggtgaaaccccgtctctactaaaaatacaaaaaattagctggacgtggcggcgggtgcctgtagtcccagctactcgggaggctgaggcaggagaatggcacgaacccgggaggcagaggttgcagtgagctgagatcacrccactgcgctccagcctggttgacagagtgagactccgtctcaaaaaaaacaacaaaaaaaaaaccctgcggctcctttaagaactatgtttatgtgatattctaagtctttttttatgatttcgacaatgttcacagaatcttcactggggtagatgccatctcatgaaaccactttatttggtcatctataagaagcaactccttaaggctgggtgtggtggctcacacctgtaatcccagcaggcggattgcttgagcccaggactttgagactagcctgggcaacatggtgaaacc

SEQ ID NO: 175441 - DNA, 601 bp, Human
tgtctcaacaacagcaacaacaaaagtcaatcctctcaaaaccctgctgctcatggctgggcgcagtggctcacgcctgtaatctcagcactttgggaggccgaggagggcggatcacaaggtcaggagatcaagaccatcctggctaacacggtgaaaccccgtctctactaaaaatacaaaaaattagctggacgtggcggcgggtgcctgtagtcccagctactcgggaggctgaggcaggagaatggcacgaacccgggaggcagaggttgcagtgagctgagatcacgccactgcrctccagcctggttgacagagtgagactccgtctcaaaaaaaacaacaaaaaaaaaaccctgcggctcctttaagaactatgtttatgtgatattctaagtctttttttatgatttcgacaatgttcacagaatcttcactggggtagatgccatctcatgaaaccactttatttggtcatctataagaagcaactccttaaggctgggtgtggtggctcacacctgtaatcccagcaggcggattgcttgagcccaggactttgagactagcctgggcaacatggtgaaaccccatctct

SEQ ID NO: 175442 - DNA, 601 bp, Human
ctcatggctgggcgcagtggctcacgcctgtaatctcagcactttgggaggccgaggagggcggatcacaaggtcaggagatcaagaccatcctggctaacacggtgaaaccccgtctctactaaaaatacaaaaaattagctggacgtggcggcgggtgcctgtagtcccagctactcgggaggctgaggcaggagaatggcacgaacccgggaggcagaggttgcagtgagctgagatcacgccactgcgctccagcctggttgacagagtgagactccgtctcaaaaaaaacaacaamaaaaaaaccctgcggctcctttaagaactatgtttatgtgatattctaagtctttttttatgatttcgacaatgttcacagaatcttcactggggtagatgccatctcatgaaaccactttatttggtcatctataagaagcaactccttaaggctgggtgtggtggctcacacctgtaatcccagcaggcggattgcttgagcccaggactttgagactagcctgggcaacatggtgaaaccccatctctacaaaaaatacaaaaattagccaggtgtggtggcacatgcctgtagtcc

SEQ ID NO: 175443 - DNA, 601 bp, Human
gttgatattttgacctcctcccgtgaatcagaaatgttcttaatggcatctagaatggtaaatctttaccagaaagattcactttgcccatatccatcacagaaatcattatctatggcagctgtaactttatgaaatatgtcttaaatagtaatacttgaaagttaaaattgctccataatccatgggatgcagaacagatgttgtgttaatgggcgtgaaaacaacattaatctctttgtaccttgctatcagagctcttgggtgaccacgtgcaccgttaatgagcagtaatatatayacacacacacacacacacacacacacacacaagtatatacatatatgtgtgtgtgtgtgtgtgtatatacattttttttttcccatacagagtcttgctctgtcatccaggttggagtgcggtggcatgatctcagctcactgcaacctctgcctcccaggttcaagcaattctcctacctcagtctcccaagtagctgggattacaggtgtgtgccaccacgcctggctaatttttgtatttttagtagagacagggtttcaccatgttggctaggcaggtctagaactcctgacctca

SEQ ID NO: 175444 - DNA, 601 bp, Human
gaaaaagaaaaaagctacaactttggtgcacaaaattattaaaaatattatataaaattaccttcaggctgtgtgtataagtaacataaatgaattttatgtttggacttgggtttcttcccctagatatctcagtatgcatatgcaaatatttaaaaaatctgaaaaaaattcgagacacttatgcttctaagcattttgcataagggatagtcacccggcactacctagagttttctttttcctttgttgtgagccacatgtaatgtgcctcccattccctgctcactgattttctccyctctaattttagtttcagaaacacaacagacctttccataatgcagctagattgtggttggctctccctatatactgtctgcagactacactacgtggaatgtccatggctataatatgtttgttacttgtaacttgtgaatatatcatttttcctttcccccataccaacagatctaccaattccagcatgaaagctattaactttagggcgtaattatggttgttatcttggttcgataccattggaattagtggcaatcatattgttgctttattgttaaatttggaaattcataag

SEQ ID NO: 175445 - DNA, 601 bp, Human
tgcttttgttgcccaggctagagcgcaatggcatggtcttgggtcactgtaacctctgcttccctaattcaggtgattctcctgcctcagcctcctgagtagctggactacaggcgcatgccatcacaccaaactaattttttgtatttttagtagatatggggtttcaccatgttgaccaggctggtctcaaactcctgacctcatgtgatccacccacctcggcctcccaaagtgctgggattcgaggcatgagccactgcgcctggccctgacttttgttttttaatttttatttttktgtgtgtggagatggtgtcttgctatgttgctcaggctgatcttgaactcctggcctcaagcggtcctcctacctcagcctttcaaagttctgggattataggcatgagccactgcgcctggccctatgcttgacttttcaaacagaagtagtgattatatggtacaataagacatctactcaaattcctaggaagaggtggtgtacttgatagcttttgtttgtttcatatatccagggaagggaaaaatgggaagacttaatttttttgagagagaatctcgctctgtcaccctggct

SEQ ID NO: 175446 - DNA, 601 bp, Human
aagttttgtgctacctttccttggcttacagaaagaaaaagtacaaactcccttctctgacatttcaaatggtactttatctgagaatctatccaagttaccagccttaggtcttgcaatttccctgtaaaatccctcagttaattgtgatatatacccattcttctgaacatggcagagaactatctccacaggttttttttttttttttttgagacagagtttgttacccagcttggagtgcaatggcgcgatcttgtttcactgcaacctccacttccagggtcaagtgattctcctscctcagcctcctgagtagctgggattacaggcacgcgccaccctgcccggctaattttgtatttttagtagagacggggtttcaccatgttggccaggctggtcttgaactcctgaccttaggtgatctacctgcctcggcctcccaaagtgctggggttacaggtgtgaaccactgtgctcggccaattttttcttttttaaataccttttatttggaagtatacatttacaaaagttacaaaaatatagtataaagaacatctggatatccgttatccagacttacccacttgcttat

SEQ ID NO: 175447 - DNA, 601 bp, Human
tagtcttgaactcctgggctcaaataatccccctgcattggtttccccaagtgttggtgctgggattacaggtgtgagccactgtgtcctgccctactatctttgttatagtggtggacttgtcatacgattatattataattatatgacattatatcattatattgttcttaattataagaaatagtatatgacctagattgtacaatgatttgtccagttatcctggtaaattttatttacctttgtcttgacggaatttgattaagcctatgcaaataacgttattaacatgaaaaartagacttagtttttactttattttgaggtggggtctcactctcttgacctacctggagtgcagtggtatgattgtggctcattgcaatcttgaattcctggactcaagcagtcctgcctcagcctcctgagtagctgggactacaggcatgcgccaccgctctcaaatgccatttaaaaattttcctacaaaagcataatatattaaattgtgagctagaggtagatgaagaagaaaggaaaagggcttcctcatatagccatcagaaaacagaatattaaaaaataacaccagcctggg

SEQ ID NO: 175448 - DNA, 601 bp, Human
gtaactggtgtgagtggtggtcctggtagcggatgctacttaattaacaacattgtcaaattgcagaaaattgaagttcttctcatttaaaaaacggttttcagttgaagaatttaagtatcctgaagtcagtaataccttgaactaatctttttagatgacattcctccagcagtgaaagtatgtctgtggttactcaacagaaaaatttaattctaatgacagactgtttttttgagacagagttttgctcttgttgcccaggctggagtgcagtagtgtgatctcctctcactacaayctctgcctcccaggttcaagcgattttcctgcctcagcctctcaagtagctcgggttacaggcatccgccaccacaccctgctaatgttttgtattttgtagagatggagtttcaccatgttggccaggctggtcttgacctcctgacctcaggtgatccacctgcctcggcctcccaaagtgctgggactacaggcctgagccactgcacccggccaccacatacgttttaaaatcaagactttggaatcccagactgcggtatcattcattgtctcggaaattaactctttggagtac

SEQ ID NO: 175449 - DNA, 601 bp, Human
ttgtcaaattgcagaaaattgaagttcttctcatttaaaaaacggttttcagttgaagaatttaagtatcctgaagtcagtaataccttgaactaatctttttagatgacattcctccagcagtgaaagtatgtctgtggttactcaacagaaaaatttaattctaatgacagactgtttttttgagacagagttttgctcttgttgcccaggctggagtgcagtagtgtgatctcctctcactacaacctctgcctcccaggttcaagcgattttcctgcctcagcctctcaagtagctsgggttacaggcatccgccaccacaccctgctaatgttttgtattttgtagagatggagtttcaccatgttggccaggctggtcttgacctcctgacctcaggtgatccacctgcctcggcctcccaaagtgctgggactacaggcctgagccactgcacccggccaccacatacgttttaaaatcaagactttggaatcccagactgcggtatcattcattgtctcggaaattaactctttggagtacctcctcttgagttgatggattttttttttttttttttttttttttttgagac

SEQ ID NO: 175450 - DNA, 601 bp, Human
ttcagtttattttgaaattaaatttctaaagtttaaaggtaaacattttaattataaattctgcattcatgccttctaattaaaatatgaaccaaattcatagaaatcctataaggcaacgattacttaaaaaccaaacaacttaagtgaattgtttttaggtttgtattgccttatgtataaaaatcaacatttgttgattttgccttggatataacacctctcatatttaaagccagaaaacacatgttgccagatgggaactaggaagagtagtagtctcatcttggcatcattttcytcataatgaccagttcacttgttttacacataatctcaggttctttccagctttaattttctatgattgacggatcagattctacattacggaaccttttagttacctgctaactgctgttacaccactcaagatgcgtgataaccagtcagattagaagatgaaagtcttggccaggtgcagtggctcatgcctgtaatcctagcactttgggaggcctaggtgggcagatcacttgaggtcaggagttcgaaaccagcctggccaacatgatgagatctcgtctctactaaaaataca

SEQ ID NO: 175451 - DNA, 601 bp, Human
atctcagctcactgcaacctctgccttccgagttcaagtaattctcctgcctcagcctcctgagtagctgggattacaggcacccgccaccacgactggctaatttttgtatttttagtagagatggaattttgccacgctggccaggctggtctcgatcccctgacctcaggcaatccgcctgcctttgcctcccaaagtgatgggattacaggtgtgagccaccacgcccagcctttaaaatgaccttttttttttttttaaagacactctcactctgtcaccctagttggagtgcagyggcgccatctcggctcactgcaacctctgcctgttgggttcaagcgattctgctgcctcagctccctgagtagctgggactacaggcacgtaccaccatgcccagctaattttttatttttagtagagatggggtttcaccatgttggccaggctggtctcaaacttctgacctcaggtgatccgcccgccttggcctaccaaagtgtgctgggattacaggagtgagccaccacgcctggccttaaaataattttttacaggagatatctatagggataggtcaagaatctacagtcct

SEQ ID NO: 175452 - DNA, 601 bp, Human
tcaaaggcattttgcatttctgttagtcttttttgattctaacctgtgcttttttttttttttttgggagggggagatggagtttcgctctgtcgcctaggctggagtgcagtggtgcgatctcggctaactgtaacctctgcctcccgggttcatgccattctcctgcctcagcctcccgagtagctgggattacaggtactcgccaccaagcccagctactttttgtgtttttagtagagatagggtctctccatattgtccaggctggtcttgaactcctgacctcaggtgatccacyggcctcggcctcccaaagtgctgggattacaggtgtgagccaccgcacctggcctaacctttccttttgattcctccttagagtttttatctctctgcttacattacccatctcttcttgcatgttgtctgctttccccattagagcccgttaacatattaatcatagttaagattccatgattggtttttagatttttagaataaatgtttttaaagaaccaggcttctgccgggcgtggtggctcacgcctgtaatcccagcactttaggaggccgaggtgggcggatcatgaggtca

SEQ ID NO: 175453 - DNA, 601 bp, Human
aaaaaaaaaagaacctggcttctttactgtttactagcgaactttggaagcatcatttacatgtattatcaaacctgtttttattttattttattttgagatggagtttcgctctgtcgctcaggttggagtgccgtggcacaatctctgctcactgcaacctccacctcctgggttcacgcggttctcctgcctcagcctcctgagtagctgggattacaggtgcgtgccaccatgcctggctaatttttgttatttttagtagagacagggtttcaccatgttggccaagctggtctcraactcctgacctcaagtgatcctcctgccttggcctcccaaagtgctgggattacaggcatgagccaccacacctggctgaaacctatttttattattagtgctcatgatttctcatttaagaatatacataatcacacagcttacacacaaatattcatagcaacagtattcatagtagcagaacaacaacttaaatttccatcagctgataggtgcataaataaaatgtggtgtatccatacagtgaagtattagccagaaataaaaagcaatgaagtacagtcatgtagcatataac

SEQ ID NO: 175454 - DNA, 601 bp, Human
taagattatactgtatttttactgtaccttttctatgtttagatatgcttagatacacaaataccattgtattacacttgcctgcgctattcaatatattaacatgcagtataggtataggtttgttgcgtaggagctgtaggctataccatatagcctagatttaggctgtattatctaggtttgttaagggacactctgtgatgtttgcacaatgatgaaatggaatgaaggcacatttctcgtaatgtatccctgtcattaagctaggcatgactgaaccgatatgtgctacaatgtkgatgtatttgaaaacactatgctaagtaaaagaagccagtcacaaagaactagatattgtgtgatgccatttatattaaatgtcctgaataggtaaatccataaagacgcaaatacgtaagtggttgtcaagggcaggggtgaataggtggaaggttgggttatatgaggttgagggggtgggaatgggagcaggggggaataacagctaagggattttgagttctttttgggataatgaaaatgttctaaaattgattacagtgagagttacacaactctgaaatatactaaaagccag

SEQ ID NO: 175455 - DNA, 601 bp, Human
ggaaaaatattactttcctcatgacactgatctcaaaaggtttcctatctcaaacattgttagatttcaaaaataagatgttaattgcactcacttcaaattttaaaaaaccttattcagtctttttatagaggtcatcctgtaattatatggtcaatatgaattccagcagcatatctttttcatgtgtcaagaaagtttacattgaaaagattgcattcttaaaaagaccatacccagatccatctccacttcctgtttgtccactaaacatttgtgagatatttatggctatcttgcrcaatgcctccagaaatcaatgtttgctctcaagtttataactacagtttaaaaaaaattcaccaaaaaattcataatcctggtggatctgctgtttaggactagttagttaagtgcagtatatacaagtagaaaagctccaattattttacttgagatgatctgatggctaattctctcacttcctttgtgtgtgtgtgtgtgtgtgtgtgtgtgtgtgtgtattttatatattttatatatatatatttttttatttttattttttttgagatggagtcttgctgtgttgcccaggctg

SEQ ID NO: 175456 - DNA, 601 bp, Human
ccaggctggagtgcagtggcacgatcttggctcactgcaagctccacctcccgggttcacgccattctcctgccttagcctcccaagtagctgggactacaggcgcccaccaccacgcccagctaattttttgtatttttagtagagacaggatttcatcatgttggccagactggtctcgaactcgtgacctcagacaatctgcccgcctcggcctcccaaagtggtgggatttcaggcgtgagccaccgcgcatggccgcatttataattttaaaagcttaaatgtgttttttttttttggcgggcgtgtgggttgggggagatggagtctcagtctgtcacccaggctctagtgcagtggtgtgatctcggctcacttcagcctccgccttccaagctcagtcctgccacctaagccacccaagtagctgggactacaggcgtacactagcacacccagctaacgttttgtatttttggtagagatggggttttgccatgttgcccagtctggtttcgaactcctgggctcaagctatctgccctccttggcctcccaaagtgttgggattacgggcatgagccactgtccctggcaa

SEQ ID NO: 175457 - DNA, 601 bp, Human
tggggttttgccatgttgcccagtctggtttcgaactcctgggctcaagctatctgccctccttggcctcccaaagtgttgggattacgggcatgagccactgtccctggcaaaaaaaaaaaaaaaaaaagatagaattcaaaaattgtatcttgaatttagtgttgctcatatgacaacttactgtaaaaggtaatttattttaagtataggtcacatactatacaggggatgctttcaaaagacaattcctattgataattgtattttattattaaagtcaaagaatgtcttagtctgytttctggtgttctgttctagtgttctggtcttctagggttagaaactaggtagtttataaaagaaaggtttatttagcacatgattctggaagctgggaagtctgagatctggtcagcttctggtgagggccttgtgccatgtcgtaacaccacggtggagaagaggaaggggaagcaggcatgtgcaaagttaccaacacaagaggtggtctcactttgtaacaacccactctttagtccaaacctgtgggagcaagaactcaagggagtgagaaaggcattaatccatcttaacgact

SEQ ID NO: 175458 - DNA, 601 bp, Human
tgcgttttctgggtctctgctctgtgaaaaatagtatgtattggacatgagtacatgacagctgacatttatcaaggataacagggggagccatattcattttcacattttaaagcaactttgaaagctttgcatgtgcacacatgctcaacatatgttcctaagctttaaatatattttccatcatgtattgcttatcattaatataagaaactaagtgtaaatctttaatgagctcaatatattaaacttatatgagtacacaagcatttggaagatcagcaatgcaggctacttcattcatttacatggaatttatcttttatagtttctgtgctattacaaataatgtaacacattccagatagcccttttgttatatagtgtttgatttggcccttctttaatttcattaccataaaattttgtcctgttgtagaagactaaatggtagaaattaacttttttctaaaccaactattgttatattgctgttctctttgccaagctatttatagggctattttactggagggtgacataaatagaattggaatggcataattgttagtctgagttcttagcctttaaaaattttctt

SEQ ID NO: 175459 - DNA, 601 bp, Human
taagctttaaatatattttccatcatgtattgcttatcattaatataagaaactaagtgtaaatctttaatgagctcaatatattaaacttatatgagtacacaagcatttggaagatcagcaatgcaggctacttcattcatttacatggaatttatcttttatagtttctgtgctattacaaataatgtaacacattccagatagcccttttgttatatagtgtttgatttggcccttctttaatttcattaccataaaattttgtcctgttgtagaagactaaatggtagaaattaasttttttctaaaccaactattgttatattgctgttctctttgccaagctatttatagggctattttactggagggtgacataaatagaattggaatggcataattgttagtctgagttcttagcctttaaaaattttctttaaattgtgataattcaaaaagaattctagaataaaactgtaaagctcataatgttgccaacttgttaattaaaataacaccttttgtggttggtataggtttcagatactgtgaccatttaatatatttatatgcagatcacattgacttgctgcaaggt

SEQ ID NO: 175460 - DNA, 601 bp, Human
attcttctgctcttctgtttgtctccttgtggagccgggggcttggggtttatatgggtacaggatatgggggcgtggtgggtcaaaaggcaacttttaggcatgaaaacaggaatgtttgttctcatttagggtcatgggttttcaggcttgagtggggcctttgccagggaactgccttcttctacccagtatttccctgtctcctgtctgtatcagtaatataggaattagaaaacacaaatatctttttttgtaaactaggttgtagatctgtttgtagttaagaggccaaattccrtttttcttaattaccttgattctgtctgtaaatggtacagttcttgagggagccatttttcgagagcctaccatttgccagacatcactgaggttttgttttacctgtggtttttaatcctctcaacaactttgtaaaggtgatggatgtgcattttagagaagatgaaattgagcttcagagatgtaaatttggtaaggtcatgctgagctcaaatcagctgttaagtctgtgttcttttcccctcttcactatgcttcatttaagttggattcgttgttttcttgttcactaatgatg

SEQ ID NO: 175461 - DNA, 601 bp, Human
aaaacacaaatatctttttttgtaaactaggttgtagatctgtttgtagttaagaggccaaattccatttttcttaattaccttgattctgtctgtaaatggtacagttcttgagggagccatttttcgagagcctaccatttgccagacatcactgaggttttgttttacctgtggtttttaatcctctcaacaactttgtaaaggtgatggatgtgcattttagagaagatgaaattgagcttcagagatgtaaatttggtaaggtcatgctgagctcaaatcagctgttaagtctgtrttcttttcccctcttcactatgcttcatttaagttggattcgttgttttcttgttcactaatgatgtgtgcttgtgtgtccagtttaggaattaaccttgtctattgattcttggtttcagacaagtatcccatgtctgtctagagtttggctgtggataattgatgatactatcttttcaaattatttataattcgtgaaagcttatagttcttttaacatccatttattcttctgtttctttttatcattcgtaatggctttcaattattattttaaaaatcgagatgggagcttgct

SEQ ID NO: 175462 - DNA, 601 bp, Human
agagtttggctgtggataattgatgatactatcttttcaaattatttataattcgtgaaagcttatagttcttttaacatccatttattcttctgtttctttttatcattcgtaatggctttcaattattattttaaaaatcgagatgggagcttgctatgttgcccaggctggtctcaaactcctgggctcaagtgagcctcccacctcagctttccaaagtgctggcaatgtaggcttgagccactgtgcctggccaattctttatctcattaaggatcataaacatttattttaaacsaatttcaagatttttattaagcattgaattcatcttttgatattgatgaatttcttgactatcttccttagttcagttattttttatttttatttattttttttgaggtggggtcttgctctgtcactcaggctggagtgcagtggcgagatctcggctcactgcaaccttcacctccaaggttcaagtgattctcctgccctcagcctcctgagtagctgggactacaggcgcatgccactacccccggccaatctttgtatttttagtagagacagtgtttcaccatgttggccagga

SEQ ID NO: 175463 - DNA, 601 bp, Human
cagctactcgggaggctgaggtgggaggatcacttcagaccagcagatcgaggctacagtgagccgtgatcacaccattgcactccagcctgggtgacagagctgagaccctgtctccaaaaaaaaaaaaaaaaaaaaggtgaatgtttcttaagttttaatttctaatatggtgaatactgacataacccacatagcagaagttattacaggtttccagtttttaagaggtaaaggaatcctgagatcaaaaggcttgaaatctagtgaatttggttggaactctagaagcatttgactkaaacctttcaccttgttgtatttggtatcttgtagcacacccagttcctgctacagctgcctctattctgtgctgcttaaatacggaggaggtctgagctaaccaatctgaagtttggccaatttcaggggcatttagttgttaacctgaatctacttcttttattagtaagaaacatatctactatagagatttaggactttgaacagctgtataacattataggatatgtctggtactcagttgtttctgtttctgaatcacaaatcggccattaattttaaataaagacgttttgta

SEQ ID NO: 175464 - DNA, 601 bp, Human
taatttttgtaacatcagtgttgcaggtgaacaaactcattgtagcctctatttttgatattgctggacagggctaactttagtactatagtgggaagtttgttattttgttttttactctacaggcactctggtttaggaatatttatctgtcttgcatttgaccatggttaccattccccctcttcattgtttacttagtgtaccatggtacactttatgtaccatccttgctgctctcagctgtttggttaccaggtggctaatgttgtcatctcttaagctttaacatttacttctsaatactgtcttttcctctgtgaggtagatggaaagaatagattagaagagaatggggcatatgctgtgatcatctctcctttacatctttattgcttattaatttaatttatatcagatttcatttctgctctgtgcacatacccactgtccctcctcaccactcttctttatccagttctttctcacttaccttagcatggctaaaacccttggtttttatttatctctttcttcctctgctgtttttattttcattatatgccacagggacaaacttaggtataagtactacttttga

SEQ ID NO: 175465 - DNA, 601 bp, Human
aagtactacttttgatgtagagatacttatgtctgtcaaaggaaaattaaactacaaaccccagaggtaaaaaatggtacacaatactggggtttaaaaaatctcctcctcggccgggctcatgcctgtaatcccaggactttgggaggctggggtaggttggtcacctgaggtcaggagttcgagaccagcctggccaacatggcgaaaccccgactctactaataatacagaaatgaggtgggtatggtggcagctgcctgtaatcccggctacttgggaggctgaggcaggagaatcrcttgaatctgggaggcggaagttttagtaagccgagattgcgccactgcactccagcctgggtgacagagcgagactccatctcaaaaacaaaacaaaacaaaataaaaaagccccactccttctgcccctccagaccagggtctcactcccttcacccaggctggagtgcagtggcgcgaaccttagctcactgtaacctctgcctcctgggctcaggtgatacccccacctcagcctcccgagtagctgcgactacaggtgtgcgtcaccacgcttggctaagtgttttgtatttttt

SEQ ID NO: 175466 - DNA, 601 bp, Human
gcgtcaccacgcttggctaagtgttttgtattttttgtagagacggcgttttgccactttgcccaggctggtcttgaagtcccgggttcaagctgtcctctcatcttggcctcccaaagtgttgagattacaagtgtgagccaccacacccagccaaattatttctttttacctctgtaaaaggagaaccttctctgtattttaagaagatgtggagttggtcaaaagtacagctgatgggaaagcaaaggagaactggagtttgaaaagagaagaggaatggtggtagttaaaaaaaaawtttgtaaaaaatagagttacatacaagtttacacaatggtttagagcttacaaggtaggaagcagagacagaaatagtgtaatatgtaaaatgttatagtaaaaatatggaaaatgcttaggataaagaagggaaaacttttgtctaattgggagagtcggggatggttttaccagaggtgacaaattaatcttgaagggcaggaatattctagatggaaaagcgatgtgggaaagattaaaaaaaaattagtgacttaaggttaaaaataaaggaaatgtttcagttacctttattaaa

SEQ ID NO: 175467 - DNA, 601 bp, Human
tgttcaatttatatattaaaaataggatgttttactttattgtttcttgctagcccttcactcaatatgctggcattataaagcaaagatagtggagaagaaattaccaagaactgaagttgtactgttttcttgtatacatctccaccaaggtagtttcttgtagataccatgtgtatgttttgtttctaaaaactgtaggctcctagctttgctattcattgtgttcaaacgattccttctttttttttttttttaacacttaccaaatttaattgtttttctgttttcctgttctgcyagcctgagagttctagtaattggtagtgacatttatccctgttttctggggctaaaatgattctgggcatgcaaaacgtttgagctgaaatggaattaaattgaaaaaaaaaaaaaggattgtgttatactttatcctacaaaacataatagcaaattatcagccacaaaacaaaaggatataaaaaatttccctctctgacagaggatgaggaagcaaaagaaaaataaataagtaggccaggcgcggcggctcacgcctgtaatcccagcactttgggaggctgaggccggtggatca

SEQ ID NO: 175468 - DNA, 601 bp, Human
aagttgtactgttttcttgtatacatctccaccaaggtagtttcttgtagataccatgtgtatgttttgtttctaaaaactgtaggctcctagctttgctattcattgtgttcaaacgattccttctttttttttttttttaacacttaccaaatttaattgtttttctgttttcctgttctgctagcctgagagttctagtaattggtagtgacatttatccctgttttctggggctaaaatgattctgggcatgcaaaacgtttgagctgaaatggaattaaattgaaaaaaaaaaaaaggattgtgttatactttatcctacaaaacataatagcaaattatcagccacaaaacaaaaggatataaaaaatttccctctctgacagaggatgaggaagcaaaagaaaaataaataagtaggccaggcgcggcggctcacgcctgtaatcccagcactttgggaggctgaggccggtggatcatgaggtcaggagttcaagaccagcctttccaagatggtgaaaccccgtctctactaaaaatataaaaattagctgggcgtggtggtgggtgcctgtaatcccagctactcgggagg

SEQ ID NO: 175469 - DNA, 601 bp, Human
gcgtggtggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttataaaagctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattct

SEQ ID NO: 175470 - DNA, 601 bp, Human
gtggtggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttagaaaagctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttc

SEQ ID NO: 175471 - DNA, 601 bp, Human
ggtggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttatacaagctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttccc

SEQ ID NO: 175472 - DNA, 601 bp, Human
gtggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttataawagctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttccca

SEQ ID NO: 175473 - DNA, 601 bp, Human
tggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttataaawgctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttcccaa

SEQ ID NO: 175474 - DNA, 601 bp, Human
ggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttataaaatctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttcccaag

SEQ ID NO: 175475 - DNA, 601 bp, Human
ctttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttcccaagaacttgttttttctgattgacttgagcagtctctgcttttgcatagtgcttgaagcagtttttaataaaccagttcagatccatagctctttgaaaaaatttccataagttactgtgattctcaagaaatacaccaaaccwctctctaattagtgtatttaatcataccttgtataagttagggaaacaagcctgacagataaactaaattgctgctgggatagtcaagtggctccaccatttaatgatagcaaaccaaagaataacaatacttgactgaccattttaaggtatagtttgtatatgtcgatctcaaattttccttttgctgtgtgagccattgaccatctcaagtggaagtaagggttatgggtaatattagaccaccacgaagggcagtttagtgacatcggtgggtaatggttaggtaaggtacttgag

SEQ ID NO: 175476 - DNA, 601 bp, Human
tttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttcccaagaacttgttttttctgattgacttgagcagtctctgcttttgcatagtgcttgaagcagtttttaataaaccagttcagatccatagctctttgaaaaaatttccataagttactgtgattctcaagaaatacaccaaacctmtctctaattagtgtatttaatcataccttgtataagttagggaaacaagcctgacagataaactaaattgctgctgggatagtcaagtggctccaccatttaatgatagcaaaccaaagaataacaatacttgactgaccattttaaggtatagtttgtatatgtcgatctcaaattttccttttgctgtgtgagccattgaccatctcaagtggaagtaagggttatgggtaatattagaccaccacgaagggcagtttagtgacatcggtgggtaatggttaggtaaggtacttgagg

SEQ ID NO: 175477 - DNA, 601 bp, Human
ataccaaatagaaaactgtacctgaagggttagtcatagtcatttgtgctcaggaattattgtatatattgaaattattattttggggaccagaaatgcttttttatttctcatgttgaacattttctttagtttaatgaaattcaggagatgtttgctctactttgctttttgttataaaacaatttgtcatttactcttagacattgtggtatcttatacagttgtacagtaaatgtacctaagttttgtccatgtctaattaagaactacaaatctgtccaacctgttcctaaaaaayccaagatagagactggacatggtggctcatgcctgtgattgcagcgctttgggaggctgacgtgggcagatcagttgaggtcaggagttcgagaccagcctggccatcatggtgaaaccctgtctctattgaaaatacaaaaattagccaggcgtggtggcacacacctataatctcagctactcgggaggctgagacgagaatcatttgaacccgggaggcggaggttgcagtgaactgagatcatgccactgcactccagcctgggtgacagagtgagactcttgtctcaaaagcaaa

SEQ ID NO: 175478 - DNA, 601 bp, Human
tttatttttattttttgagatggagtcacactctgttacccaggcctggagtgcagtggcgggatctcagctcactgcaacctccgccttccgggttcatgcgattctcctgcctcagcctcccaagtagctgggactacaggcgcctgccaccacgcccagctaatttttgtatttttagtagagacagggtttcaccatattggccaggctggtctcgatctcctgaccttgtgattcacccgcctcggcctcccaaagtggtgggattacaggcgtgagccactgcacctggctctttaattattcaatttattattattattgtttttaagagacagagtctcactcggtcacccagtctggagtgcattggcgtgatcataactcactgcagcctcaaactcctcaaacaagcagtcttcctgttttattcctaagtagttaatgctataggtgtgcaccatgatgcctggcttatttttaaaaaaattttgtagagacagggtgttactgtgttgcacagattggtctcaaactcaagtgcctcaaactcaaactgcctgagcctcccaaagcactgggattacttgagctactc

SEQ ID NO: 175479 - DNA, 601 bp, Human
ttgcatttagttgtcattttcttatagcttcctttaaaatctggactgtttacagactttctttgtcttttgtgacattgacacgtttgaaaatacaatacccctgagattgtgtgatctgactgtgccactactaataatagtgagccactactaataaaggttattttaagtctttttctgtccttcatttaaacttgtcatggggaaaaaacaaatacttaaatcatctcagctttttagcctttccattttacaaccaaagttatagaatgaattttcttggtaatttaatacatayttagtgcatctgtaaagacaatgttgcaatctagattttctgatttatattatgatcatgtgattttttaaatttttattttttttgtttttttgcttttgattttttttttaaagctacacatttgaagtttgatcagcatcttgagtgaattttttcatttttataaatctgtcttccttcctggtagcattctgccacctagtggaaatttatgtcctccagcatacgtctcagagtttagttggaatgcaagatgcattttaatatataaaaattagtttagaatcgttgaacttc

SEQ ID NO: 175480 - DNA, 601 bp, Human
aacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggtaataaaaacactcatgtctttttgaacagtggtggttcccaacctttttggcaccagggactggttttgtggaagccagtttttccatggacctggtagaggggatggtttcaggatgattcaagcacattacgtttgtggtgcaytttatttctattatggttacattgtaacatataatgaaataattatacaactcaccataatatagaaatcagtaggagccctgagcttgttttcctgcagctagatggatccatctgggggtaatgggagaaactgtgacagatcattaggcattagagaatcataaggagcacacaacctagattcctcgcatgtggagttcacattaagatttgcacacctgtgagaatctaatgctacttctgagctgacaggatgtagaactcaggtggtaatgtgagtgatggggaggggctgtt

SEQ ID NO: 175481 - DNA, 601 bp, Human
tattttggaaatttttgtaaatgttactatttttaatctgtactatcatagaaatgtatacctactgtaatgagtgctttatgtgtatcttttttcatgttgcttatgcaaccttaaaagaatttcactaaaattcttggcatttgaattgggtatgtttggcattttaaatcccccagataaattaaaaaaaaaatttaggggcacctggttttctctccaaattgcattttgcgtcagaatttagtatttctttaacttcaagcccatttgtcataaagaaacatgttttaaaaaattrtaagtaatttaatgagaattattgggagtaattcctttttttttttttttttgttgagacggagtcttgctctgttgcccaggctggagtgcaatggtgcgatctcggctcactgcaacctccacttcttgggttcaagtgattttcctgccatggcctcccaaacagtttggactacaggcacgtgccaccatgcccggctaatttttgtatttttagtagagatggggtttcaccatgttgtccaggctggtctcgaactcttgacctcaagtgagtcgcctgcctcagcctcccaaa

SEQ ID NO: 175482 - DNA, 601 bp, Human
gttggtcaggctggtctcaaagtcctgacctcaggtaatccgcctgcctcggcctcccaaagtgttgggattacaggcatgagccaccatgcccggctgtatgttactttatatttgaacattttctctgtattaactcccctcagataaacatagtgacagcaattgttatatattattttatccttttagagtgagtctttctctgcacctcttatgatttggcagtgttaattttctacttgaatagccatgttttacatttgctactgaagatactaaataaaatatctttaagcartttagcaagtagcatctttgaaaattatctcatcagtatataaaagtgatacatgtttattataaaagttagaaattaccaagcatgaaagaaaacaggacatgatggagaaaaaaattgccaagcaagaaagatcaaatgctttgtgtgattaacatcatttaaaactgagatcctacttacttttgacctctggggatattttatcttctgtccctgatgtgtttcatttaataaactttttatggacatctgttttgtatttgtcatgtggcccagggctaaactcaggagaggtgg

SEQ ID NO: 175483 - DNA, 601 bp, Human
gtctttctctgcacctcttatgatttggcagtgttaattttctacttgaatagccatgttttacatttgctactgaagatactaaataaaatatctttaagcagtttagcaagtagcatctttgaaaattatctcatcagtatataaaagtgatacatgtttattataaaagttagaaattaccaagcatgaaagaaaacaggacatgatggagaaaaaaattgccaagcaagaaagatcaaatgctttgtgtgattaacatcatttaaaactgagatcctacttacttttgacctctggrgatattttatcttctgtccctgatgtgtttcatttaataaactttttatggacatctgttttgtatttgtcatgtggcccagggctaaactcaggagaggtggttgaggacaaatcatgtctattttgggcacgagtgcacaggtatttactctttcccagaatgcgtttatcccttttccctagtctccccctgctactaataagatttttggtcaccattaaaattctgaattttaaacagattattggactggtggtttatttctgtcagcttattcaatattagtgccttttaaat

SEQ ID NO: 175484 - DNA, 601 bp, Human
aattggagatggagtcttgctctgttgcctaggctggagtgcagtggcacgatctcagctcactgtaacctctgcctcccgggttcaagcaattctcctgcctcagcctcccaagtagctgggattacaggtacgcaccaccacgcccagctaagttttgtattcttaatagagatggggtttcaccatgttgaccaggctggtctcgaactcttgaccttgtgatctgcttgccttggcctcccaaagtgctgggattacagatgtgagccactgttgctggcccgagttttttttttttgagatggagtctcattctattgccaggccggagtgcggtggcatgatctcggctcactgcaacctccgcctgccaggttccagcgattctcctgcctcaccctcccgagtagctgggactacaggcgcacactcccatgcccagctaatttttgtatttttactagagatggggtttcaccatgttggccaggatggtcttgatatcttgacctcgtgatctgcctgccttggcctcccaaagtgttgggattacaggcgtgaggcaccgtgctaggccaagagttttttatagaattta

SEQ ID NO: 175485 - DNA, 601 bp, Human
ccgagtagctgggactacaggcgcacactcccatgcccagctaatttttgtatttttactagagatggggtttcaccatgttggccaggatggtcttgatatcttgacctcgtgatctgcctgccttggcctcccaaagtgttgggattacaggcgtgaggcaccgtgctaggccaagagttttttatagaatttaatcaccaggctctccttcctccctcatgccccattcctggaggttagtagatggaactactaacagaaagttccaatcctttaattacttggtctttctgattaycagctccatcctgaggtgatctagagaccccaccctaagtctcctcatcagcataaattgaggtgtgttccaaaggggctctttatgaataacttgaaaatacttttattactcaggaaattctgaggattttggataggggctctgtgctagaaatctgacaaagaccaaatgtattattatactccttagcagaacatgtagggagaatcctgtggtgctatgtcttaaggagaaaagctgtggatatagtagaaatttggatcagagaaggtggagcaaagatttaatatcttttat

SEQ ID NO: 175486 - DNA, 601 bp, Human
tgtgtgttgctttggggactgcatttaaaatttgagggtaaacttcaagaataaaggtagttactgtctgggttggtagtggcaaataagaaatgcatgaaggggaggatattcacccattaattatcttgagtaatttgcaggtacccccaggtgaagccctagataatgtggcaactctaataaagcccacctgaaactccagttaacatagctgttggtctttcataatactacagtggtctcactcatagattctgtggcttactgaaaaatatgttactaggtaaataattgatcratatgtagattggaactgtcactaggtattggaatgctgcctaaaaagttaagttcctgggtagttaattcatcccatttttttattccctctccttctctctcccttcttcctttcttcttcttctcttcttcttttttttttttttttttttaaacagagacagagtcttgatctgtcacccaggctggtgtgcagtagtgccatcacagctcactgcaacctcgaactcctgggctcaggcgatcctcccaccgcagcctcctgaatagctaggactagagatgtgtgtcactatgc

SEQ ID NO: 175487 - DNA, 601 bp, Human
acttcatcaatttaacaaaggtaggccgggcatggtggctcacacctgtggtcccagctactcgggaggctaaggcatgagaatcgcttgaacctgggaggcgaaggttgcagtgagccaagattgcgccactgcactccagcctgggtgacagagtgagactccgtctcaaacaaacagacagaaaaacaaagatatattgtgtgtgtcaattgaaaaggcagcatgcacaattattcagaatggtcattattcagtagcattatttcctaaactagaatggatagatcaattaagagtkggggggaaaaaaagaaggttagaaggggattttacattttatttcttttcgatcagaaggcaacttatctggttaagttgattgttaaaattataaacagtatacttaagtacaaatatgcaagaaccttcaggagcttggaacatttgtgaatttttcaatattaagtgaagcgcagagtatcagtgaccatatcaggctacagaaaagttctcagtacttcagccgacatggagattgttgtttctactttatttggaatatgagacccttttttggctggcaggggggcggggggtg

SEQ ID NO: 175488 - DNA, 601 bp, Human
tgcaatctcggctcaaggatctcctgggctcaagcaatctgcccacctctacctcccaaagttctgggattacaggtgtcagccaccacgcctggctcccttcttttttttttttttttttttttttttttgagacaaagtcttgctctctctcccagcctggagtgcagtggcgcaatctcggatcactgcaagctccgcctcctgggttcatgccattcccgcctcagcctcccgactagctgggactacaggcgctcaccaccacgcctggctgattttttgtatttttagtagagayggggtttcaccattcacaggatggtctcgatctcctgacctcgtgatccgcccgcctcggcctcccaaagtgctgggattacaggcttgagccactgcgcctggccatagctcaacatttgtatccttccttttattcttttgatttctctaattttcaagtattataattattacctccttcactgttttcgtgaggagtatcttctcccatccttccctaccctccccctggcccccatttctgctataccccaaatgcctagggtttggcaattacaatttggtgttgggattgggg

SEQ ID NO: 175489 - DNA, 601 bp, Human
aagctccgcctcctgggttcatgccattcccgcctcagcctcccgactagctgggactacaggcgctcaccaccacgcctggctgattttttgtatttttagtagagacggggtttcaccattcacaggatggtctcgatctcctgacctcgtgatccgcccgcctcggcctcccaaagtgctgggattacaggcttgagccactgcgcctggccatagctcaacatttgtatccttccttttattcttttgatttctctaattttcaagtattataattattacctccttcactgttttygtgaggagtatcttctcccatccttccctaccctccccctggcccccatttctgctataccccaaatgcctagggtttggcaattacaatttggtgttgggattgggggtttaagctgtatatggtggtctaaagtggcctggtgaaatttctaaattgtgggccttaaacttaaattgatgccattcactcttttttaccacttggtttattatttgtgtttgtagcatttgagttactgttcattaaaaatactatgcatggttgctgtgatctattactcttagaaaaaaaaaaagc

SEQ ID NO: 175490 - DNA, 601 bp, Human
atgaaataaaatgttttgggttctatgtgtctgaaaatatctttattccaccctcctacatgtctggctatgtattacattctaggtttaaaataattatatacttttgaaagatttctgccatagttttctggcatctagtgtggccactgagttgtatttctttctgattttgattcatttgcatgtgacccgtttattctctttggaatgatttaggaactttttctctccgaaattttatgatgctgtatcttggtatgggtcttttttcattcattctgctgtgtactagatacamtgatattccctttggtttaggggtgttttcttgtataatttctttattaaccttatctctcctgtgtttttttttctgacctacttttctgggatttctgttgacatgttgggcattaaattcgttctatttttttttttttgagacggagtctcgctctgtcgcccaggctggagtgcagtggcgtgatcttggctcactgcaagctccacctcctgggttcaagccattctcctgcctcagcctcccgagtagctgggactacaggtgcccgccaccacacctggctaattttttgta

SEQ ID NO: 175491 - DNA, 601 bp, Human
tcctgtgtttttttttctgacctacttttctgggatttctgttgacatgttgggcattaaattcgttctatttttttttttttgagacggagtctcgctctgtcgcccaggctggagtgcagtggcgtgatcttggctcactgcaagctccacctcctgggttcaagccattctcctgcctcagcctcccgagtagctgggactacaggtgcccgccaccacacctggctaattttttgtatttttagtagagacggggtttcaccgtgttagcgaggatggtctcgatcccctgacctcrtgatccacccacctcagcctcccaaagtgggattacaggctgggattacaggcgtgagccaccgcgcctggcccttcattctatattttgaagtcttctctatttttcttgtctttgatttgcttgagtcacgttcaagcttggaaagtgttggacgcttttatcaagtatctggtgatccctgactgttcttatatgttaagagtgagacattaagaagctgatttgacactttgcaagtgtgagcagcatcagttgtctttactgagggtaattaagtggggaactagccctagccct

SEQ ID NO: 175492 - DNA, 601 bp, Human
actcctgccatctggtaatcttttattacctggttgcattttgggagctgggctagggaggcaagtgtgggatattaaattataaaatataaaattttatttaaattataaatatgctaaatataaaatttcctgttttcagcctctgcctcactcctttcttaggctctgcttggtgcccctgaacccctgtacctttgtcgggtaggtagaaggtacaggcctttcgggagtcagggagcaggcagggaggtagttgacctcctgctctatactcagactcctaaccaacctcctcatktcagcaccatgctctgatcccctaccaccctcactggagtctcaatagatctgtggaatacatttgcttgtttttcatatgtatttttcctctgtgggcacataagtctaagtttttctgttctgttgagctggttcctacttctctattcactttgtatcttctattataaatatggaaatacttgatcttgttgcgttattagtgttttatggataaatactaccttttaagtattttttttttaaataaactggatacctcttagttccctttattgtcattttagtagggttagca

SEQ ID NO: 175493 - DNA, 601 bp, Human
ctctgcttggtgcccctgaacccctgtacctttgtcgggtaggtagaaggtacaggcctttcgggagtcagggagcaggcagggaggtagttgacctcctgctctatactcagactcctaaccaacctcctcatgtcagcaccatgctctgatcccctaccaccctcactggagtctcaatagatctgtggaatacatttgcttgtttttcatatgtatttttcctctgtgggcacataagtctaagtttttctgttctgttgagctggttcctacttctctattcactttgtatcttctrttataaatatggaaatacttgatcttgttgcgttattagtgttttatggataaatactaccttttaagtattttttttttaaataaactggatacctcttagttccctttattgtcattttagtagggttagcaagtgaatgcaggtaagcatgcatgatcagtctgccatgtttaacttaaagtatagtttgctttattaagacatcttcagccaggcatgatggtgtgtgcctgtagtcccagctactggggaggctgaggtgggaggatcacatgaacccaagttgatgggacaaaa

SEQ ID NO: 175494 - DNA, 601 bp, Human
cttgatcttgttgcgttattagtgttttatggataaatactaccttttaagtattttttttttaaataaactggatacctcttagttccctttattgtcattttagtagggttagcaagtgaatgcaggtaagcatgcatgatcagtctgccatgtttaacttaaagtatagtttgctttattaagacatcttcagccaggcatgatggtgtgtgcctgtagtcccagctactggggaggctgaggtgggaggatcacatgaacccaagttgatgggacaaaatagaaacatagttgccasttactatggtaacagtccaagaggtgtcctgggaagggtcataagggtgaaatggaaagaagggagggatacatgatatgccctggaggaaaaattgacaggacttggtggtcacacgtgtttactcttggaaagggagaatgtgaagaatcaaattgctgggttttggttcctgggcagtgaatggtgatgctgtgtaccgtcaccatttgacatctgtgaggggttggtttcaggacccctgtggataccaaaatccatggatgctcaagtcccttatataaaacagtctagtatttg

SEQ ID NO: 175495 - DNA, 601 bp, Human
ggacaaaatagaaacatagttgccagttactatggtaacagtccaagaggtgtcctgggaagggtcataagggtgaaatggaaagaagggagggatacatgatatgccctggaggaaaaattgacaggacttggtggtcacacgtgtttactcttggaaagggagaatgtgaagaatcaaattgctgggttttggttcctgggcagtgaatggtgatgctgtgtaccgtcaccatttgacatctgtgaggggttggtttcaggacccctgtggataccaaaatccatggatgctcaagtcmcttatataaaacagtctagtatttgcatatagcctatgcacatcctcccacatagtttaaatcagctctacattacttataatacctaatacaatgtaaatgttatgtatattatatagttgttacactgtattgtttagggaattattataagaagaatgatgactgtgtgtattcagtcaggtacagctaccgtttccttcccctggaatgttttcagtcccctgttggttgaatccatgagtgtggaaccatggatatggagggccaactgtattgtgatatagtagggtaggttgg

SEQ ID NO: 175496 - DNA, 601 bp, Human
ttggggaagaaaaatgttacttgatgactttgtagtcttaaaggtagataaggttttttttgaaaaaaatccttactgctaataaccaaatacttaaaccttcttgatttcagcatttttaatggaactcttctttctagatgttttataaaactagagttgtcttttaatattctaaaatatgacttctgtttaccctattgttttcttagtccccaagaaatgttttaaaattcaattgtttttattgtttatgtcttcaaaccatataagtagatgaatgcctgaggttttttttttktttgtttgtttgttttgtttttttttttttttttgaggtggagtcttgctctgtcgcccaggctggagtgcagtggcatgatcttggcttactgcaacctccaccttctgggttcaggtgattctcatgcctcagcctcccgagtagctggggagccacgcaagcccggctagtttttgtatttttagtagagacagggtttcaccatgttggccaggcccgtcttgaactcctgacctcaggtgatcctcctgccttgaccttccaaagtgctgggattacaggtgtgagccaccgtgt

SEQ ID NO: 175497 - DNA, 601 bp, Human
tgatgactttgtagtcttaaaggtagataaggttttttttgaaaaaaatccttactgctaataaccaaatacttaaaccttcttgatttcagcatttttaatggaactcttctttctagatgttttataaaactagagttgtcttttaatattctaaaatatgacttctgtttaccctattgttttcttagtccccaagaaatgttttaaaattcaattgtttttattgtttatgtcttcaaaccatataagtagatgaatgcctgaggttttttttttgtttgtttgtttgttttgtttgtttttttttttttgaggtggagtcttgctctgtcgcccaggctggagtgcagtggcatgatcttggcttactgcaacctccaccttctgggttcaggtgattctcatgcctcagcctcccgagtagctggggagccacgcaagcccggctagtttttgtatttttagtagagacagggtttcaccatgttggccaggcccgtcttgaactcctgacctcaggtgatcctcctgccttgaccttccaaagtgctgggattacaggtgtgagccaccgtgtgcggccaaatgcctgagtttg

SEQ ID NO: 175498 - DNA, 601 bp, Human
agtcttaaaggtagataaggttttttttgaaaaaaatccttactgctaataaccaaatacttaaaccttcttgatttcagcatttttaatggaactcttctttctagatgttttataaaactagagttgtcttttaatattctaaaatatgacttctgtttaccctattgttttcttagtccccaagaaatgttttaaaattcaattgtttttattgtttatgtcttcaaaccatataagtagatgaatgcctgaggttttttttttgtttgtttgtttgttttgtttttttttttttttttgaggtggagtcttgctctgtcgcccaggctggagtgcagtggcatgatcttggcttactgcaacctccaccttctgggttcaggtgattctcatgcctcagcctcccgagtagctggggagccacgcaagcccggctagtttttgtatttttagtagagacagggtttcaccatgttggccaggcccgtcttgaactcctgacctcaggtgatcctcctgccttgaccttccaaagtgctgggattacaggtgtgagccaccgtgtgcggccaaatgcctgagtttggaatccaaagag

SEQ ID NO: 175499 - DNA, 601 bp, Human
agcctgactataaatcttttgagtttctattgtgtgtgtgtatatatatataaaatttatttatttattattattttttctgatacagggtttcaggatggaatgcagtggtgcagtcacagcccactgcagcctcgacctcccaggctcaggtgatcattccacctcagcctcccaggtagctgggactacaggagtgtgccaccactcttggctaattttttgtagagatggggtttcttcatgttgcccagactgatctcagactcttgggctcaagtgatctgcccacctcagcctytcaaagtgctgggattacaggtgtgaagatattctttaagctgcaaaattgcactttacttttttttccccagtgccaaacagtagcccatcatatgctagccaaagacttttcaacattgacctttttgcagtgtgaaagtactggttcagtttagacgtgacttagccaggttattgtgtttggagatattacctcattggctggtgctgagggtctggaaagctgttttggcagactgacgtgctctgcttgcattctaaccaacttgtctcacctcagtttttgaatcagagccga

SEQ ID NO: 175500 - DNA, 601 bp, Human
tctttaagctgcaaaattgcactttacttttttttccccagtgccaaacagtagcccatcatatgctagccaaagacttttcaacattgacctttttgcagtgtgaaagtactggttcagtttagacgtgacttagccaggttattgtgtttggagatattacctcattggctggtgctgagggtctggaaagctgttttggcagactgacgtgctctgcttgcattctaaccaacttgtctcacctcagtttttgaatcagagccgacaggcacttgaattgaaaatggaaaaccctactgctggtggtgctgcggtgatgaggcctatgatgcagccccaggtgagctcccaggtgaggatgataagcctctccacatgcattgctctgtgctcaggacagggcttggcctgtggttggctctcagtaaatgtttgttaaacaaatgaaggtaattctgaatttcttgtgtaagaaagcagtcgcattaaagactttcgactcttccattcttctctctggctggtgactgggaggaatcagaggagggagagctttcttcattaaaaccatcgattagtgtttttttaattggttccc

SEQ ID NO: 175501 - DNA, 601 bp, Human
ttcctgtcctgctttgtcagtctttttactagcaactcaaagatcattgtctttgttcaagtaatttagtatatttcgaaactgaaatctgaaactttgtacacagcgttttccatcttcacgctggtgatagcgaaccccataccatgttgaggattgtcagttttgttttggttggtttaaaaacattttttcattttaaaatatggtagctcttttaggctaccatgcctgttgggatgcactcagatttattcttgtacttttctttctttcttttctttcttttttttttttttttgagatggagtttcgctcttgtcgcccaggctggggtgcagtggcgtcatcttggctcactgtaacctctgccttccgggttcaagcaattctcctgactcagccttcagggtagctgagactataggtgcctgctaccatgcctgggtaatttttgtatttttagtagagacggggtttcaccatgttggtcaggctggccttgaactcctgacctcaggtgatctacctgcctcagcctctcaaggtgatagcattacaggcgtgagccacctcacctggcctgtttattgtctttttt

SEQ ID NO: 175502 - DNA, 601 bp, Human
acatttgttacttatttttttcacatcagatgggtaatgtgctgacataacaaggtttgagggaggcatgtctcacatataagcatgaaaccccaatcatcacccttacaaactacaaaaggatcacgtttccgatttttattgtttattagattaaaaaaaattttaagagatagggtcttgctgtacagtggtgcagtcacagctcactgcagccttgaactcctgggctcaagtggtcctcctgagtagctgggactacagatgcaagacactatgcttggctaatttttttttttttagagacagggtcttgctatgttacccagtctggttgaactctgggctcaagcgatcctcctgctttggcttcccaaggtgctggtattacaggtgtaacccgctgtgcccagccaacatttcttttttttaatatgaggataatagtcttaagaacaatagagaaaatattccctagcttccgtaaggtcttttgtattaataaacattaaatacatgttagtggggttgaatcaaataccctactatctgtagcaatggatagtattttagcttttttttaatagacattttcaaggac

SEQ ID NO: 175503 - DNA, 601 bp, Human
atagagatagatatagatatctagagagatatggatatctagagagatatagatatctagagagatagtatatagcagtatagttagggcttttccaagtaatgacttttgcaatctgtgtatcaacatttaccttaaatgaaattcagatgactgaattcttcaaagaattaaatactagaatgaccatcaagaagcagttctctaaattactaccacccagaaaaatgtttaaatgaagtgagtgaaatttaaaaactcccagtgatttcaggagtcttacagattcattattaaatgygccatctttcaagacaaaataaaccctcaggttaggaatcacatgaacaatttatctggatcaaaaaactggtggctgagttgagatacttgcagaataaccaggcagcttgttgaatgaatcttcttttaattataaaaaatttttttagagacaacgtcttgctatggagtatagtacctattcacaggcgccatcatagcacaccacagcattgaactcctgggctcaaatgatcttcctgcttcggcccccaagtagcagggactacaggcatgcaccaccatgctcagcttgagt

SEQ ID NO: 175504 - DNA, 601 bp, Human
caaatgcactgtctgcttggagagaagctatttgattcctgcacagctcctggggccgcctcccatacagtgttctgtgtgagtggaggccccagaaatctgcaccgagttggcccaggagacaggtgctcaggtgtgttagctggtcgtggtggtgggctctgtaatcccagctactctggaggctgaggcaggagaatcacttgaacctggaggcggaggttgcagtgagccgagattgtaccattgcactccagcctggtgacaagagtgaaactccgtctcaaaaaaaaaaaaaaamaaaaaaactgcaatggttttctttccttgttccatactgctttctgatttttgactgtttcactgtccttcctttatagacccctcttctgaagttacattatgttatagacaactccagatctttctctttagccccatatttaactgcccaggtgtctggtctcaccagcttgtcagactcctgatagtaaaagttgaactccaggacaggtgcggtggctcccgcctgtaatcccaacactttgggaggctgaggcagcagatcacgaggtcaggagatcgagaccatcttggctaa

SEQ ID NO: 175505 - DNA, 601 bp, Human
actgtctgcttggagagaagctatttgattcctgcacagctcctggggccgcctcccatacagtgttctgtgtgagtggaggccccagaaatctgcaccgagttggcccaggagacaggtgctcaggtgtgttagctggtcgtggtggtgggctctgtaatcccagctactctggaggctgaggcaggagaatcacttgaacctggaggcggaggttgcagtgagccgagattgtaccattgcactccagcctggtgacaagagtgaaactccgtctcaaaaaaaaaaaaaaaaaaaaaaactgcaatggttttctttccttgttccatactgctttctgatttttgactgtttcactgtccttcctttatagacccctcttctgaagttacattatgttatagacaactccagatctttctctttagccccatatttaactgcccaggtgtctggtctcaccagcttgtcagactcctgatagtaaaagttgaactccaggacaggtgcggtggctcccgcctgtaatcccaacactttgggaggctgaggcagcagatcacgaggtcaggagatcgagaccatcttggctaacacggtg

SEQ ID NO: 175506 - DNA, 601 bp, Human
atctcagactaaatgagaaagactaaaaggtacacagcacagtatttgacatgtaagtgctctgtaaataacaacacaacacttccgagcatttcctgtaggcagtgttagaaacttcataaactttgcatatattaactcatgcagtcttcacaatagtcctataaggaaggcgggaaataatatccccagagtttaggtaactgtccaaagtttctacttcctaagtgggacccagaaactgccctagtatcttcatgctgtagttttatttcctattctccttttttttttttttttwaaaaaaatagagacaggatctcatgctgttgcctaggctggtgtgcagtggcatcatcatagctcactgctgccttgaactcccagtctgaagtgatccttttacttcagccctctgagcagctaagaccacagcataggcacgtgccacaatgcccagctttttaaaaaaaatattttgtagagatggagtcttgctctgttgcccaggctggtcttgaacttctgggctcaagggatcctcctgcctcggcctcccaaagtggtgggattaccggcatgagctacagtgcccagccct

SEQ ID NO: 175507 - DNA, 601 bp, Human
tctcagactaaatgagaaagactaaaaggtacacagcacagtatttgacatgtaagtgctctgtaaataacaacacaacacttccgagcatttcctgtaggcagtgttagaaacttcataaactttgcatatattaactcatgcagtcttcacaatagtcctataaggaaggcgggaaataatatccccagagtttaggtaactgtccaaagtttctacttcctaagtgggacccagaaactgccctagtatcttcatgctgtagttttatttcctattctcctttttttttttttttttwaaaaaatagagacaggatctcatgctgttgcctaggctggtgtgcagtggcatcatcatagctcactgctgccttgaactcccagtctgaagtgatccttttacttcagccctctgagcagctaagaccacagcataggcacgtgccacaatgcccagctttttaaaaaaaatattttgtagagatggagtcttgctctgttgcccaggctggtcttgaacttctgggctcaagggatcctcctgcctcggcctcccaaagtggtgggattaccggcatgagctacagtgcccagccctt

SEQ ID NO: 175508 - DNA, 601 bp, Human
aaactttgcatatattaactcatgcagtcttcacaatagtcctataaggaaggcgggaaataatatccccagagtttaggtaactgtccaaagtttctacttcctaagtgggacccagaaactgccctagtatcttcatgctgtagttttatttcctattctcctttttttttttttttttaaaaaaatagagacaggatctcatgctgttgcctaggctggtgtgcagtggcatcatcatagctcactgctgccttgaactcccagtctgaagtgatccttttacttcagccctctgagyagctaagaccacagcataggcacgtgccacaatgcccagctttttaaaaaaaatattttgtagagatggagtcttgctctgttgcccaggctggtcttgaacttctgggctcaagggatcctcctgcctcggcctcccaaagtggtgggattaccggcatgagctacagtgcccagcccttcctattctacttttaaaatcagtactaggatcaataatggattagattagattataatataattagtatacatctaattagcacataatgaatatacatctaactaatacattggtttg

SEQ ID NO: 175509 - DNA, 601 bp, Human
ggaaataatatccccagagtttaggtaactgtccaaagtttctacttcctaagtgggacccagaaactgccctagtatcttcatgctgtagttttatttcctattctcctttttttttttttttttaaaaaaatagagacaggatctcatgctgttgcctaggctggtgtgcagtggcatcatcatagctcactgctgccttgaactcccagtctgaagtgatccttttacttcagccctctgagcagctaagaccacagcataggcacgtgccacaatgcccagctttttaaaaaaaatwttttgtagagatggagtcttgctctgttgcccaggctggtcttgaacttctgggctcaagggatcctcctgcctcggcctcccaaagtggtgggattaccggcatgagctacagtgcccagcccttcctattctacttttaaaatcagtactaggatcaataatggattagattagattataatataattagtatacatctaattagcacataatgaatatacatctaactaatacattggtttgctcaggctctttgttttccagatcaagaaactgagacctagaagctaaataactt

SEQ ID NO: 175510 - DNA, 601 bp, Human
tctcacatccttggggtgaatccatctggtacctccaaattgttttcttgcttctcttagtctttctttttttttttcttttttgagatgaagtcttggcccaggctggagtgcagtggtgtgatcttggttcactgcatcctccacctcctgggttcaagtgattgtcatgcctcaacctcccgagtagctgggattacaggcccttgccaccatgcctagctgatttttgtatttttagtagagatggggtttcgccatgttggtcaggcttgtcttgaactcctgaccttgtgatccrcccgctttggcctcccaaagtgctcggattacaggcgtgagccacctcgcccagccctcctaatcttgatgcagttagatttcagtcgtgtttctgggcctattggaaagatgagcttggattctgtcttggctggggcgctttgttgctgtgtcatgtcagccacagtgcttaacccctgagatatcatgccctcacaggtcagatgtagatggaaccccatcctcacagagcatttgtaaggtgcttagcacagggtccagtccttggcacttgcccaataattctttcctggtcttt

SEQ ID NO: 175511 - DNA, 601 bp, Human
aggctggagtgcagtggtgtgatcttggttcactgcatcctccacctcctgggttcaagtgattgtcatgcctcaacctcccgagtagctgggattacaggcccttgccaccatgcctagctgatttttgtatttttagtagagatggggtttcgccatgttggtcaggcttgtcttgaactcctgaccttgtgatccacccgctttggcctcccaaagtgctcggattacaggcgtgagccacctcgcccagccctcctaatcttgatgcagttagatttcagtcgtgtttctgggcctmttggaaagatgagcttggattctgtcttggctggggcgctttgttgctgtgtcatgtcagccacagtgcttaacccctgagatatcatgccctcacaggtcagatgtagatggaaccccatcctcacagagcatttgtaaggtgcttagcacagggtccagtccttggcacttgcccaataattctttcctggtcttttcacaatattgtccaacaatggaaagtgtcatttgggccatgaagtccttagctcctggtgccactttccacaaaggccagtgaagcccctgtccaggttac

SEQ ID NO: 175512 - DNA, 601 bp, Human
gttgctgtgtcatgtcagccacagtgcttaacccctgagatatcatgccctcacaggtcagatgtagatggaaccccatcctcacagagcatttgtaaggtgcttagcacagggtccagtccttggcacttgcccaataattctttcctggtcttttcacaatattgtccaacaatggaaagtgtcatttgggccatgaagtccttagctcctggtgccactttccacaaaggccagtgaagcccctgtccaggttactcatgcagagctggctggtgggattcccttctggtggtgcacygaagctttctgtctgggacaactgtgttctgtgagctgatgaattttcagcaaatccaatagttggttgatggaaagtgtgtgtgcagaaactgctgagaaaattagcctttaaagtgagtcttcagaagtataactttcattaaatgcttttttttagacggaaaatgaagaaaatgttcttatttgtctaagaataattattgagctacacaaacagttcaggccaccgatcacacaagaagtaagttgtttaaaatccttatagcatttataaagtgtgtcaacatgttccttctgt

SEQ ID NO: 175513 - DNA, 601 bp, Human
tgaccttttgggtgtcattgatgccaggctagaaagataaggttgttgttgaaacccagaatcaccctgctgggaagagcagcagaccaggtgtggggtgtctgttctgtcccttagctttgagtcttttgacattaataaagtcccttaaactatagataaaagcatatagctcagtgactgagagtgtgggctctaggacagagagctccagtacaatgtcctggccccactggggttttctgactccaagaaagttaatgaacctgcgttctgaccttatttttcctctcattatctraaaaacctgtctcacggactttgtgaaggtaatgctggcatggtccgcaggtaatgtatcgtatatttgtggtgtctgccacataggtaacatgttttgagcacttactatgacaatttttgtgattgaattattatccatgtttgtttttctgaaatggttgtgcagagtgtttcagttgtgctaggatgaacaagaaactttgagtaacgctttcctccttttgttgttcttagttagaaatttgttttctgagtatcattcctttgtattttcttttttccttgtctgttgatatcc

SEQ ID NO: 175514 - DNA, 601 bp, Human
ctgccacataggtaacatgttttgagcacttactatgacaatttttgtgattgaattattatccatgtttgtttttctgaaatggttgtgcagagtgtttcagttgtgctaggatgaacaagaaactttgagtaacgctttcctccttttgttgttcttagttagaaatttgttttctgagtatcattcctttgtattttcttttttccttgtctgttgatatccattgcccatctgtattttgagcctgacattttccttgtttcatgagtccttatatattaggactgttgaacttttstatattgtaagcattttctgtttataaatatctttgaataaaactgctgagtaaattgtactttgtgctgttcttttaaataagtgaagtcataggcattcattttaaaaatttctcagatgatttgaatctccaagtttggacatagtttcctgaactttttacaaatgattatgtagaaaaatatgcaaacctttaggccgggcacggtagcacacacctgtaatcccagcacttcgggagaccaaggtgggcagatcacctgaggtcaggagtttgagaccagcctggccaacatgg

SEQ ID NO: 175515 - DNA, 601 bp, Human
tattgctcattagtctcttgggttttgggcttcttataagaaaattggcatctggggccaaaagatgtgtataatacacacatgctaaataatgtgatgattcttcggtatgccagattttgtcgccatagcagagtgtcaatgtatgaaaatctggtatgtttgcttttagctctacaaactgaacatccacaatgttgttgctgagtttgtgcccttgatcatgaacaccattgccattcaggtgtctgcacaagcgaggtgaggcgtcactgtagccggctgccacagtgcctggattccaagtaaaaatacacttgctgttgtcattcttaagacatgaaaattatgagtgataaaattttggtaaaattatatgcactgttgactttctgcacctgtgtttcagggatgacagttgtagctattttcgttcttaatttggaaagatgagataatagctcgtattctggtgcgttgtaaattaaaaatgtcgtcaggcattaccgtgctcaatgacagctatggcatgtccaagccttgctcaccttcaagactttgttcttgctgattgttcagcttgagtgctagaatgttcttt

SEQ ID NO: 175516 - DNA, 601 bp, Human
gcttttctgaggagactgtatggtggatttttgtttcattttttcatgcatagttgtgttcttatttaaatcatgagaacttgaaggaaaaaataccttatctccttttagtgtttttgaaaagaattcttatatgattgttctatagtatggaataaattcagtactgatctatatcaatggaattggattataatttatgctttttgtatggcttttatttcagaaaaataaaaattaaagagctgaattgtttagaataaaaactacttttgaaagcatttgtaatcttttccccctkaattttaatgcatatgattagataatgatagcttacatgaagaaaatggaactggaacatttggtgtaaaaagtcaaattaggtaccccttgacattttagtcagcttgcgttatcttggtgagtggccttctgctgacaccgcaaaagaagattgtgattagagcctgttctgagttggctcaagttgactccactgttgttcacaacttacattaatgggatgactaagtaaacaagtaattaccttaaaaaaaatcttagaagcctggcatggtggctcatgcctataatcccagca

SEQ ID NO: 175517 - DNA, 601 bp, Human
gtaaaaagtcaaattaggtaccccttgacattttagtcagcttgcgttatcttggtgagtggccttctgctgacaccgcaaaagaagattgtgattagagcctgttctgagttggctcaagttgactccactgttgttcacaacttacattaatgggatgactaagtaaacaagtaattaccttaaaaaaaatcttagaagcctggcatggtggctcatgcctataatcccagcaggtgggaggattgcttgagcccaggagttggaggccagctcgggtaacatagcaagacccccattyctaaaaaaaaaaaaaaaaaaaagaaaattaggcatggtggtatgcacccttagtcccagctactgaggtgggaggatggcgtgagcccaggaagtcgagggtcacttgagtcaagcttagtcttaacgattttttttttggagacaagagtctcactctttcatgctggagtgcagtggcttgatcttgcctcactgcaaccttctcctcccaggttcaagtgattgttctgcctcagcctcccaagtagctgggattacaggcatgtgccatcacacccagctaatttttgtattttta

SEQ ID NO: 175518 - DNA, 601 bp, Human
gaccctcaatagctacgagctggtgggaaatgtactttatttgacttactgcagctggctttatgtcaggcttattccagaacctgaacaccctttgggatgattgtattaatagaactccccaggggaagtgtggacatgctgtcgctgccccatctgcacatcctcagaagcctgaattgtccctgagtggtgaccggttgtttctatagaaccctggttaggttcaggcctgcaaggacgcagagagtaagtttaggggtggttccacctgcaggaatagagcaagagaggaaccccrgtggggattctgatgagcatcatccagggaatgcagaaccgtaacctgggactcatgcctgtgagaacattgtaaaaacgcctggacctttgtaatttacatagagaaacatcgttaggtcttctcaatatgcttcagggtagtaaaggggcatttaggagatcctgttcccttgtccaaactggttgggagggtggtgacaatgtttaaggatggtgggatgtgcccacagttaagtatcagaggtgggatctctgccaggggacaccaagctgatttattcttaatttgatctctgac

SEQ ID NO: 175519 - DNA, 601 bp, Human
cgaaagcactgtaaagtaatttaatgtgtgtaattggttttgttagtgatctgtgcaatggatgtttgtcttctagagttcattccttgcatggacaagctgtttgatgaatccatactaattggctcaggatatactgccagagagactctaaggtatgagattaaaccagtgatatctggttggttaaatgccaggagcatcagttactggcacttcatgttacaagtgtttcaatgaacaccggctgttgagccttgacacacctgttaggttagcaagtgcaggatttttgtttttkttttatttatttatttatttatttatttatttattttgaggccgagtctcactctgtcacccgggctggagtatagcagtgcaatcttggctcactgcaactctgcctcctgggttcaagcaattctccctgcctcagctgcccgagtagctgggattacaggtgcctaccaccatgcctggctaatttttgtatttttagtagagatggggtttcgccatgttggccaggctggtcttgaactcctgacctcaggtgatctgcctgcctcagcctcccacagtgctgggattacaggcg

SEQ ID NO: 175520 - DNA, 601 bp, Human
gcacggtggctcacgcctgtaatcccagcactttgggaggccgaggcgggcagatcacctgaggtcgggagtttgagaccagcctgaccaacatgaagaaaccccttctctactaaaaatacaaaattagccaggcgtggtggcgcgtgcctgtaatcccaactagtcgggaggctgaggcaggggaatcgcttgaacccaggaggtagaggttgcagtgagctgagatcatgccattgcaatccagcctgggcaataagagtgaaactctgtctcaaaaaaaaaaaagtagtgataatggttactatttctaaagcagaaaattaacatttaatcatctttacattataaaatgaatcaatgtttgtcatattttacttccaataaggaaggcgtgatggatcttttaaaaaatgtttaggttcctttgaatatgatgcagttttctcactgttttctatagacaatgttataaaatattaagacattttttgtaacttggggttgaacttgcctagaattggacgttagattatgttactcctgctcgaagccctccagtggctttctgtagttcttagagaaaacccaaactcttgac

SEQ ID NO: 175521 - DNA, 601 bp, Human
gcgagcaggagagtggcaatgggagagacgtcctgatgcggatgctggaggtaccagctcttctgagagtatcatccatcctgcactctatcctgtttgtggctaaattttttttttttttttttttttgagacagatccttgttctgttgcctaggctgaagtgcagtggcgtgatctcagctcactgcaacctctgcctcctgggttcaagtgattctcatgcctcagcctcccaggtagctgggattataggcatgcaccatcatgcccaactaacattttgtattttagtagagacwgggttttcccatgttgaccaggctggtctcgaactcctggcctcaagtgatcctcctgcctcagcctcccaaagtgctgggattacaggcgtgagccaccatgccggacttgtggccaaacttgaaccagtgctgtaggggcggcttgatcgctaggcttgatcccaggagttagaccacctaggttcagacccaggctccccagatgcttcacttctgtgcaccagttttttcatcttttcacttggggtgatgatatctgcctcataggatcgctgtgggagttaaatcaggcagcgc

SEQ ID NO: 175522 - DNA, 601 bp, Human
agcaggagagtggcaatgggagagacgtcctgatgcggatgctggaggtaccagctcttctgagagtatcatccatcctgcactctatcctgtttgtggctaaattttttttttttttttttttttgagacagatccttgttctgttgcctaggctgaagtgcagtggcgtgatctcagctcactgcaacctctgcctcctgggttcaagtgattctcatgcctcagcctcccaggtagctgggattataggcatgcaccatcatgcccaactaacattttgtattttagtagagacagggttttcccatgttgaccaggctggtctcgaactcctggcctcaagtgatcctcctgcctcagcctcccaaagtgctgggattacaggcgtgagccaccatgccggacttgtggccaaacttgaaccagtgctgtaggggcggcttgatcgctaggcttgatcccaggagttagaccacctaggttcagacccaggctccccagatgcttcacttctgtgcaccagttttttcatcttttcacttggggtgatgatatctgcctcataggatcgctgtgggagttaaatcaggcagcgcttg

SEQ ID NO: 175523 - DNA, 601 bp, Human
ggacaaggaagacaagcagacattccaagtcacagactgtcgaagtttggtcaaaaccttggtgtgtggtgtcaagacaatcacgtggggcataacatcatgcaaagcacctggtggtaattctgctcttcagttatgtagacaaacaatagttttcataaagtgagttttattcaagttaacttaatatactttctcttttccagaagctcagttcattcccaacaagcagttacaacccaaagagacacagatttacatcaaacttgtgaaatatgcaatgcaagctttagatatttaycaggtaaggaagtgccctccagccaggctttcgcatatggaaagtacctcttagtattagaggtcatagtggtggggtggcagtgagagctgttagtatttggatggtccacagtatttgtatacccagatgtgttttgttccacaacatagcactgcgtttatgtgggaattcttatttataagagtctgtgcatttttgaggggcagatagtgtaaacggaatgcaataaaaatataagacttaagtttaataatttttttcatggtctgaacacctagaggttttttttttttaatt

SEQ ID NO: 175524 - DNA, 601 bp, Human
ttgggaaaatctgaagatgtaaataagatctgtgcatttggagtaattgcacagatggtgacacagagctccagtaacctgtgctttccttgttttcttttcacagttctatagtaattacttatcaacaaccttaacttttgtgttaatataggagagtactagtcaggcgtggtagcttacacctataatcttataattctagcacttccggaggctgaggcaggaggattgcttgagcccaagagttcaagaccagcctgggcagcatagtgagaccctatctctacaaaataatttwaaaaaaaattagctggatgtggtggtgtgcacctgtagtcccagctactcaggaagccgaagagagaggatcgtttgaatgagccaggaggttgaggctgcagtgcacttcagcttaggtgaccgagtgagatcctgtctccaaaacagaagggaaaatacttatttttaaatttaaagatataaaataattataatctgtgtcctcatataattcattatcctcaaataattcatttttttgccagcattagatatgactatgcagaacaacagcaaaaaagcccagaataaaacctat

SEQ ID NO: 175525 - DNA, 601 bp, Human
agagcatgtaggtgaggcagaatctggtttaacccagcaaatcttccacaagaggctctccgagctcacttagttcctgtaatctgccattggctatttgaacatgaaattgttaaactccatcttggcattttaatttgaactgtgcaattccttgttttgtaatacttccaccgcctcttttggaagcttcaccaggtgaatacctattaaagctgtattaaagctgtattgtattaaagctgtaaagtgtgtacccactgtgctctcttcaaaagaaaatatgcatgagactggtgcygtggcttagttggttaaggcgcctgtctagaaatgtgcattaagattcttctgggtgattgagaccatcctggctaacacagtgaaaccccgtctctactaaaaatacaaaaaaaattagccgggtgtggtggctggcacctgtggtcccagctactcgggaggctgaggcaggagaatggcgtgaacccgggaggcagagcttgcagtgagcggagatggcaccactgcactccagcctgggcgacagagcaagactccgtctcaaaaaaaaaaaaaaaaaaggttcttctgggtgtgg

SEQ ID NO: 175526 - DNA, 601 bp, Human
atgcatgagactggtgctgtggcttagttggttaaggcgcctgtctagaaatgtgcattaagattcttctgggtgattgagaccatcctggctaacacagtgaaaccccgtctctactaaaaatacaaaaaaaattagccgggtgtggtggctggcacctgtggtcccagctactcgggaggctgaggcaggagaatggcgtgaacccgggaggcagagcttgcagtgagcggagatggcaccactgcactccagcctgggcgacagagcaagactccgtctcaaaaaaaaaaaaaaaaaaggttcttctgggtgtggctgggcgcggtggctcatgcctgttatcccagcactttgggaggccgaggcgggcagatcacgaggtcaggagatcgagaccatcctggctaacacagtgaaaccccgactctactaaaaatacaaaaaacttagctgggcgtggtggcgggcacctgtagtcccagctacttgggaggctgaagcaggagaatggcgtgaacccgggaggcagagcttgcagtgacctgagatacgcgccactgcactccagcccaggcgacagagcgagactccgtctcaa

SEQ ID NO: 175527 - DNA, 601 bp, Human
actccagcccaggcgacagagcgagactccgtctcaaaaaaaaaaaaagattcttctgggtgctgcagatgctttcagtgaaagcttttcacaatcatgtaatttcagcacaaactgtagtttctttgtgtcttggttgtaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaagtatgtyggccacttccttctgtgtggttgggtggatcctgttttaggaattggggctgcagagggcctcccaggtttcctggtgctaggagcaggctccttgaagtccagcagatgccatattatctacctactccttcttgttggggccttagagaaaatggaaaggagaactgggtgcttgagaattagaagggatcacagttgtcgcctgcctttattgtgtcttgtcacctcctccattagtttgtaagtgtgaagaaatcaagggtcatgtcccttctccctccctttgtctcaccattct

SEQ ID NO: 175528 - DNA, 601 bp, Human
gctttcagtgaaagcttttcacaatcatgtaatttcagcacaaactgtagtttctttgtgtcttggttgtaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaagtatgtcggccacttccttctgtgtggttgggtggatcctgttttaggaattggggctgcagagggcctcccaggtktcctggtgctaggagcaggctccttgaagtccagcagatgccatattatctacctactccttcttgttggggccttagagaaaatggaaaggagaactgggtgcttgagaattagaagggatcacagttgtcgcctgcctttattgtgtcttgtcacctcctccattagtttgtaagtgtgaagaaatcaagggtcatgtcccttctccctccctttgtctcaccattctgtccacagcagctggcgcctgaaaggcatgcagtggaccctctgcattttcatttcacagtgatctttct

SEQ ID NO: 175529 - DNA, 601 bp, Human
atacttctgtgtccaagtgctttgggacaagctgcctgtgaaacagacagtttgtgttcatactcactgctcaccttcctctgcctggctgtgttttccaaggccagtcttgccctccagaaacttctccatcacctgctccctgctctccaacccatgcctcgcagtctcccctgcgatgcccgtttctgctcccaggatcctcattctgctgttcctcctgcctggaacggctgctcacctccgtttcagtggctctcacactcttggtggtgaagggccacttgtatttgttcacttktatttccgatccattgtaggtgatgtctttgtaaaagacaataaaaatggccaggcacggtggctcacgcctataatcccagcactttgggaggccgaggtgggcggatcactgaggtcgggagttcgaaaccagcctgaccaacatggagaaatcccgtctctactaaaaataccaaattagctgggcatggtggtgcatgcctgtaatcccagctactcgggaggctgaggcaggagaatcgcttgaacctgggaggcggaggttgtggtgagcagagatcgtgccattgttccagcc

SEQ ID NO: 175530 - DNA, 601 bp, Human
gctcaccttcctctgcctggctgtgttttccaaggccagtcttgccctccagaaacttctccatcacctgctccctgctctccaacccatgcctcgcagtctcccctgcgatgcccgtttctgctcccaggatcctcattctgctgttcctcctgcctggaacggctgctcacctccgtttcagtggctctcacactcttggtggtgaagggccacttgtatttgttcacttgtatttccgatccattgtaggtgatgtctttgtaaaagacaataaaaatggccaggcacggtggctcaygcctataatcccagcactttgggaggccgaggtgggcggatcactgaggtcgggagttcgaaaccagcctgaccaacatggagaaatcccgtctctactaaaaataccaaattagctgggcatggtggtgcatgcctgtaatcccagctactcgggaggctgaggcaggagaatcgcttgaacctgggaggcggaggttgtggtgagcagagatcgtgccattgttccagcctgggcaacaagagcgaaactccgtctcaaaaagaaaaaaaaagacaaaaaaaatgtcatgccactgcc

SEQ ID NO: 175531 - DNA, 601 bp, Human
tgtcttctgatttggagggtgtctgtacctgagagtggtccttctagaaactgatagtttaagaattgcggccagacgcagtggctcacgcctgtaatcccagcactttgagaggccaaggcgggcggctcacctgaggttgggagttcgagaccagcctgaccaacatggagaaaccccgtctctactaaaaataaaaaaaattagccaggcgtggtggcgcatgcctgtaatcccagctactcgggaggctaaggcaggagaatcacttgaacctgggagatggaggttgcggtgagcygagatcacaccattgcactccggcctgggcaataagagcgaaactctgtctcaaaaaaaacaagaattgcagtaacgtgttgtggtttgttcattttcctctccaggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactgg

SEQ ID NO: 175532 - DNA, 601 bp, Human
ttatttagagcatgattcctaatcactgcactgtccagccgagttcttattttttttagtggacttgatttgtcccttgacccaaacacggaccctggcagatggcatcttatgagtatttgtcactgtaaacattccagtgtggggtgctattagtctgacaaacaggaatgaaactgtgggtgttgccaaattataagcaacatctttagaatacagtagtggtctggtgatcagataaaatttaaaatttttatgggacatgaatcacacttgcagaggcattgtcagagtataccgyggcaaaaatcagaagaaagcaaattcttccaggtccatactgtctgaatttctgattatgaaaatttacctcttgacattttaaggtcctgtttttgcttggacatatggttataggatcatatgatctggctctgatctttataccttatcatttgtaaggcttgacagaaggtcaagacctttaggaaatgcataacttcccttggctgatctagagacagatgtattttaacctgcatggaaaactcctcactgcacttaagaccagagcctggcagtattgagggcatgaaactgg

SEQ ID NO: 175533 - DNA, 601 bp, Human
agtataccgtggcaaaaatcagaagaaagcaaattcttccaggtccatactgtctgaatttctgattatgaaaatttacctcttgacattttaaggtcctgtttttgcttggacatatggttataggatcatatgatctggctctgatctttataccttatcatttgtaaggcttgacagaaggtcaagacctttaggaaatgcataacttcccttggctgatctagagacagatgtattttaacctgcatggaaaactcctcactgcacttaagaccagagcctggcagtattgagggcrtgaaactggttttccagatgtctctcagtgcctggctgcatcagaacacgtgcggatcttttgaaaagcatggactcgagtcctttccttggagattcaggttcagtccatttgggtgagacctgggaatccactgtctgaaagcttcccaggtgatgctgtgtggctgtgttggggttttgttttgtagttgacttctctctctccatacctgcacgcatatatacacgcatgcccttatatgtgaggagagtatttttgaaggtcatacaaggccctagcaacagtggtttcctctgg

SEQ ID NO: 175534 - DNA, 601 bp, Human
cctccttcctgttagccattgtgggtgctacttttgctagaatgaatgttacctgtcacctgacatagaaggttgaggtgtgtctccttccctaagaatatttgccttttgaaagtcttaaagccttttaccctcaaagctgggtagtgaagaaaggctgggctgtgtgtgtctgtcccctgcattgcctgtcactggaggaccagagaccgtgccatcagccttgttcagatgggcctgtcctggatccagccaccccattaccctatgaaggtgtcctgggataggggtgtcagtgggktctctcttcttccccctcaagctttcttcttctcatctgaagacgtaagatttatcatggcttttctggcaggctggacttcactcttagattatactcaacatgtggatggaagaccatgtgtacttttgtctttctcagggccaaacactaggaaagagggctcgtggttcatattttttgctggttggtaggagcctttgggaaagaaaattcagccgggggcagtggctcacagctgtaatcctagcactggggaggccagggcaggagaatcccttgaggccaggagttagagat

SEQ ID NO: 175535 - DNA, 601 bp, Human
ctgtggtcccagcttcttggcttggaggctgaggtgggaggatcacctgagcatgggaggcaaaggttgcagtgagccgagatggcatcactgcaccccagtctgggtgacagagcaagaccctgcctcaaaaaataaataaataaaaacaatgcattcagatggcttaaaattgaaaaggtgtaaaaggatgtactgcagaaagcctccctcccaccctgtcctccagctacccagtcccctccctgagacagccagggttaagactttgttgtgtatccttttagagatgttttatatrtgtaagaggacatatgtgtatatattttttcctataaaagggggtacaatatatatatacacagtccttgcttttcccatttaacagccatcatttcatgtcagtacctgaagtacttcattctgctttatggctgcagaatacctcatgacatgaacttgccataatttatttaaccatggcctcactggtgaacatttagattgttcccagccttttcattatataccatgatgcactgaaagacttgttcataatttcacatgcttttatctgtggtgtacatttctagttgtagaa

SEQ ID NO: 175536 - DNA, 601 bp, Human
gcaaaggttgcagtgagccgagatggcatcactgcaccccagtctgggtgacagagcaagaccctgcctcaaaaaataaataaataaaaacaatgcattcagatggcttaaaattgaaaaggtgtaaaaggatgtactgcagaaagcctccctcccaccctgtcctccagctacccagtcccctccctgagacagccagggttaagactttgttgtgtatccttttagagatgttttatatatgtaagaggacatatgtgtatatattttttcctataaaagggggtacaatatatatattcacagtccttgcttttcccatttaacagccatcatttcatgtcagtacctgaagtacttcattctgctttatggctgcagaatacctcatgacatgaacttgccataatttatttaaccatggcctcactggtgaacatttagattgttcccagccttttcattatataccatgatgcactgaaagacttgttcataatttcacatgcttttatctgtggtgtacatttctagttgtagaatttctggatcaaaagaatgtatgcattttaatctttcaacaccttgtcaaattgctctc

SEQ ID NO: 175537 - DNA, 601 bp, Human
aattgaaatgtaagcggatggaggatttcatctgttagctttcttttgcattcaattttgcttctggtaaatggatttataaataataaacaggatttaatggtccaccactgcaaacatgaatgtatttttcatgcttatgtttcccaagtagcctttgaccatttgacgttttaagatactggagctacttttttatttttggtgtacctttcccccaactataaacaggagtttatatctactgatggacagataaggtagagattgcattatgtagagagagatattgcaggtatgratacattgtgtgtgatacagtgtatcacagtgcacagatacattgtatttatctacacatggaatgtagagaaatctctcatatatgaaagacacgtagctttttacctcatctatatgctagtttcttcatatctacaagtacctaaataataatgacccaaatactaaaattgtaagttatgccctaataatacattataattgaaaaacaaagtataatatggaagtgaattttccaaattggggactttcaccttaagcttccaaatatatgtaatacacatacacacctatcagt

SEQ ID NO: 175538 - DNA, 601 bp, Human
tcaccgtgttggccaggctggtgttgaactcctgacctcaagtgatccacctgccttgacttcctgaagtgctgggattacagatgtgagccattgtgcctggcctgtttgtttgtttatttgtttatgagacagagtctcactctgtcacccagactggagtacagtggcgcgatctcggctcactggaacctctgccacctgggctcaagtgattctcctgcctcagcctcccaagtagctgggattataggcacctgccgccacgcccagctaattttttgtatttttagtagagacrgggcttcgtcatgttggccaggctggtcttaaactcctgacctcatgtgaaccactgcgcctggcccagcctgtttatttttagtccccagtctaacccttcagacctgctgtgagctgggaattcattcagtgaacattgttacccagatttttttttagtgcagtacgaagacagctgccttaatgtctgtagtttctgaccaaggccagtgttctttctgcctaaaataaatcacatgggttttgtgttaatggttcatttaggtgaattttttcctcccttttctgctctctgagt

SEQ ID NO: 175539 - DNA, 601 bp, Human
ttgaacaacgcagggtaataaatatgcaactgttattgaatgctcttcttgtggttttagctttaaggcccgggcatttgtctgcctggttttgctggacacagaggctggagcctggctaccaggtgcctgggttaagctaaagtctggggtctcttcccatacacttaaatgcagagtctcttgctgaagcatggccctcattctgcagagggaattgtggccctatggcactcacttgcacagttcctgaccaagtggggtccacatctatctcaccagccccttccctagggtcccsattgtgcccactgctcccccgcgtggccaccgttccttctgtgctgtcagggcctttgccctcctcttctctctgcccttctgcttctggcattcctgccttctctagtcccatcctcagcaggaggaccccgaccccctcctttctcatccagagctggttcctgtcttcctcttacaacaccgtaattgtagctacacacagcaggcacctttatgtttacctttttcctcatcagaccacgggctccgcaaggagagggacatcatgacagggatgatgtcggccgttcatgtctct

SEQ ID NO: 175540 - DNA, 601 bp, Human
tgttgtcgttgctggttttgctgtgactcgttagctgtgtcgtggttctgtactggacagagtgcgttgtgcccttgagtgcagtgacctgtattgtctgtctgtggcagagttgtatcagtatcattgctgtgaactgtctgatgccaagcatgttttctattaggatgttttaagcaagactcttaagttcgtgtgagaattgcaatgtctcaattatattcaagattgaattagattttgtgttcgtaacctctatctgaatacacatagctagcaacctcctgagaggaaactcacagagtatattgtgcctgctagaagtgggaggaattacatgttctttcacactactgactgccctgaatttaaaaccttacagcttgtcccactcacccacccagtccccttcatctccctcttgcgtgcacacacaccacacatgcacacacaccgatgcactcacaacacgcgtgcacacagaccacacgtgcactcacaccacacatgcacacacaccacacatgcacacacaccagtgcactcacaacatacatgcactcacaccacacatgcacacacaccacacgcgcacacacca

SEQ ID NO: 175541 - DNA, 601 bp, Human
cttgcgtgcacacacaccacacatgcacacacaccgatgcactcacaacacgcgtgcacacagaccacacgtgcactcacaccacacatgcacacacaccacacatgcacacacaccagtgcactcacaacatacatgcactcacaccacacatgcacacacaccacacgcgcacacaccacatatgcacacaacacatatgcacacacaccacacatgcacacacaccacaatgcactgacaacacacatgcacacacaacacacatgcacacataccacacatgcacacacacactgakgcactcacaacatggtgcagcattgcacacaccccgagctttccctcttgtgtaaaatggggatgatggcatctgttactcctgcctcccagtggtgttgcaaagacccaaagaagtggtttctgtgacagtgctttgaaaatgaaaaagcagattgtaaaagtaccattttagaatgttataatttcaggatagaacttactcttcctaagtcttgcagattctggggaagagaattgtagggggcatggagctggccttgagcccattttcctcattttgtctccatctcctgctttg

SEQ ID NO: 175542 - DNA, 601 bp, Human
caccacacatgcacacacaccgatgcactcacaacacgcgtgcacacagaccacacgtgcactcacaccacacatgcacacacaccacacatgcacacacaccagtgcactcacaacatacatgcactcacaccacacatgcacacacaccacacgcgcacacaccacatatgcacacaacacatatgcacacacaccacacatgcacacacaccacaatgcactgacaacacacatgcacacacaacacacatgcacacataccacacatgcacacacacactgatgcactcacaacatkgtgcagcattgcacacaccccgagctttccctcttgtgtaaaatggggatgatggcatctgttactcctgcctcccagtggtgttgcaaagacccaaagaagtggtttctgtgacagtgctttgaaaatgaaaaagcagattgtaaaagtaccattttagaatgttataatttcaggatagaacttactcttcctaagtcttgcagattctggggaagagaattgtagggggcatggagctggccttgagcccattttcctcattttgtctccatctcctgctttgccttttggtgtaaa

SEQ ID NO: 175543 - DNA, 601 bp, Human
caggagcaaaactggaaagtgagaagggaaagctggagcaacagcagcccacccctgagctgtgagacagtagaacatgcagcacccttggcatttcacacatctttgatttaattcagcggagcagtttgtcagctttatttttaggcctggttgacaaatacttagtaccaggatcagttgtttatatacattgatatttaatttccagggtaaatagttaattttttgaagaactttctctgctagggttttttttgtttgtgtggttttttttttcttttctttttttttgagaccrggtctcattctgttgcccaggctggagtgcagtggcacgatctcagctcactgtaacctccgcctcctgggttcaagcagttctcctgcctcagcctctggagtagctgggactacaggcgcccgccaccacgctcggctaacttttgtatttttagtagagacggggtttcgccatgttggccaggctggtctcgaactcctgacctcaggtgatccacccgcctcagcctcccaaagtgctgggattacaggcatgagctaccacactggccactgctaggttttgagggcaaaagac

SEQ ID NO: 175544 - DNA, 601 bp, Human
ttttgagggcaaaagacatctgtgcccttagaacttagtgtgttgagaggacctcgtgataccttggcaaagtagggcatcctcacactgctctggccccaggtggaatcatccctgcttctgtgaggggactattatggcagcctggtaaggtcacctttaccacttgtgagcacgcatgacagcaaacagcacgatcacatcgggtgtacaccgtcggcccctccacacccctacaatggacaggaatgctgaaggccacgggcagtcagtttccttaggacacagcacagttagaacytaaggctagtaagttgtggcttttacatgtgaacccttcgcttcactgcctagccttgccaacatagttagactatagtagggtctgtagtgacgttgacctctgtcacttgcaaaattaatcgacctgtttataatttctggttttcttgatcaggaaatgaagatttgctcagcaattataaacctttttcatctgatcccggctgctcctcagacactggtgaagcctttgctagaggttgtcatgaaaacggagcgggcgatgctgatcgaggtaagggccatactgaaggctgct

SEQ ID NO: 175545 - DNA, 601 bp, Human
taatcccagcacttcgggaaactgaggcaggtggtttacttgagcccaggagtttgagaccagcatgggcaacagagtgagaccttgtctttacaaaaaatatgaaaattagccgggcacggtggcacatgcctgtagtcccagctcctcaggagcttgaggtgggaggattgcttgagttcggagttggaggctgcagtgagctatgattttaccactgcacttcagcctgggcaatagacccaagactctgtctctttttaaaaagaaaaaaaaaaagcatctttttaaaaagcatgcstgtggtgcttttttggtaagccttctttgagagatttagaaagatttttaaaagatttagaaagatttaacattcatatcctctaactttctgtgagtttgattagcttaaaacggcttttctatttgttttgctttcagagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggcca

SEQ ID NO: 175546 - DNA, 601 bp, Human
caggtgtgggcctgccaagaagcagtacatctggggaagagaggaccttggggctaaaagggaccttgataaaaacatgattatagtggaagacttcagtctgtctgtttttcagaattattaagacctggtagacagacagcggttaggatacttagttgaattgaatgatgctgccattatacttgatttaatagagatgcgtagaatattcctcaaagaaggcacatttttttcttatgtcaatgaaacacttaaaaaatctgtcagatgctttcaaaactgcaacaattttttgaamgtagacatttttccaggtcacattttctgatcataatgcagaaaaatgaggagtagacaaaagttgaccaggaaaaaacatctcaactacttggaaattaagaaactcagtcctaaatcacctcgaatcaaagaggtcttcttttccacctcaccctcctccagcccctgcatcctgactcttaagcctgccctattttaaatgttgaatttggtgaatttctaatccatttgtaaaccaaaaagtatctgagacggatctcaatcaatttagaaatttattttgccaaagttaaggatg

SEQ ID NO: 175547 - DNA, 601 bp, Human
tttggtgaatttctaatccatttgtaaaccaaaaagtatctgagacggatctcaatcaatttagaaatttattttgccaaagttaaggatgtgtccgggagagacatttgtgcctttctctaaaaatggttttgagggcttcagtatttgaaggggaagagtgggctgaaggggaacgggggaaggtgtggtcatccacacgttgccaaagaaggggaccaggtaggggaagagtcagttctgtgttcatctcatgctcggtaagtcagcactttacgtaagataaggtgaacgtggggcmgtcacctgtgcagatcgttaacctttcatctgtagctctccttaggaacgaaaggagccagtttcttgcatgactcagctttcagcttaatttttttccactgggcagagcaaattggggtcctggggtttttttctcctttcacatatatgtgaaggaaaatggataggatgttattgataacctccttgtaaaacttcatgttacattgtgtgtgtgtgtgtgtttttaaggcttaaacctgtcgtatgaccctcagtcagtaacccagttcacaactggaaatgagtccttcctgct

SEQ ID NO: 175548 - DNA, 601 bp, Human
ttgggtatgtcttaaacttttacaatgtcaagttctgaagtttgatacatgtgattagactcaccttcctgtctgaagagaatttgatttttcaagactgaagtatactattgtaatgggatgtaatgggatgtagttggggtgggggagggtgataaacacatacataaggcagtgagaatttcctcgctcaggttaggattcagaattcttgagcatcaagttgggctgtgtgtgtatgttggggctgagaggcatgtcgggggtgtgtgtgtgcacgtgcgcacacgtgcatgcactrtgggaccaagctcccatgttcccggcgtgatgctggccctgcgtccgcaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcaggtaggggtgtcagcctcaggggtgccccgatcgtcttcctttgacttctccctagaaatcagtcagtaaaaccaagcgcctgtgtgttttt

SEQ ID NO: 175549 - DNA, 601 bp, Human
ttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtatgtgacctttcccaccggtgcttttctttcaaagtggacggtgggcgcggagcttgctatgagagcgcttgtcctccagttattgtgtcgagcgctttgttatcactttcctttctacttgcaaactttcttttaaaaacwgacatggaaacatagaatgggccgggtgtggtggctcacgcctgtaatcccagcactttgggaggccgaggcgggcggatcacctgaggtcaggaattcaagaccagcctgaccaacgtggagaaaccccatctctactaaaaatacaaatttagctgggtgtggtggcacgcacctgtaatcccagctactcgggaggctgaggcaggagaatcgcttgaacccaggaggccagaggttgcggtgagccgagatcgtgccattgcaatccagcctgggcaacaagagcaaaactccatc

SEQ ID NO: 175550 - DNA, 601 bp, Human
gccctgttgtaggtacttccagtgtggcctccaaatatgaagagctggagtgcctctacgcagccgtcggaaaggtcatctatgaagggctcaccaactacgagaaggccaccaatgccaatccctcccagctcttcggtgagtgtgtgtctgtcctggtgttcgtggtggctcagtttggcctctttccccgctcactggacgtgcttccctttgggaaagggctccggttgttgggcagagctttgagccgctgcgttgttcaggtgtctgttgcctggggccctcaaggccgccgtcycctgtagactgcatcccccttcgccgatgcttgctctgtgctccctcctcagcttccagcacaggctttggtgtgagggatgttgccagggtgcatgtgtcctgccaccccagtgtcacactaaacaggcaccgcaagagctacatgacaatgtgtggactctgcctttcaccaccagcctgcctgtgagtcagccactcacaagatgagaacttgtcccgtcttattgctgaggctctggctggcccaggtgagacggaaactgcctccctccttaggtgatcagggcagctgggtcac

SEQ ID NO: 175551 - DNA, 601 bp, Human
acttccagtgtggcctccaaatatgaagagctggagtgcctctacgcagccgtcggaaaggtcatctatgaagggctcaccaactacgagaaggccaccaatgccaatccctcccagctcttcggtgagtgtgtgtctgtcctggtgttcgtggtggctcagtttggcctctttccccgctcactggacgtgcttccctttgggaaagggctccggttgttgggcagagctttgagccgctgcgttgttcaggtgtctgttgcctggggccctcaaggccgccgtctcctgtagactgcaycccccttcgccgatgcttgctctgtgctccctcctcagcttccagcacaggctttggtgtgagggatgttgccagggtgcatgtgtcctgccaccccagtgtcacactaaacaggcaccgcaagagctacatgacaatgtgtggactctgcctttcaccaccagcctgcctgtgagtcagccactcacaagatgagaacttgtcccgtcttattgctgaggctctggctggcccaggtgagacggaaactgcctccctccttaggtgatcagggcagctgggtcactctggccccaggta

SEQ ID NO: 175552 - DNA, 601 bp, Human
gtcggaaaggtcatctatgaagggctcaccaactacgagaaggccaccaatgccaatccctcccagctcttcggtgagtgtgtgtctgtcctggtgttcgtggtggctcagtttggcctctttccccgctcactggacgtgcttccctttgggaaagggctccggttgttgggcagagctttgagccgctgcgttgttcaggtgtctgttgcctggggccctcaaggccgccgtctcctgtagactgcatcccccttcgccgatgcttgctctgtgctccctcctcagcttccagcacagkctttggtgtgagggatgttgccagggtgcatgtgtcctgccaccccagtgtcacactaaacaggcaccgcaagagctacatgacaatgtgtggactctgcctttcaccaccagcctgcctgtgagtcagccactcacaagatgagaacttgtcccgtcttattgctgaggctctggctggcccaggtgagacggaaactgcctccctccttaggtgatcagggcagctgggtcactctggccccaggtacgcaggagtcagatttatagatgtgccctcagttttgtggcagacacatgt

SEQ ID NO: 175553 - DNA, 601 bp, Human
acactaaacaggcaccgcaagagctacatgacaatgtgtggactctgcctttcaccaccagcctgcctgtgagtcagccactcacaagatgagaacttgtcccgtcttattgctgaggctctggctggcccaggtgagacggaaactgcctccctccttaggtgatcagggcagctgggtcactctggccccaggtacgcaggagtcagatttatagatgtgccctcagttttgtggcagacacatgtctttgatcctagactttggattagtgcctcaaaatttattttctcctttattrcatattcattgggtgaaactttgaaaatacaaatgaaggaatactaagtagaagtcacctgtcaggctctcttcccaatagcaatcagtcccagtattttagagtgattatcatattctatacacacgtatacaaatacctatatagatagcccttgttaggcaaacgcttttctgaatttgccaactgaatatatttggatgagttccttgctctccaaacttgccaggagctaggagaatttggttaacatggtgtcccttgctctcttagcttgctgtctctcttcaggcagcagct

SEQ ID NO: 175554 - DNA, 601 bp, Human
cgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcaggtgagctgggacggtgtgccatgtgatctccctttcaataaaagaaaattcaagcctcaacatcttggtctttctgaaacttgaagcaaaacatttttttctgctgtrattgcactcacagcatcttttcttaattaagatggatttttgtctgtaatctcagcactttgggaggctgaggtggacagatcacaaggtcaggagattgagaccgtcctggctaacacggtgaaaccccgtctctactaaaaatacaaaaaattagccaggcatggtggcgggcgcctgcagtcccagctactcgggaggctgaggcaggagaatggcgtgaacccaggaggtggagcttgcggtgagctgagatcacgccattgcactccagcctgggcgacagagcaagactctgtc

SEQ ID NO: 175555 - DNA, 601 bp, Human
gcctgggcgacagagcaagactctgtcttggaaaaaaaaaaagaaagatggatttttttcagtgcacttaacagatgttaaatagaaactgagttgctcatcttaatgtggctttgctcctcttaaaatgttaaatgaagactcactcctgtcatcccagcactttgggagaccgaggcaggtggatcacttgaggtcaggagtttgagaccagcctggccaacatggtgaaaccccgtctctactaaaaatacaaaaattagtcaggtatggtggcgcatgcctgtaatcccggctgctyaggatgctgaggccagagaatcgcttgaatccaggaggcagaggttgcagtaagccaagatcacaccactgtactccagtctgggcatcacggcgagacactgtcttagaaaaaaaaaaaagttgttaaatgaaccttgttaacctttttatggcgataaagataagacaaataatacttaaagtaaaagtaataatagagactatcatttcacttagatgcttgcaaacttctgatttgttttataatttacagttgctttctctctaaaatgagttgtagcccctacgaaaattacat

SEQ ID NO: 175556 - DNA, 601 bp, Human
gctgtgggttttctgagttggggctccaaagccaggaggtgttcacacacactgagatgaattggaaatctccagcacaaacctgcttctgatctccaggaagaaaataaagacttcagggcaagcgttcatctaaagcgtttttgggctgatttaaaatcctgtgtcagaaagttgaatagtatatttttgtaggtgaagattcattttttcttcaaatataaaaaagtttgaattctgtctgcgtgccctagaaaataaaactgtggacttgtcaactcccattgttctttttttttttgagacagagtcctgctctgttgcccaggttggagtgaagtggtatgatctcagctcactgcaacctctgccttccaggtttaagcaattgttgtgccccagcctccccggtagctgggattataggcccatgtaaccacacccggctgatttttgtatttttagtagagatggggtttcaccatgttgcccgggctggtcacaaactcccaagctcaagtgatctgacttcctcggcctcccaaaatgctgtgattacaggcatgaggcaccatgcctggcccccatcattccttaagca

SEQ ID NO: 175557 - DNA, 601 bp, Human
tttgatgagaagaagggagtgagttgtggtgctgggtctcaggagagcctgctagcatgtttcctgttcgtgccggatgggcgttctcttggcgcgtgtgcagcgtgcgtttggaattttgcctatggccacacctgggcagagttccctgctcttccatcactcgttcaggagacctttcgactgctggttagttgccaggcactgggtcaggtgctaaaaagacaaagacagacgacatattggctgtggcaggtccatgtgaatcggtcaggggaagggcacaagccaagagtcctcractccctccttcctttgcccctgagtatctgctccctcactgcgggtgacagttcagggcccactggccaccgccatctctcattaggacgatggaaccatttccgtagtgttcaaccacctcccctcctactgataagttttctctgtcgttacaaaattattcttaataaagcagataacaatactctttccattgtgcgtggcataaaatccagcctccaggctatggtccccatagcctctctctgccaggtgactggccccctgcctctctctgcatccccatctcatccctctc

SEQ ID NO: 175558 - DNA, 601 bp, Human
gcctatggccacacctgggcagagttccctgctcttccatcactcgttcaggagacctttcgactgctggttagttgccaggcactgggtcaggtgctaaaaagacaaagacagacgacatattggctgtggcaggtccatgtgaatcggtcaggggaagggcacaagccaagagtcctcgactccctccttcctttgcccctgagtatctgctccctcactgcgggtgacagttcagggcccactggccaccgccatctctcattaggacgatggaaccatttccgtagtgttcaaccayctcccctcctactgataagttttctctgtcgttacaaaattattcttaataaagcagataacaatactctttccattgtgcgtggcataaaatccagcctccaggctatggtccccatagcctctctctgccaggtgactggccccctgcctctctctgcatccccatctcatccctctccctccagcatcagtctccagtgtgctggccttccatattcttgatcttgcctcactcttgccactcaggctaatgtgcagctccttttaattctgtcagtccaccctgtttcctggccat

SEQ ID NO: 175559 - DNA, 601 bp, Human
tctctctgcatccccatctcatccctctccctccagcatcagtctccagtgtgctggccttccatattcttgatcttgcctcactcttgccactcaggctaatgtgcagctccttttaattctgtcagtccaccctgtttcctggccatgttaccacagtgagcacatgcctggctgtgtccttccccctgacacttcagctccttgaggcaggggacactatctctgtgcagtcaacagatgagtctgcagggcccccatggcacccagtgggtgctcagggaatattcgcccaagatgrcaagagtgtcgtggccaggcagcttgtgcacggcctgtggggaagaacggtgtggtggcgagtggcccaactgcagaggcaggcaggggcttcagtacatcacggaggggctcgcaactcacacggggaagcctacactgtcgcctgaggctgcgggaagctatgggtgggtgggccggggtaaagggccactgtgtggaaagagatgggttcaggaggacgagtctgggggtgaggtgggaggttccacccaggtgggagcaggaaccgcctaggtgttcaggagttaagagtggcagg

SEQ ID NO: 175560 - DNA, 601 bp, Human
gggccaggcacttcttttgtttgtttgtttgtttgtgtgagacagggtctcactctgttgctcaggctggagtatagtggtgcaatctcggctcacagcaacctccatctcccaggttctagcgattctcctgcctcagcctcctgagtagctgggattacaggcacacaccaccacacctggccaatttttgtatttttagtagagacagggtttcaccatgttggccaggctgatcttgaactcctgacctcaggtgatctgcctgcctcggcctcccaaagtgctgggattacaggcmtcttaatagacccatgtccctactgccgccaccaccagaaaaaagggctataagtccatgtcctgaagcccaaggcctcctttggctgatggtcaccatgacacatcaccacgtcatcaggtgcctgcgcctcagttttagcctcagctcctggtgcgagtgccatcaggagaggaagttctagcagtatgttgtgcgaggggtcaggatatttggttttactcaacaatatttttgtcttggctcagttggtcacagctgtacacctccacgtcctctgtggggccatggctgctctct

SEQ ID NO: 175561 - DNA, 601 bp, Human
tcctgcctcagcctcctgagtagctgggattacaggcacacaccaccacacctggccaatttttgtatttttagtagagacagggtttcaccatgttggccaggctgatcttgaactcctgacctcaggtgatctgcctgcctcggcctcccaaagtgctgggattacaggcatcttaatagacccatgtccctactgccgccaccaccagaaaaaagggctataagtccatgtcctgaagcccaaggcctcctttggctgatggtcaccatgacacatcaccacgtcatcaggtgcctgsgcctcagttttagcctcagctcctggtgcgagtgccatcaggagaggaagttctagcagtatgttgtgcgaggggtcaggatatttggttttactcaacaatatttttgtcttggctcagttggtcacagctgtacacctccacgtcctctgtggggccatggctgctctctggatggcggctgggctagaccagacgtggctgaaatctcggcagatctcacagaaaatcttgcccacagatgtccccatggtcttctcttgatctgaggcttcatagcctgagtctcagggcccatct

SEQ ID NO: 175562 - DNA, 601 bp, Human
taatcctgagacacaaaaccctgaacatcataatcccggatgttgaaatccctaaagatcaaaatttctaacctctcaaatcccgaaaatataatgctggaaaaaaacaatttaaaaattctttaaaacatacacagagataccccaaataatactttactaggtaggtttccaggtattccttagtccagtcaagttgatgctgtaaacatggcacccataggcatctccttaaaccatgcagacagtaacatgtaatagtttctaacctgatgcagctgtgctgtgatgatgattttttcagggattttgatctttgaggatttcgacacttggggttagggtgtatagaattgtgtcttttgggattctgatccaaacccccacggttggagttgagcagctttatcagcaggtcagtgaccttgctgggctcttcaattctccccagctcttggtctccgctaaactgacgtggagctgagagcccctgatgggctggtcagggtgaagtgtgtggccatgtgagggaaactgtgcttacttcatcacagtcctcacagggcagcctgatgacagatacttaggagcgttctttacc

SEQ ID NO: 175563 - DNA, 601 bp, Human
tgccccagccctgttgcgccactgcctgatgccatgtagggtgtctcctgtgggctagagcagcctcaggcagacctagaaacctggctgttaataaggaatgttggcagctaattcagatcagatcttcaaaaacaagagggctgggatgagataaacacaactgtgaatttgctgtgccctccaggccctcagtttcgacttcgggctctagttgtccaggcgttccgttccagtccgttccattctcttctgttctgtttcagtccgtctcggtcattttctcctgcctcttgtccaytgcagattgcagagactgaactttcagttcttgatttgttcttcagaataatacctgttggcaaatagtttatgtcatatacgtgtgttttcactttcctattttcagtggcctgggcctcggtgacatctgtgtccttctaagttactctttcagtcttgtcagtgtttttgtccttcttggatatggtgggatcagtagtgttaagaaacccccttaaaaactaaggacaaatgcaggcgccattgctgagcctctcgggatgcctgggcttggctgctaagtgcaccatggcttccc

SEQ ID NO: 175564 - DNA, 601 bp, Human
ccaggctcataggacggtgactcaaaatgtgtttacattttatgggtccaaagaggtcatgagaaccacgtttgcaggtgcttagtgtggctgtggggtttagcaggcacgttgggaaaaggcacgcctgcagcagggatgccaggctgtcccgaccttaggcattgctggacaaagagccgggcagggagggtggcaaagggcatggacagcaggaggaggagttttgaggactgcccattagctaggtttggtgtctgtaccatcgttctcccagtctcctgtctctcaggagccacargctgaggttttaaaattggagacaccataaggaaagtagtgtttggggtgaacagtaaatgaaatgtgggatctcaggtgtctgtggtgtaaatgagagtgcttcctttggtaattgcatcataagatctttgcgataatcatgtccccaatggactctggtgtgtttttcccgtttgatctttactgacatttaccgcagagtctcttatgctggtcccatcaggcagcccagcaaatcatcgaactccaggaagctgcacaaatcaacgcaggcttacagccaaccaacctgggaagg

SEQ ID NO: 175565 - DNA, 601 bp, Human
ttcatattgtttagaaatttcaagaactttttttctgctcattttttttgaacagggccttgaagttattgaatctacaaatttaaaatacttcacaaaagagatgacagccgaattttatgcactgaagggaatgttcttggctcagatcaacaagtatgtatgttatattgaaaggataagagaaaaaatgcatcagattatttaaagttatttataacctgaagccaatgtgaagctcaagctagaaatgggtatgatttggtgacagtcattaggtaggattttttaggtactgcayctctgcaaaaagagtaacttgtgacaaattgataagcctatttgatgtgtagtattttaaaagcttttctcaaatgagctactggatcacagaactgctgataacatggattcatttccccatttcctcagtccgccatttacagagctggttcgttttgtggagatgattcctgctttagaccaggggtcagtaaaggatggcctgggggccagccacatccagccactgccctgtttttgtcagtgaagtgatattggaacacatccctccccactgatgttgcctgtgactgctttc

SEQ ID NO: 175566 - DNA, 601 bp, Human
gcctatttgatgtgtagtattttaaaagcttttctcaaatgagctactggatcacagaactgctgataacatggattcatttccccatttcctcagtccgccatttacagagctggttcgttttgtggagatgattcctgctttagaccaggggtcagtaaaggatggcctgggggccagccacatccagccactgccctgtttttgtcagtgaagtgatattggaacacatccctccccactgatgttgcctgtgactgctttcgctttactgcagagttgaggagttgtgataggaatygtatggtctgcagagcctaaaccatttgctgtctagcccatcgcaggaaaggttgccaaaccctggtttagagaagtaaacgtcagaggagattttgtaaatatcatgcaaatgaggtagactcacaagatgctgcctgttgccttgtgtaggctccagtgcctgcttttcacatcttcagtctgtggggcttgcatgtttagcttatttttaaattaggaagcagttttgtcaacataaaaaggttttatctttttgtgtaatgttttaaattcatgtgacagacacaaccattccaaa

SEQ ID NO: 175567 - DNA, 601 bp, Human
tcttttcacttttttgatagtgtcctttaatgtacaagtttttaattttgatgaagtccaattcatgtatttttttcttttgttgctcatacttttcacgtcttctaagaaaccataccctaatccaggatcagaagcatttattcttatgttttcttctaagcatttcatagatttagctcttacatttgggtctctgatccattttgaataattttttatgtggtgtgaggtaggggtctatatttattatgctgcatgtggatatacggttgtcccagcaccatttgctgaaaagtckagtctttctccattgaatggtcttgacaccctcatcaaaaatcagttgaggccaggcccagtggctcacacctgtaatcctagcactttgggaggctgaggtgggaggatcacttgagcccaggagtttgagaccaacctggacaatatagtggagacccccatttccaaaacccaaaaaacaaaaatccgttgaccattttttgtgggcttatttctggactctcacttctattccattgatctgctatgtagagtctcatatttccatatgaattttaggttattttcatgtatttct

SEQ ID NO: 175568 - DNA, 601 bp, Human
ttccattgatctgctatgtagagtctcatatttccatatgaattttaggttattttcatgtatttctgccaaaacagttggaattacgacagagattgcattgaatctgtagatcagtttgtgagcattttgccatctgaagcaagttttccagtttgtgaacacgagatgtctttccactagtttaggtcttctttagtttaattcaacaatgttttttagtttttagtgtacaagtcttgcacttatgttaaatttattcctcaatattgtcacgtgaatggagccattttcttcattwtcacattgctcattgctaacatttggaaataccagggttttgtatattgatcttagatttctcaaccttgctgagtgtatttgctctaatagctttttggggattcttcttttctgtgtataagatcgtgtcaactgcaggtagagatggactgacatcttctcttccaataaggatgccttttatttctttttcttcccaattgccctgactagaacctcaagtacagtgctgaattaaagagatgagatccttgtctttttcttgatcttggggaaagccattcagtctttcagcctt

SEQ ID NO: 175569 - DNA, 601 bp, Human
tctgagcaggttggacgcgtgtatccccaagcggtctactttcccatccggaccctgtacctgaccctgaaaatagaacagcgggaacgctacaagagcggtacgtctcgggtggggccggtaggccaggccgggaagggctcattccagggggtgccccacatccagacagaccaccgcagccacccctgccctgcagctcactcatagccgtggccaatctctcctcagtgggcagcaccgtagggcaggaagcaaagtctgatctgagtacagtctctcttttgccaggatgtaatargcgttcatttatccgagtgatttgatctataggtagagaaaatatgtgaaattttcagcttcagaaaactgtaaagtttacctttctccttagtagtaagtgcatcccaatacacagcagatgccagctgccgtgtgtgtgtgtgtgtgtgtgtgtgtgtttaagttatgaggagtatcttcagctgtgagaagaatcagcattgaagtcagtcttaccagatgttggtgaaatttcactcacagtgtaagacttttaatctatattgaatagcccttgtatgcaaagcaacaactgatt

SEQ ID NO: 175570 - DNA, 601 bp, Human
ccatcccatcctcatacccccatcccatccatgcacccccgtcccatctactcacccctgtcccattcacactcccccgtctagtccacacaccccatccacttacctgcgtcccctcatcctcatgtcccatctacacaccaacgtcccatctacttaccctcatcccatcatacacacctacatcccatttacacacgcgtgtccccgcgtatgcactgtgtcccatctacacacccacatcacatctgcgcatccacatcccattgtgcacacccacatccaccgcggtgcgcacaggcacagctgcttctcgtgctgtctggaacacgttgcttcttactcctcattcagcctccatcccacttacctgcgggctccctagtagagaagcgcgtggcgggctctcttgccaggttctcactgagagctcctggtcccaggatgtggcttcagctgcctgagtaacttccccaagccttcatctctcaagtgtcagcacatgagtgattgcagcacatgagtgattgctgtgtgaaaacgagatttgtctggtacagtttcccagagatgaaagaaagattaaatcattcacatttaa

SEQ ID NO: 175571 - DNA, 601 bp, Human
aaatagcagcaactctgttctaattataagatgattttaaattttatttttaagattaagtatcctctttgacaatccagaaacatagtctttgctgactctgtggacacacacctaaaacagttaaaaaggattcctcaattttcaatgacaaagtacaaaaaaagagtatgttcttggtgggcacggtggctcacgtctgtaatcccagcactttcagaggccgaggtgggcgggtcacttgaggtcaggagttcgagaccagcctgaccaacatggtgaaaccccatctctactaaamatacaaaaattagcctgtcgtggtggcgtgcgcctgtaatcccagctactcaggaggcttaggtgggaggatcgctggaacttgggagacggaggttgcagtgagccaaaatcacgccactgcactccagcctgggcaacagtgagactctgtctcaaaaaagaatatgttctcaagctgcagttcagtttttctgtccccttttccaaaaaatcttactttactaccaagccactcacctaactataaggaaagacagtttttcaaaaaggcaacaaaatccagaaaaaggagtaggta

SEQ ID NO: 175572 - DNA, 601 bp, Human
atccagaaacatagtctttgctgactctgtggacacacacctaaaacagttaaaaaggattcctcaattttcaatgacaaagtacaaaaaaagagtatgttcttggtgggcacggtggctcacgtctgtaatcccagcactttcagaggccgaggtgggcgggtcacttgaggtcaggagttcgagaccagcctgaccaacatggtgaaaccccatctctactaaaaatacaaaaattagcctgtcgtggtggcgtgcgcctgtaatcccagctactcaggaggcttaggtgggaggatcrctggaacttgggagacggaggttgcagtgagccaaaatcacgccactgcactccagcctgggcaacagtgagactctgtctcaaaaaagaatatgttctcaagctgcagttcagtttttctgtccccttttccaaaaaatcttactttactaccaagccactcacctaactataaggaaagacagtttttcaaaaaggcaacaaaatccagaaaaaggagtaggtatcagtccaaaattatcacccaaaacactgctgttgcaaaaaaaaaaaaaaaaaaaaaaaaaaaaattagagtag

SEQ ID NO: 175573 - DNA, 601 bp, Human
gggccagcctggggtgtcctgaaggagcagggcccacacctttcccttcctcatcagcaccctgaagggtcgtggccaggctgggctgggggcaccctgtctcgagtttgggggatcgaagcccactgagcagttctggcccggcccccttctctgccttgcacacccagagtgtggtccctaccataccttccagctgccctgcagtgcccaacttagcgcttttgtaatgatctttgccacgttctttcttcactgatgggttaaatcgtagactaagtggttcacatgtgtggtattyaaagaatctcctaaagactcattgtgtcctagatgacacagttaatattaagtcacataaaagaaaatcttcatctccttaatcggaaaggacactcaacagccatagctgtgaccagggttgcatcgaggttgcatccagctgaagtgtggcgtgtgccctgcagttgctccaggcagtctgggggcgcagctccctgttcgtgatgtgtgggttgggcttgccttaggtgaacccacagctgagggaggtgctctttgaaaagtgaagggcaagcccggtcctccccgtctatacgtg

SEQ ID NO: 175574 - DNA, 601 bp, Human
gtggagacggagaagggattcatgctggccaggtgttcgggatgcaggggagaggcgggggggtggggtggtgggggtgggtggtagctgtgaagggcagccaagggcatcccgtgctgatggtgcagctcagcaactgattgtgctggtggctctgcgaggccacacagtgacatgaccagaggtgtgcgcatgcatacacacatgtgcgcacacacacgtgcacacataactggtgaagtctgaatcagctcttcagctctttggactgtgccaatgtcactttttggtgttggcatcrcactgggttgcataggatgctggtgtgggaggaagagggttaggagtacatgggactttctgtatattttgtttgcatcctgttgtgaatctctaggaatttcagaataaaagttaaaaagagatcaggcatgagcttggcagcacgttcttggtccagcgtggagagggaacaatgaggtggcctgcgtccttggtggtggcctctgtctctcgcggctctgctgggggatctcaccttggtgcacagcagcctgtccagccacctgcctgtgtggagtcctggcactgtgaggaatgc

SEQ ID NO: 175575 - DNA, 601 bp, Human
actgggttgcataggatgctggtgtgggaggaagagggttaggagtacatgggactttctgtatattttgtttgcatcctgttgtgaatctctaggaatttcagaataaaagttaaaaagagatcaggcatgagcttggcagcacgttcttggtccagcgtggagagggaacaatgaggtggcctgcgtccttggtggtggcctctgtctctcgcggctctgctgggggatctcaccttggtgcacagcagcctgtccagccacctgcctgtgtggagtcctggcactgtgaggaatgcasaggagggaggtgccacagagcttaaaatgaaagggaaaccagacaagtgctatgaaaaaaaaacacacacacacaaaatacattggctttcatgaaaccaatgacatttgtggacagccaagttcagacatggtcaggaataggccactcgtatagctgggtgttatcacgcgtgggcagggatggtcaggccacttgaatagctgggtgttatgcccagcgcctcatgtgcgctgcctcgtttaatttcatcctttcggggcaggtgttaaattattcccgttcctataccacgggtta

SEQ ID NO: 175576 - DNA, 601 bp, Human
ccacagctcgctgggtacacaggcagcttcacaggtggggatgagagccacacctcgtggggtgcacaggcagctcacgttagcctttgagggtccagctgcgtcagcagagaatgttgtagtctgtgctgaccagggaaggcctcaggaagaggagcagctccaggccttcaggcttctcactgagagatgagagctgtgtccacctttcctctaaggcgagcttgtccaacctgcgggctccatggggcccacgatgcctttgaatgtggttcgacacaaattcgtcaactttcttagracattatgagatttctttttctttttttttttcttttttagctcatcacctgtcgtgtcagtgtattttatgtgtggcctgagacaattcttccaatgtggcccagggaagccaaaagattggacatccctgttctaaggtcttttgcactctacggagtgggcccctggagagctggggcgtctcagtgggtgctgccggttttgcttctcctcccgggaacccaggctgctgggaggagaagtgaaaccaccccggccgagcctgggcgccagcgaggcagcagcatgcatcaggttt

SEQ ID NO: 175577 - DNA, 601 bp, Human
actgagagatgagagctgtgtccacctttcctctaaggcgagcttgtccaacctgcgggctccatggggcccacgatgcctttgaatgtggttcgacacaaattcgtcaactttcttaggacattatgagatttctttttctttttttttttcttttttagctcatcacctgtcgtgtcagtgtattttatgtgtggcctgagacaattcttccaatgtggcccagggaagccaaaagattggacatccctgttctaaggtcttttgcactctacggagtgggcccctggagagctggggygtctcagtgggtgctgccggttttgcttctcctcccgggaacccaggctgctgggaggagaagtgaaaccaccccggccgagcctgggcgccagcgaggcagcagcatgcatcaggtttccagcgcgcctctagctgcttcacacgctgcactctgggccctccctgaatttcattcctgggtgaaatgcaggactcgggaaagtctagctgccctgttaaggccacagaaattgccagggggacacaaatagctgataagcaacctctgaatgaagtctttgtcactgagttatcgtga

SEQ ID NO: 175578 - DNA, 601 bp, Human
ccactttgatgactttttagcatgtaatccctgaagtcgggagcccgctgcaatgtatgttatctagtcctttatggaactttcttttgccaccaaagctgtgatcagccccttttgacctgaaatctctgacccttaatttttttatatctcaaaataagatttttttaaaagcctaaagaaagctcaaaatgcatcacagaaagctgtgtatgttttaacatgtatataacatgacctgtagtgttgattccagctgtgggttattgatttctctgcttccaaatgcttggtcagcacrgaatggtggtcctaatgtgtgtcctggagtcatttggggatttctttatgggtagacgccaggacagcaagccatcagctgtggcttaactgacattagacagaatcagccacttggttcacagaagtcagaatcatctgtgtgcacttcacatgcccctgactccacgtcaggggttacagtggctgggacacagctgccactgggaccctcaccgggcaggcttaatctgccatcttctggaaatctttcagctccctccaacttcattgcaacaagatatctgaatattccctgaac

SEQ ID NO: 175579 - DNA, 601 bp, Human
gacgtcactggggagacaggctctggagtggtcgcccagcgctcctgccgcctccagctgactcagaccacagtggtttcggtgcaggttagcatcctgtctggcaggttgtagattaactgcatctccaataccgaatggtgattgggaacagagtactggtcaccatgtgtggacagggatttacacattaatggggctagacgatcaggttgatgctggttgctttccttatgtggacagaacacagaagatgacctgagggatgattttcctcctccaaagatggggcacagccgtyctaggtgctgaaagacaagtttgcatcattagacagcagctgtctcagagcaggaaggccggactcttcccatagactctgattaaggaaagcctctaagagtgagcatttggcagagtctgtttttttttatttttagttttttgagacggagtctcactctctcattcaggctggagtgcagtggcgcaatctcagttcactgccacctccacctcctgggttcaagcaattcttctgcctcagcctcccgagtagctgggactacaggtgcgcaccaccacgcctggctaatttttg

SEQ ID NO: 175580 - DNA, 601 bp, Human
aggctgcagcatcaggtgcagcctccagctctgtgcaggcagaggcatggatccctgtttctgatcagcctctgttgacagagttcatggcctctcttgggaattgacaccagggcttttttgtggcacaggccatggcctggtcattctgtggatgatgggcagttctgaggtatttgcaggagaggaatggattatattcttaaggcgacattaactttcgacagcgtggaagccagtgacaaatacatgctgacctcagagtcatcctgtttctaaacagcgtgagtgaccgactagrcagtttgttccagcttagcagctgccagggcctataggcagagggagatgcccacagcacagaggaatccagcttcagagccgcttcctcctcttgtttattttgttatttattctactccttcattcttctctttttttttttttttttttttttttagatagagtttcgctgttgttgcccaggctggagtgcaatggcgcgatctcggctcaccgcatcctccgcctcctgggttcaagcgattcttctgcctcagcctcctgagtagctgggattataggtgcctgtgaccacacc

SEQ ID NO: 175581 - DNA, 601 bp, Human
gatatattccatagtcagcaagggtggaaatgttcagatatttacctgcattcttgtcaggtatcgcatattaggtaactgcagctttgacgcagaccagccgcattggtgctttagagcagacagtggcgaaccctggagggaaacagccatcttgtgcctcctcgccttcagtctcctaacaatgcgtgcgttaaatctgtcaccagaatttacagaatttgctcttggtgctaagttaaagaggaattgcaatttgagaatttttcttttccaaaaaaaatcagtgagtgagatgggrgtgtcacggagcgctgtgtttcaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggtaacctgctttgaacagccagatcctctcctcgtgacatcgcctttctgctgaagttcctaaagtgtctcc

SEQ ID NO: 175582 - DNA, 601 bp, Human
ttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctygttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttg

SEQ ID NO: 175583 - DNA, 601 bp, Human
ccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagygggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgctt

SEQ ID NO: 175584 - DNA, 601 bp, Human
gtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcaytgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcc

SEQ ID NO: 175585 - DNA, 601 bp, Human
gaacgtcaaagcaaaaggacatggcagggattattcggtccaaacttccggtttacatatgtggatcctaggttcagaggcccggccagttagtggcagggcagtgggtatcctaagctcagggctcctgtctctaagctcaacccttgccagtacattgcatggcctttaagaattccccgtcaccaccgcacactgtagtccctcttacttgagttgctgggtgagttcagatttctggagatgttccacggcctccttggcattgttgctcagctggctgaagtagtcccacatcacygtggccacctggtcagcactgacctcagccctggctcctgggtggtaacagagagcaattcatgaggccccgtctcctgtgtggcccctctgctccagctctgagctgcagactggatgatggtgggggtgcctcaacctgccattttccctgtctgagcttagctttttggaagccacagggatatgtgaaactggtatagcaccaatgccaatgggcccaccactgggactgggccagctctcctgtgagccacttggcagccaggcagacctcatgtccagctgggggctgatgggc

SEQ ID NO: 175586 - DNA, 601 bp, Human
tctgggccataggatcacattgtgtaacacaatgttgtcttcttgacctctgctggggtcttccagtggcacaaggtgctgctttccttgcctgtgcccaggggcctcccaaatattcccacctccctccccttgattccactggggcctgtctttctgaaacgtattagaaatcagctcacgtgacattttcctccctccctctcttccatgagcctgaatgataggatgtggccatttgtcaaactctagaacgtcaaagcaaaaggacatggcagggattattcggtccaaacttccrgtttacatatgtggatcctaggttcagaggcccggccagttagtggcagggcagtgggtatcctaagctcagggctcctgtctctaagctcaacccttgccagtacattgcatggcctttaagaattccccgtcaccaccgcacactgtagtccctcttacttgagttgctgggtgagttcagatttctggagatgttccacggcctccttggcattgttgctcagctggctgaagtagtcccacatcactgtggccacctggtcagcactgacctcagccctggctcctgggtggtaac

SEQ ID NO: 175587 - DNA, 601 bp, Human
ctccttgtctgcagagggtgggactttgaggtccttcccagagggagtgttctgggccataggatcacattgtgtaacacaatgttgtcttcttgacctctgctggggtcttccagtggcacaaggtgctgctttccttgcctgtgcccaggggcctcccaaatattcccacctccctccccttgattccactggggcctgtctttctgaaacgtattagaaatcagctcacgtgacattttcctccctccctctcttccatgagcctgaatgataggatgtggccatttgtcaaactctrgaacgtcaaagcaaaaggacatggcagggattattcggtccaaacttccggtttacatatgtggatcctaggttcagaggcccggccagttagtggcagggcagtgggtatcctaagctcagggctcctgtctctaagctcaacccttgccagtacattgcatggcctttaagaattccccgtcaccaccgcacactgtagtccctcttacttgagttgctgggtgagttcagatttctggagatgttccacggcctccttggcattgttgctcagctggctgaagtagtcccacatcac

SEQ ID NO: 175588 - DNA, 601 bp, Human
ctcaggatctcccacatagtttgtctcagaatctacccaccatgtcacctccagcagtttgctttcccctccttgtctgcagagggtgggactttgaggtccttcccagagggagtgttctgggccataggatcacattgtgtaacacaatgttgtcttcttgacctctgctggggtcttccagtggcacaaggtgctgctttccttgcctgtgcccaggggcctcccaaatattcccacctccctccccttgattccactggggcctgtctttctgaaacgtattagaaatcagctcacrtgacattttcctccctccctctcttccatgagcctgaatgataggatgtggccatttgtcaaactctagaacgtcaaagcaaaaggacatggcagggattattcggtccaaacttccggtttacatatgtggatcctaggttcagaggcccggccagttagtggcagggcagtgggtatcctaagctcagggctcctgtctctaagctcaacccttgccagtacattgcatggcctttaagaattccccgtcaccaccgcacactgtagtccctcttacttgagttgctgggtgagttca

SEQ ID NO: 175589 - DNA, 601 bp, Human
ttgtccccgatcttctggctcacctcattggcatggggcagcagccgggccctcagctcctccagctccttcccaatctcctccttcagtttctccgagtccttggccaggcgttcatgcagctcggtggcaaagggcaccagcttcttctgcaggtcacctgcgtaagtgttcacttctccaagtttgtcctggaagagggcactgtggggaagggcacaaggaggccacgttacatttggcatttacacggcaagactttgtctgcttgtataccactcgccttatgcacacgtgctargacaggtgagtgctcagaggtaccgagttcaccctccctatggtggtgcagattggagaggatgggtgtcacagactaagttacgatgctgaatttctatctcaggatctcccacatagtttgtctcagaatctacccaccatgtcacctccagcagtttgctttcccctccttgtctgcagagggtgggactttgaggtccttcccagagggagtgttctgggccataggatcacattgtgtaacacaatgttgtcttcttgacctctgctggggtcttccagtggcacaaggtgctgc

SEQ ID NO: 175590 - DNA, 601 bp, Human
ttctcctcaagtaataaccagaccgtccccttccatcagaccgcagcccagctgtctctccctctcgccactccacagggtccagactgctcctttcgaatagtacaggtggtgtgagccaggctgtccaaatggtgagaatactattcataacaactactgctcatttcataccctcagacaacatttacaaagcattttcacaaatcttatctcacttgagctgatgacaacaccagtaccattttacaaaagaaactaaggctaggagacatagggggatttatttaagatccgacckcctggaccagagctctgaccccagtaccgaatctctctctagaatactgaggtacctgctctgaggtcctctcacctccagagccctgacagacaaagtgtagcgcactccctggtcctggatcctgcctgccgactggatctccgtgttgttccagccacagtgctcgcaggaaaaggagctcactattatttctctgaagaagggaatcttggtgagcaggaggcgcgtcatgccctggtgaagtagaaagtagctaaggaaaaaaatcaatgaaactccctttccccgccctactat

SEQ ID NO: 175591 - DNA, 601 bp, Human
aggagatacctcatgtccctgaacattatttctaaaagacaacttcccctagatagagacagtttatctaacttatgaggacaacagtgactttcccaagcagactgttaccttgaggaggtctctggtcatatctgaggcatctgtgatgtggagggtgatcctggtgcccaagggttctactgctcctccagatttcacctgcatcgataacagtcaggagcaacagagagaagacctgagcctcacttggtacccaggagacctggagtgtaggcttggacatccaatcagttagggycattaatagctaccaaagaaagagccttctaaacagcagtcgcccaaaccaaaaacaccaagagctggccaggaacagtgcccaaccctggtaacgtgccaaaacttatcccaaattgccaataaactctgaatttaccttaaaaaaaaaaaaaaaaaagacttttggggttgaaagagacttttaagcatttattgcagtcctttcatccactgcatccaatgtgtgggtctcctttataatattctggttaaagaatttaattagcttatactcagatacactcaggggaagggaatt

SEQ ID NO: 175592 - DNA, 601 bp, Human
cagttttctctgactcccttgttaaagcttgagactcactcctgtccatctgaaccacgggaatagatccaacttaataaagggaaactcagtcatagcttcgagctgtcaggtatcctgtcactaggggacagacagagaagaggacccagatagacactggaggccaaaaagctaccaggtcatcagaaagagctaacagggtcaccttctaaacctgcaattccaatcttagattaactccctctgctcaggggtcctcaaagccagggaagtaggagatacctcatgtccctgaacrttatttctaaaagacaacttcccctagatagagacagtttatctaacttatgaggacaacagtgactttcccaagcagactgttaccttgaggaggtctctggtcatatctgaggcatctgtgatgtggagggtgatcctggtgcccaagggttctactgctcctccagatttcacctgcatcgataacagtcaggagcaacagagagaagacctgagcctcacttggtacccaggagacctggagtgtaggcttggacatccaatcagttagggccattaatagctaccaaagaaagag

SEQ ID NO: 175593 - DNA, 601 bp, Human
gagttttccagactgaaaaaatacatctaccaagtgcttagcccagtggatgaaaactgacccacaccaaggcacaccctgaaatttcacatcaaaggaaacgaagagatcacaagactaggtcacatataaaagaccaggaatcaaatggcttcagacttctcaatagccaaagtggaagactatagtacaatgtctttaccaaactggaagaccatagtgcagtcttcgaaattctgataaaaaattatttctatcctagaatcgtattcccagccaataatcactctagtgtgataayagaataaagacatgttcagatgtggaaggtcccagaaattttatttcccatgcactttttcccaggaagctactggagaagatgctctaacaaaataagggagaaaaacaagaaagaagacatggaatatagaaaaccagaagagggccaggtgcggtggctcacgcctgtaatcccagcactttgggaggcccaggcaggcagatcacgaggtcaggagttcgagaccagtctggccaacatagtgaaaccctgtctctactaaaaatacaaaaaattagccaggcgtggtggtgtgcg

SEQ ID NO: 175594 - DNA, 601 bp, Human
ccatttccttgcacaacccagccccattccctgctttacattcctccatgacactaatcaccatctgatgtactgttttcctcatctgtttattgtcatttttccccactagacttcaagttccatgaaagagatttattttgtcctctgttctgtggtgtgcttggcataaagtagataagcaagcatctgctgaaggaatgaattaaatgccagctgcaatccccaaattacagtagatacacgggaaaattttctttaggaggctgaattctaacagcatgatatcaaacaaggatarggtcaatacagaggccagtgctgtttgaaagtcatcatttcaatggtaactccttcacttgtgctggactcggtctcccctcaggagactcctttcctgttcaaagtcagtattttatatactcaaaaccaacaacaaactccaggtgtaactttattccaccttctccaacttcagagttccaaccttagaggatagagcattatgtggaaggagggtgaggacttgatatgaaaaaagtgatgacatacccctggttcatttctgggtttcctcctaggccaattcaaaacttccaaa

SEQ ID NO: 175595 - DNA, 601 bp, Human
aggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagaggtgagtctcccaccccacccccaccaacacacagttgygctccaccatactgaacctgactctcagtgagactttgctggccctgagaatgcacggggaaggtggctgtcccctgccttggcccccatcacttgccaaacctcctcagatgtctcccctatttccctaatagctgagcattgaggatttcacagcatatggcggtgtgtttggaaacaagcaggacagcgccttttctaacctagaggtgagagtcctctcccagccaggggccatgggggacattctgtgctccttctcccagcataagaactgtactctgacctcatatcagggtt

SEQ ID NO: 175596 - DNA, 601 bp, Human
acatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagaggtgagtctcccaccccacccccaccaacacacagttgtgctccaccatactgaacctgactctcagygagactttgctggccctgagaatgcacggggaaggtggctgtcccctgccttggcccccatcacttgccaaacctcctcagatgtctcccctatttccctaatagctgagcattgaggatttcacagcatatggcggtgtgtttggaaacaagcaggacagcgccttttctaacctagaggtgagagtcctctcccagccaggggccatgggggacattctgtgctccttctcccagcataagaactgtactctgacctcatatcagggttacttgggtctgagtctcttctgggtcaac

SEQ ID NO: 175597 - DNA, 601 bp, Human; identical to SEQ ID NO: 22265

SEQ ID NO: 175598 - DNA, 601 bp, Human; identical to SEQ ID NO: 22266

SEQ ID NO: 175599 - DNA, 601 bp, Human; identical to SEQ ID NO: 22267

SEQ ID NO: 175600 - DNA, 601 bp, Human; identical to SEQ ID NO: 22268

SEQ ID NO: 175601 - DNA, 601 bp, Human; identical to SEQ ID NO: 22269

SEQ ID NO: 175602 - DNA, 601 bp, Human; identical to SEQ ID NO: 22270

SEQ ID NO: 175603 - DNA, 601 bp, Human; identical to SEQ ID NO: 22271

SEQ ID NO: 175604 - DNA, 601 bp, Human; identical to SEQ ID NO: 22272

SEQ ID NO: 175605 - DNA, 601 bp, Human; identical to SEQ ID NO: 22273

SEQ ID NO: 175606 - DNA, 601 bp, Human; identical to SEQ ID NO: 22274

SEQ ID NO: 175607 - DNA, 601 bp, Human; identical to SEQ ID NO: 22275

SEQ ID NO: 175608 - DNA, 601 bp, Human
cgcgcctgtagtcccagctactcgggaggctgaggcaggggaattgcttgaacctcgcaggtggagattgcagtgagccaagattgcgccactgtactccagcctggtgaaagagcaagactccatctcaaaaaaaagaaaaaacaaaaattagctggatgtggtggcaggcacctggaatcccagctactcaggaggctaaggcaggagaatcacttgaatccaggagacggaggttgcagtgagccaagattgcgccaccaaactccagcctgggtgacagcaagactccatgtcacgaaaaaaaaaaaaaaaaaaacacatgctcttcgaagcaatcaggcactgcaaccatggatgggtccatttctacaaaccattacagaatgggggccatgccaccaggtcaaacgccctcacccagagccaggcagttaggaagccaccacagggcttccaggagggcaactgctatggtgtgggtgccttgtgtgcttgcgctcttcaggggccctgctccacttctgatgctcctcaggtgagctcggtgccaggactacagcgacacggacctctcactgctgcacccttcaaagtccag

SEQ ID NO: 175609 - DNA, 601 bp, Human
aaaaccccatctctattaaaaatacaaaaattagccaggtgtggtggcaggcacctgtaatcccagttactcaggaggctgaggcaggagaatcacttgaatccgggaggcagaggttgcagtgagccgagatcgtgccactgcactccagcctgggtgacaagagtgagacttcatctccaaaaaaaaagtgagaaaaagatagaactgcaagccaaattaccaggaagaaaataggaaataatgacaagtaaaattaataaaattaaaagctaacccaaagaaaagatgaacaaagctrgaaattggtgtttgaaaaagacgaatagaaacagacaaccccctggcatggttgcttttttaaaagggcataggccgggcacagtggcttactcctgtaatcccagcactttgagaggccgaggcaggcggatcaagaggtcaggagatcgagaccatcctggctgacacggtgaaaccccgcctctaccaaaaatacaaaaaattagccaggcgtggtggcgggtgtctgtagtcccagctactcggaaggctgaggtaggagaatcacttgaacccgggagatggaggttgcagtgag

SEQ ID NO: 175610 - DNA, 601 bp, Human
tctttatccactcattggttgatggacacttaggttggttccttatctttgcaattgtgaattgtgctgcctataaacatgtgtgtgcatgtacctttttcatataatgactttttttcctttgggtagatagccagtagtggaatttctggattgaatggtagatagatggtaatctactacttttagtatttttttttttttttttttgtcttgagacggagtcttgctctgtcgcccaggctggagggcagtggcgcaatgttggctcactgcaacctctgctgtccgggttcaagcrattctcgtgccttagcctcccgagtagctgggactacaggcacacgccaccactgccagctaatttttgtatttttagtagagacggggtttcaccatgttggccaggctgatctcggtctcttgacctggtgatcgcctgccttggcctcccaaagtgctgggattacaggcgtgagccaccgtgcccagcccgatggtgtattttgatgggaattgcattgaatctgtagattgctttgggcagtatggccattttcacaatattgattcttcctatccatgagcatgagatatcttt

SEQ ID NO: 175611 - DNA, 601 bp, Human
gcgcggtggctcatgcctgtaatcccagcactttgggaggctgaggtggggtggatcacctgaggtcaggagtttgagaccagcttggccaacatggtgaaaccctgtctctactaaaaatgcaaaaattagccgggcgtggtggtgcacctctgtaatcccagatacttgggaggccgaggcaggaaaatcacttgaacccggaaggtggaggttgcagtgagccgagagagtgccactgtactccagcctgggcaacagagtgagactgtgtctcaaaaaataaataaataaatcttgytccagagcctgggctagatagtaagaggacagtgtggatgcagttaagaaccatatatgtctgaattttttgtacatgttcattttgttcccttcaccttcaaaattagtaacagatggctgcattttctcaagggatctgtgtggcttttaaatctaaatcatccacttacaggacatttgcaaagcaagaggttttagtccccattttctttctttttttttttttttttagtagagacggggtttctccatgttggtcaggctggtttcgaactcccgacctcaggtgatccgccca

SEQ ID NO: 175612 - DNA, 601 bp, Human; identical to SEQ ID NO: 36616

SEQ ID NO: 175613 - DNA, 601 bp, Human; identical to SEQ ID NO: 36617

SEQ ID NO: 175614 - DNA, 601 bp, Human; identical to SEQ ID NO: 36618

SEQ ID NO: 175615 - DNA, 601 bp, Human; identical to SEQ ID NO: 36619

SEQ ID NO: 175616 - DNA, 601 bp, Human; identical to SEQ ID NO: 36620

SEQ ID NO: 175617 - DNA, 601 bp, Human; identical to SEQ ID NO: 36621

SEQ ID NO: 175618 - DNA, 601 bp, Human; identical to SEQ ID NO: 36622

SEQ ID NO: 175619 - DNA, 601 bp, Human; identical to SEQ ID NO: 36623

SEQ ID NO: 175620 - DNA, 601 bp, Human; identical to SEQ ID NO: 36624

SEQ ID NO: 175621 - DNA, 601 bp, Human
gtcaagctgtgaggagtgcctagcacctggccagagccaggtacatgccagctatgacgatgatgagcccaactgcaacaggagaacacacttagtgcgacatgcagcggtagcctggcgttgggcacctccccatgctccgagaattctatttggagaagcccttctccattgtctcagtcacttcagggtgcaggaagcggctggccaaccgttcgatgtcgtccagcgtcaggcgactcagggacctctcgtaatcctggggagagaagggcaggaagattcaggggctgccagtggkgggggggcatacactgcaacagaggtaggggctgggagcaactgggcctgaagaggatgcccagggttacccttctcaccctctgtagctgttccaggaccctgctggcatctgccgcactgaagtggcgggccaagactttggagatcagctgccagacctgcgggggtggggagtcggccagcctctgggcctcgccttcttctagtagcaccttctccaggggtttgaccactaggttgagcttggagttgggcccgatgctataatccgagagtcgtttcccatctgccaaagaca

SEQ ID NO: 175622 - DNA, 601 bp, Human
gatctcctggaagagcctgggggggagggggaatggaatatttaagatagaaagaatttgaaagtctattgatcccactaggaatatttagaaaaattatgatagccttttgccacctttgccctcccacccctcattgagttaaactgcttaactcagtaacttcaacaaaattagtaaccctgaaccttttctccccaaggcaagtaccagtagcctatttaaaatattaacttctcaagagactagtaaaagtcaaaggacaagacagtattgtctaatacgtaggatacatctaggygttcactctccttcaatacaagactaaacatctgtcttaaaagacctaacattcctctttccttcttttcaaaatactgcacaatacagtacttctgtcctggttacccacaaagaactatcattctgcacagatcccaatagtgttagcactaggataatttcattaaactcaaataaattttaatccctttatcaacaggatgatttcggccttaaaagagagctcacttgagtggtaagattggtttctttctctgcagtttccaaattctccacgatgacttttataaacaggaag

SEQ ID NO: 175623 - DNA, 601 bp, Human
aaaataaccactttctctcttcttcaacataggtgatggctgcacaacacggaatgtacccaatgccactcaattgcacttgaaatctgatgtgactatgtgacagttatgttacgcaacttttacctcgataaaaacacatcgttttctccactcttttcaataatttaaagattggcttaataaataaggcttccctgagtacaagagatgaaatcctactcttaggtttgcagttaatccaggactgcaatgaggatgaacatttagcgccatgttgaatctcagtagaattcaaaaracacatagatttccaaaataatcagaaaaagcacttaatatctgcttcagttactgggaaggctaacacatgaaaggcaagctgtatgatctgtattctttccacgcccaagaagagaacaattcaagccacatgacttagaataatggttggcagaactccacctctgaagagtctacagaggtaccattactccattagtgataatagctattgatctcctggaagagcctgggggggagggggaatggaatatttaagatagaaagaatttgaaagtctattgatcccactaggaat

SEQ ID NO: 175624 - DNA, 601 bp, Human
aaaaacggtacaaaaaaatagccaggtgtggtagcatgctcctgtagtcccaactacttgggtggctggggctggagggtcgctttagcctgtgaggtggaggctgcagtgagccatgctccagcctgggtgacagagtgagaccttgcctcaaaaaaaaaaaaaaaaaaaaacaagcaatcaaacgcacacataattatagactggaatatctggtaaaacactaagtaactttcaaaagaaggcaaagagaagataacgttttatatcatttaaaagtagtatttccctttgactaccragcatagaaagtggtccttgaggctgggcacggtggctcacgcctgtaatcccagcactttgggaggctgaggtgggcagatcacctgaagtcaggagttcgagctcagcctggccaacatggtgaaaccctgtctctatcaaaactacaaaaattcactgggcgtggtggtgggtgcctgtaatcccagctacttgggaggctgaggcaggagaatcacttgaacctgggaggcagaggttgcggtgagccgagataccacaccactgcccactgcactccagcctgggtgacagagca

SEQ ID NO: 175625 - DNA, 601 bp, Human
gcccttttctgttgttcgtattctcctctcctgttcattcttctcgcctttctgagtagggtcttttcaacctagtaggaaaaataacttccagtcttaacctctattacacagatacaagacccaatgtgaaggtttgaaaataataacatctattctctatagtaggggtccccaacgggtccatggcctgtcacgaacctggctgcagagcaggaagtctgtcactccccactgctcgaattaccacctgagctccgcctcctgtcagatcagcggtggcattagattctcaaaggastgccaactctactgtgaactgcacacaaaagggatgtaggctgcatggtccttatgagaatctaatgcctgatgatctgtcactgtctcccatcacccccagacgggaccatctaattgtagaacaagctcagggctcccactgatcctacattacggtgagttgtataattattacattacatactacaatgtagcaataataaagtgcacaataaatgcaatgtgcttgattcatccccaaaccatccccttacccctcaccccacccagtccatggaaaaactgtcttccatgaaac

SEQ ID NO: 175626 - DNA, 601 bp, Human
ttccaagatccaagatattctagaatattccttccctactcccttgtccccactagctttcctcgccttggaatgcccttttctgttgttcgtattctcctctcctgttcattcttctcgcctttctgagtagggtcttttcaacctagtaggaaaaataacttccagtcttaacctctattacacagatacaagacccaatgtgaaggtttgaaaataataacatctattctctatagtaggggtccccaacgggtccatggcctgtcacgaacctggctgcagagcaggaagtctgtcrctccccactgctcgaattaccacctgagctccgcctcctgtcagatcagcggtggcattagattctcaaaggagtgccaactctactgtgaactgcacacaaaagggatgtaggctgcatggtccttatgagaatctaatgcctgatgatctgtcactgtctcccatcacccccagacgggaccatctaattgtagaacaagctcagggctcccactgatcctacattacggtgagttgtataattattacattacatactacaatgtagcaataataaagtgcacaataaatgcaatgt

SEQ ID NO: 175627 - DNA, 601 bp, Human
cgatggaaatatccctgcatgtgaatcattatggtgattcttcttgtcatttccccccgaaatttctagcatcctgaaaggccaccaacatttttgtcttcagtagtcaatcccattgttcacagccttccaaagactacagactcccttaaataggcatggcattccaagatccaagatattctagaatattccttccctactcccttgtccccactagctttcctcgccttggaatgcccttttctgttgttcgtattctcctctcctgttcattcttctcgcctttctgagtagggtattttcaacctagtaggaaaaataacttccagtcttaacctctattacacagatacaagacccaatgtgaaggtttgaaaataataacatctattctctatagtaggggtccccaacgggtccatggcctgtcacgaacctggctgcagagcaggaagtctgtcactccccactgctcgaattaccacctgagctccgcctcctgtcagatcagcggtggcattagattctcaaaggagtgccaactctactgtgaactgcacacaaaagggatgtaggctgcatggtccttatgagaatc

SEQ ID NO: 175628 - DNA, 601 bp, Human
gaccgatgtgctgaaaaatggtgaagctgggtgtacgggggttactgtactatttgtctttattttgtatgtttgaaagtttccattagtcaaagggaaaaaaaaggcaatcactccaaagaagcataagggagatgggcccttgcctcaaataagctggcatcgagcctacccctgcttcaacctcattttccttcctagaggacaaagggcaatgggtgccttttgaattctgaaacatgtatacataatacctattcaaacacatctttcaaaactttcaaggtcctgtactagtgargaccttaaacattattcttagctggttttccagcaattcccctcttgggtctgtcttaacgtacgaattgtgcctgaaagataccagatactcctccatgtacaactcatttatggggacatgaccatcctaagtggaggagcttactgaatgcctactgcttttgcaccatcataaagttgaaaaattgtcaggttaaggtcaggcgcagtggctcatgcctgtaaccccagcacttccagaggccaaggcgggcacatcacctgaggccaggagttggagaccagcctggccaacatg

SEQ ID NO: 175629 - DNA, 601 bp, Human
ccatcctggctaacacggtgaaacctcatctctactaaaaatacaaaaagttagccgggcgtggtggtgggcgcctgtagtcccagctactcgggaggctgaggcagaatggcgtgaatctgggaggcagagcttgcagtgagctgagatcgcgccactgcactccagcctgggcgacagagcagactctgtctcaaaaaaaaaaaaaaaaataccaaaaagtaccgttaagttttccattgcggtccagacgcgttttggtcatcatttattaatacacacacacacacacacacacaccgacacacacacacacacacacacagccagatgatgaaaagagaaaaccaagatcaaaatgcaacagggtaccaaaaaatgaaagtaacaggtagttgtaattcactcagcaagtgtttttgagaatctacatgccacagctccaaataatgttggtagaaatacattctatgtaagttgtaaaaatttaatctgttaatgatagctttgtttgaagttgtgccatattgtttgcccttcctcaataaatagatcaagttccaaacatctgaagtctttttctacatggccagcaaacgat

SEQ ID NO: 175630 - DNA, 601 bp, Human
ataaataaaataaaaaataaatgatgcatttcaatcccacctcttcctggttctttcaaaatcaaggttctggaattaagtctacaattgttaccatttcttcaatgtttcactccctcctcaaccccacagccctacacagtcgtcactgtcttccgaccccaggcatccagtgctcttggtcttcatcttaagtctgaactcacagaggcatctaaccctgatgaccgctctttcctgaggctctcctccccttgtcagccttctttcctggtctttccttcctcgttccagtcactayttaagtgccaaccactccctagcgctttacactgtgacacagatgctacatttttttctgggtgacctttgttctgcatggttccaacacacatggatacaaagcggctccctcttgaatgtcagttctaccagggaagaggatattatattctgcagctgttaggccagcctggttattagtggatcctaaatgtttctttgcttacactgtgccagggcactgttacgaatggcggtcaaattgacctgtagccaagttaatttgcctccacttaagtgtttcctcaaattcagcaga

SEQ ID NO: 175631 - DNA, 601 bp, Human
gaagcttaaagccaatcttgaaagccaagttttcagaaaagcccaaagccagtaattttatataaacagtttatggatgtatacaacaaactcaaaccacacttctttgctttctgtgtgttttaacttagttgtataaaaataatggtaataggctgggcgcggtggctcacgcctgtaatcccagcactttgggaggccaaggtgggcggatcacctgaggtcaggagttcaagactagactggccaatatggtgaaaccccatctctactaaaaatacaaaaattagctgggcatggygacgcacacctgtaatcccagctactcgggaggcggagacaggagaactgcttgaacccgggaggcagaggttgcagtgagccaagatcacaccactgccctctagcctgggcaacagagcaagattacatctcaaaaaatacatataaaaataatagtaataataatgtataaaaatgataaagatacaatgaagaacaaaggatacctttatacggttagtaataacatacagaatacattctatactgttgacccttggacaacacaggtttgaactgcacaaatccacttaaatgt

SEQ ID NO: 175632 - DNA, 601 bp, Human
acacaggactttcagggcaatgaaactacactgtgtgatattcaggtggtggctacatgcctctataaacttgtccaactccacagaatgtagatcaccaagagtgagctctactgtaaactgtggaccttgggtgataatgtttcattaattgcagtttaagtgtacccctctggtgggggctgctgagggaagaaggctgtgcttgtgtggggcagggggtatatgggaactccattaaattttactgtgaatccaaaactgctctaagaaagtctggcttttttttttttttttttttctgagacagagtttcactctgtcacccaggctggagtgtgatggcacgatctaggctcactgcaccctctacttccgggttcaagtgattctcgtgcctcagcctccaaagtagctgggattacaggcacccaccaccacgcctggctaaatttttgtatttttagtagagacagggtttcaccacgttggccaggctggtctcgaactcctgacctcaggtgatccacccgcctcggcctcccaaagtgctgggattacaggcgtgagccacggtgcccggtctttttttttttttttt

SEQ ID NO: 175633 - DNA, 601 bp, Human
aactgaagtttacatccaaaaaataagccaggagagatgaacaggcagagcacacaggactttcagggcaatgaaactacactgtgtgatattcaggtggtggctacatgcctctataaacttgtccaactccacagaatgtagatcaccaagagtgagctctactgtaaactgtggaccttgggtgataatgtttcattaattgcagtttaagtgtacccctctggtgggggctgctgagggaagaaggctgtgcttgtgtggggcagggggtatatgggaactccattaaattttactgtgaatccaaaactgctctaagaaagtctggcttttttttttttttttttttctgagacagagtttcactctgtcacccaggctggagtgtgatggcacgatctaggctcactgcaccctctacttccgggttcaagtgattctcgtgcctcagcctccaaagtagctgggattacaggcacccaccaccacgcctggctaaatttttgtatttttagtagagacagggtttcaccacgttggccaggctggtctcgaactcctgacctcaggtgatccacccgcctcggcctcccaaagt

SEQ ID NO: 175634 - DNA, 601 bp, Human
aatttttagtagagacaaggtctcactatgttgcccaggctggtcttgaacccttagttcaagtgatcctcccaccttggccgctcagagtgctgggattacaggtgacagccattgtgcccagcaaagtcttcttgaaaaagtaaaatgctacagaaacatgaggaactacttttaagaataccctgaataattttccttcattttagttctcaccacaggggatgtctacatttcctaacgatctcccagctcatcttcctgtatcgagtgtctcttctccgtttcatcctcttctctwtattaagcggaaactgccttagctgcctcacatcgcttcctttccataaaccctagttccatacagcctgaaaaaaaactgcccagacttggctttggaaggagctgagcccttgggcgctgctgccacccatctctggcatactttactgagtgtgcgaatgctgaagacaaaccgccccgcggtgcagccctcatgactgcctccagtgcaaggagaggccagcgtgccgaaggccacaaagatcaagttctggcctttcccctaaatcatgttgtccttatttcaagggccaggagc

SEQ ID NO: 175635 - DNA, 601 bp, Human
tttggagacagagtttcaaaaagacctggtctcactctgttgcccaggctggagtgcaatggcatgatgtcggctcactgcaacctccccccaagttcaagcgattctcctgcctcagcctcccgagtagctgggattacaggcgtgtgccaccatgcctggctagtttttgtatttttagtagagacagcgttttgccatgttggccaggatggtctcaaactcctggcctcaagtgatccacccgcctcagtctatggctgatttatttatttctttatttagagatggggtctcactrtatcaatccgctggaagtgcagtggcactatcttggctcactgcaacctcagcctcccagggcttcaagcaatcctaccttagcctcctgagtggctgggactaaggcacatgccaccacacccagctaatttttgtatttttctgtagagacaaggtcttgccatgttgcccaggctggccttgaactcctggcctcaagtgatccacccaccttagcctcccaaagtgttaggattacaggtgtgagccactgcatccagccatttaaaaatttttagtagagacaaggtctcactat

SEQ ID NO: 175636 - DNA, 601 bp, Human
cttctaaaaatcctgatgtccaggctgctaaaatagaaaggatgtgggaccagctgtgggtaataaggatctcaggtgactccaatgaggagcaaagcctgcaaactccttcctctggtgtggtgtttcccagttttgcccggtgagaatcacctgcggctggccgtgcgcagtggctcacgcctgtaatcccagcactttgggaggccgaggcgggtgaatcacgaggtcaggagttcaagaccagcctggccacgatggtgaaacctcatctctactaaaaatacaaagaagttagccrggtgtggtggcgggcacctgtaatcccagctactcaggagtctgaggcagagaattgcttgaacccgggaggcgtaggttgcagtgagttgagatcgtgccactgcactccagcctgggcaacagagtgagactccgtctcaaaaaaaaaaaaaaaaaaatacagccatggccagtttcccaggtatacaacctgtgcagttctgtggggcccagtgcttaaatggaatgccctcttgccctgaaatggtaataacttttgaataaggggccccacgagctatgctggttctgtctgtgc

SEQ ID NO: 175637 - DNA, 601 bp, Human
atggtatctgccatgtggttgatccagtctgcctgtggtggtgtcaatatgtggtgtcaggtaaagattccgaggtacaaagacagtacctgtcctgcctctttcctgaccagtggcagagcctgtgttctcttttgtagagatggggtcttgctatgtttcccaggccagtctcaaactcctggcctcaagcaatccttggcctcccaaagtgctggggttacaggcatgagtcactgcacctggccttgaccctgtggtctttctgtccccttgtgggctgccctccctgagcactcakgtatggcttgggagtacccgggcaggtgatggccggcagcattaacttctcacctttcctccaggtaactgacgatgccctggtgtacagcaccttcctgctccatgacccccgccccgtgggaaacctgtccatcgtgaggactaaccgcgcagagattcccatcgagtgccgctaccccaggtcggtgtgggactgactcatggcccctggtgcaaaagccccttgggtgtggctgcaggcaagtgggctggctatgggctacagcttgcagcatggctattagaactacctaccgaa

SEQ ID NO: 175638 - DNA, 601 bp, Human
ctgctccatgacccccgccccgtgggaaacctgtccatcgtgaggactaaccgcgcagagattcccatcgagtgccgctaccccaggtcggtgtgggactgactcatggcccctggtgcaaaagccccttgggtgtggctgcaggcaagtgggctggctatgggctacagcttgcagcatggctattagaactacctaccgaagcatttgcagctgtggttactgtactgcgtgggattgtggggcctgctgagtctagttcgagccccagaagagtatcaggagcccaactgcagcttakcggaagcttcagagctgctcagccctggtggtggtactatgccagcctcggcccttagggttcagaaatggccttccaatagtgctaggctggggccaggtgcagtggctcatcctgtaatcctagcactttgggaggctgacaggtggatcgcttgaggtcaaggagttcaagaccagtctggcctacatggtgaaaccccatctctactaaaaacacagaaattagccgggtgtctataatcccagctacttgggaggctgaggcaggagaattgcttgaacccaggaggcagaggct

SEQ ID NO: 175639 - DNA, 601 bp, Human
agtgtggtagcgcgtgcctgtaatctcagctactcaggaggctgaggcaggagaatcatttgaacccaggatgcagaggttgcagtgagctgagatggcaccattgcactccagcctgggcaacagagcaagactccatctcaaaaagaaaatgctagtgtgaagtgggtagggagctgataccagtcaggacatcatgagggatgagccatgcccctgggaggggtcatggtaggggttatcctagaacaggatcctggagtgggggaccttgaggctgagatggcctgggcagagccaygtggccacacacccaacgggagggcagtgtgcccttagtaggtgacatgcagcctgggggctggagcccagggactggggtaatgagggagccagacagatgggctcaccagcctcaccacaggtgcccctcctggaatgggtgaggactgaatctccacccagggtcacctggtggctggtgctgaagacaaatgggaactagtgagaaccagctgggaggctggaaaactgggattcaatgaggcctgacccatggttgcagggaccgtagaggctgactcgcaggagctaagagcaa

SEQ ID NO: 175640 - DNA, 601 bp, Human
tcagctactcaggaggctgaggcaggagaatcatttgaacccaggatgcagaggttgcagtgagctgagatggcaccattgcactccagcctgggcaacagagcaagactccatctcaaaaagaaaatgctagtgtgaagtgggtagggagctgataccagtcaggacatcatgagggatgagccatgcccctgggaggggtcatggtaggggttatcctagaacaggatcctggagtgggggaccttgaggctgagatggcctgggcagagccatgtggccacacacccaacgggagggyagtgtgcccttagtaggtgacatgcagcctgggggctggagcccagggactggggtaatgagggagccagacagatgggctcaccagcctcaccacaggtgcccctcctggaatgggtgaggactgaatctccacccagggtcacctggtggctggtgctgaagacaaatgggaactagtgagaaccagctgggaggctggaaaactgggattcaatgaggcctgacccatggttgcagggaccgtagaggctgactcgcaggagctaagagcaattggaggagcttggtgcctatgtgg

SEQ ID NO: 175641 - DNA, 601 bp, Human
tgtggccacacacccaacgggagggcagtgtgcccttagtaggtgacatgcagcctgggggctggagcccagggactggggtaatgagggagccagacagatgggctcaccagcctcaccacaggtgcccctcctggaatgggtgaggactgaatctccacccagggtcacctggtggctggtgctgaagacaaatgggaactagtgagaaccagctgggaggctggaaaactgggattcaatgaggcctgacccatggttgcagggaccgtagaggctgactcgcaggagctaagagcarttggaggagcttggtgcctatgtgggtaggggagatggaggaggatagaggagtcaagggcaggctgcccagtcggcatgagggactgaagctgtcctgtgaccgtggaagtctgacttcagtctctgggcctgacccctgaggatggtggctcacctggtccattggctgtaggtagtattagagaggctggttgtaggctgggatgctttaacctggctccagatacctgagtctggttatcaatagatgcatccatcacttggagtagcttcttccagcagatcctatggggttagc

SEQ ID NO: 175642 - DNA, 601 bp, Human
ggcagtgtgcccttagtaggtgacatgcagcctgggggctggagcccagggactggggtaatgagggagccagacagatgggctcaccagcctcaccacaggtgcccctcctggaatgggtgaggactgaatctccacccagggtcacctggtggctggtgctgaagacaaatgggaactagtgagaaccagctgggaggctggaaaactgggattcaatgaggcctgacccatggttgcagggaccgtagaggctgactcgcaggagctaagagcaattggaggagcttggtgcctatgwgggtaggggagatggaggaggatagaggagtcaagggcaggctgcccagtcggcatgagggactgaagctgtcctgtgaccgtggaagtctgacttcagtctctgggcctgacccctgaggatggtggctcacctggtccattggctgtaggtagtattagagaggctggttgtaggctgggatgctttaacctggctccagatacctgagtctggttatcaatagatgcatccatcacttggagtagcttcttccagcagatcctatggggttagcagggtaggtatctgcagataccc

SEQ ID NO: 175643 - DNA, 601 bp, Human
tggccttggctgggcatggtggctcacgcctataatcccagcactttgggaggccgaggcgggcggatcatgaggtcaggagatggagaccatcctggctaacgtggtgaaaccccgtctctactaaaaatacaaaaaattagccaggcctagtggcgggtgcctgtagtcccagctatttgggaggctgaggcaggagaatggcgtgaacctgggtggtggagcttgcagtgagccgagatcgtgccactgtactccagcctgggagacaaagtgagactccgtctcaaaaaaaaaaaaagatggccttagctgattcccctctcaagcatcctgtggagtactgtgcagggcctgctatcagaccccaaacctgaacctctagggctaaagtatgtgtggtggcttttggttttttgtttaaaaaaaaaaagtcttactctgccgcccaggctggagtgcagtggggtgccatcatagttcactgcagccttgacctcctgggctcaagcaatcctcccatctcagcctcctgagtagctggtatgtactactatgcccagctatcttttcttttcttttctttttttttttgagatgg

SEQ ID NO: 175644 - DNA, 601 bp, Human
aaaaaaaagatggccttagctgattcccctctcaagcatcctgtggagtactgtgcagggcctgctatcagaccccaaacctgaacctctagggctaaagtatgtgtggtggcttttggttttttgtttaaaaaaaaaaagtcttactctgccgcccaggctggagtgcagtggggtgccatcatagttcactgcagccttgacctcctgggctcaagcaatcctcccatctcagcctcctgagtagctggtatgtactactatgcccagctatcttttcttttcttttctttttttttttgagatggagtcttgctctgttgcccaggctggagtgcagtggtgtgatctcagctcactgcaaactccacctccgaggttcacgccattctcctgcctcagcctcccaagtagctgggactaaaggcgcccgccaccatgcccggataattttatttttagtggagatggggtttcaccatgttagccaggatggtctcgatctcctgacctcatgatccgcccgcctcggcctctcaaactgctgggattataggcttgagccaccgtgcctggcctcttttcttttttatagagatag

SEQ ID NO: 175645 - DNA, 601 bp, Human
ttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcytagcggggccgaaaggcagtcccctcccccgcagtctgatttccctcttccccccaaaggcaagcacgaggagcggcaggacgagcatggctacatctcccggtgcttcacgcggaaatacacgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacac

SEQ ID NO: 175646 - DNA, 601 bp, Human; identical to SEQ ID NO: 18723

SEQ ID NO: 175647 - DNA, 601 bp, Human; identical to SEQ ID NO: 18724

SEQ ID NO: 175648 - DNA, 601 bp, Human
atgggccgggcacagtggctcacgcctgtaatcccaacactttgggaggccgaggtgggcggatcacaaggtcaggagacagagaccatcctggctaacatggtgaaaccccgtctctactaaaaaaatacaaaaatattagcgggcgtggtggcgggcacctgtagtcccagctactcgggaggctgaggcaggagaatggcgtgaacctgggaggcggagcttgcagtgagccaagatcgtgccactgcagtccagcctgggtgacagagtgagacaccgtctcaaaaaaaaaaaaaaraaaagaaaagaaaacctttagtactgattgattttttcccatgtgtgtatattatctactcaaattaacaattaattacttaattaaacacaaagccaggcctcacctaattgcttcttggaaggtgaccagagtgctagtgccaagcaaacaactcttctatatctcaagagccctgggcttcagagggccatcttttttgttaattcaagtttctctgaaaatggagacccgtttatgatgacaagctggctacagggtagcatctgccacactgtttcgggggtgccgctgggctga

SEQ ID NO: 175649 - DNA, 601 bp, Human
aaagagactttgcaggtgtgattaaattaaggatcataagagggagagattatccaggattatttgatgagtctaatataatcatcagggtacttaaaagagggaggcaggctgtgcctggtggttcacgcctttaatcccagcactttgggagactgaggcgagcgggtcacgaggacaggagttcgagaccagcctgaccaacatggtgaaactccccctctagtaaaaaaaaaaatacaaaaattagccaggcatggtggtacacacctgtaatcccagctactcaggaggctgaggygggagaattgcttgaacccaggaggcagaggttgtggtgagctgagatcgcaccactgccctccagcctgggcaacagagcaagactccatctcaaaaaaaaaaaaagagggaggcagtgggatcagagtcagagaaggcaacgtgatgatgaaagctgacatttgagtgatgcaaccacaagccaaggaatgcaggcagcttctcaaagctggaaaggacgagcaatggattcttccctacagcctctgtgaggaatgcagcctttgattttaaccccataaggccgatttctgactct

SEQ ID NO: 175650 - DNA, 601 bp, Human
ttcaatgtacttttatcaatggtctcatgtagggtattgctttcaatgaagatattaacatagtttcaactttaaggtttatatctggagtttctttagaagcttcacaactgaccacttagtaaacagtaagcatctgttaagtgcttctcatatgtaagttcattcaattctcacaatcacactataagataaatatgattattagcccatttacagatgaggagacaggctcaaaagacttttatgcaacctggtcaaagtcattcactggtaagctgaggaggtctgtccacttccytttgctgcccccagggggtatcaagcctggcagttagtgtcagcgacttaggaggtgaacaagtgagcaggcctgtaggacctggctaaactgccccaggtctctgtctacagcctcaaacctgtggctgtgggtcccagagacaaggcctcctcagcatcagagaaggatgcctttgtctcagggtcatcaaccttctccaggttgctcaccccctgctgtaaaggggatccccaagaccgctcatcagacaaggagcttgggaactgaggagacacagtcagcctccaggagtgccca

SEQ ID NO: 175651 - DNA, 601 bp, Human
tgtccacttccttttgctgcccccagggggtatcaagcctggcagttagtgtcagcgacttaggaggtgaacaagtgagcaggcctgtaggacctggctaaactgccccaggtctctgtctacagcctcaaacctgtggctgtgggtcccagagacaaggcctcctcagcatcagagaaggatgcctttgtctcagggtcatcaaccttctccaggttgctcaccccctgctgtaaaggggatccccaagaccgctcatcagacaaggagcttgggaactgaggagacacagtcagcctcyaggagtgcccaaaatgccctcacatgctgcatacagattgccacaaataaagtacatccacattctgaagactctgtcctcatcaccaaccaggctggcccctggtgagggctgtagtggttgaggcctttgttggtagacggtaggttaaagcaagccatgattttctattgggaggcttcagaatcagctcagctgtgtttccaagaccaggagggcagaaagcaaaccatcccaggcaagcagtccatgggccatgtcagatatctagacgttatgggtctgtgtttgctctgccat

SEQ ID NO: 175652 - DNA, 601 bp, Human
tgggtcccagagacaaggcctcctcagcatcagagaaggatgcctttgtctcagggtcatcaaccttctccaggttgctcaccccctgctgtaaaggggatccccaagaccgctcatcagacaaggagcttgggaactgaggagacacagtcagcctccaggagtgcccaaaatgccctcacatgctgcatacagattgccacaaataaagtacatccacattctgaagactctgtcctcatcaccaaccaggctggcccctggtgagggctgtagtggttgaggcctttgttggtagacrgtaggttaaagcaagccatgattttctattgggaggcttcagaatcagctcagctgtgtttccaagaccaggagggcagaaagcaaaccatcccaggcaagcagtccatgggccatgtcagatatctagacgttatgggtctgtgtttgctctgccattcctctcggaaactatgatgccctgtatggtttaccttcagtcacaggtgactggcctacagggccattccttgttccaacgacttctcgagtataattaatccccaggcatttacggccagagcagccggccaaatccgtg

SEQ ID NO: 175653 - DNA, 601 bp, Human
ggagcttgggaactgaggagacacagtcagcctccaggagtgcccaaaatgccctcacatgctgcatacagattgccacaaataaagtacatccacattctgaagactctgtcctcatcaccaaccaggctggcccctggtgagggctgtagtggttgaggcctttgttggtagacggtaggttaaagcaagccatgattttctattgggaggcttcagaatcagctcagctgtgtttccaagaccaggagggcagaaagcaaaccatcccaggcaagcagtccatgggccatgtcagatrtctagacgttatgggtctgtgtttgctctgccattcctctcggaaactatgatgccctgtatggtttaccttcagtcacaggtgactggcctacagggccattccttgttccaacgacttctcgagtataattaatccccaggcatttacggccagagcagccggccaaatccgtgaagtgcagtggttgttttaaattatattaacttcttggaaacttattttagggagagaaaactcagtacttctctctatccaatcttgagtaaaaatgttagaagggactggtggagagcctcc

SEQ ID NO: 175654 - DNA, 601 bp, Human
ggaactgaggagacacagtcagcctccaggagtgcccaaaatgccctcacatgctgcatacagattgccacaaataaagtacatccacattctgaagactctgtcctcatcaccaaccaggctggcccctggtgagggctgtagtggttgaggcctttgttggtagacggtaggttaaagcaagccatgattttctattgggaggcttcagaatcagctcagctgtgtttccaagaccaggagggcagaaagcaaaccatcccaggcaagcagtccatgggccatgtcagatatctagacrttatgggtctgtgtttgctctgccattcctctcggaaactatgatgccctgtatggtttaccttcagtcacaggtgactggcctacagggccattccttgttccaacgacttctcgagtataattaatccccaggcatttacggccagagcagccggccaaatccgtgaagtgcagtggttgttttaaattatattaacttcttggaaacttattttagggagagaaaactcagtacttctctctatccaatcttgagtaaaaatgttagaagggactggtggagagcctcccagacatc

SEQ ID NO: 175655 - DNA, 601 bp, Human
tgacagtagagtgtagtccagccactgtgggacatgggtgctgaaagaccacatggagaggaacagtgagtgctgacaagggctagccttgatcactttggagacaccccctgtgtcttctagatgtcagactttccaaatctgtctgctatcctccaaacgtgcattttcaagagcaatggaaaaaggattggacttgatggaatgcagcaagagtcctaggtctgttactacctacctatgaccttaagaaactccttcacccctcagaacccttacagctttctttctgattctatcmtgagttactctactccaagctgagacttttctgcttagatctatcccttcctcctaaacccccaacctccatttctcctggtgtctttctttacacacccctcagcatacacacacacctagccacaggaaccaatgagttaatatttgaggagttggttttcttttgtcctcaatgagatcctggtgaggccacttgagctgttcagctcccttgtggtattttggggatggaactcagaagccaacaatatagaaaaagagtctttggccagctttcccaggggctccatgccataga

SEQ ID NO: 175656 - DNA, 601 bp, Human
gtgtctttctttacacacccctcagcatacacacacacctagccacaggaaccaatgagttaatatttgaggagttggttttcttttgtcctcaatgagatcctggtgaggccacttgagctgttcagctcccttgtggtattttggggatggaactcagaagccaacaatatagaaaaagagtctttggccagctttcccaggggctccatgccatagagagtactgcacccgtgtgcacagggggccctgacatgaggactttgaggataacactattcctccaactctgcttcagcakctccatggattttcacacagacactttaggaaagaaactaagtttggggggacttgacctaatcccacatcacagccccagtaatacagccctggaatttatcacagaaagcctagaatcccatgcatatcccatgcatatgcatccctagtcctatgggttcaaggcttggagctctccctggatttagctgggaaaagttggcagacagttcttctctgtcttctagaaatatggactagaatcgtgagtgtgagattgcaagtaacttttaaaatcatctagtttaacttcacccca

SEQ ID NO: 175657 - DNA, 601 bp, Human
agttggttttcttttgtcctcaatgagatcctggtgaggccacttgagctgttcagctcccttgtggtattttggggatggaactcagaagccaacaatatagaaaaagagtctttggccagctttcccaggggctccatgccatagagagtactgcacccgtgtgcacagggggccctgacatgaggactttgaggataacactattcctccaactctgcttcagcagctccatggattttcacacagacactttaggaaagaaactaagtttggggggacttgacctaatcccacatcmcagccccagtaatacagccctggaatttatcacagaaagcctagaatcccatgcatatcccatgcatatgcatccctagtcctatgggttcaaggcttggagctctccctggatttagctgggaaaagttggcagacagttcttctctgtcttctagaaatatggactagaatcgtgagtgtgagattgcaagtaacttttaaaatcatctagtttaacttcaccccatttcatagaccaagaaactgagaccagagagagaaatggactttcaagttcaccctgctagttactgatgga

SEQ ID NO: 175658 - DNA, 601 bp, Human
aaacaccccctggagaacagatgaatcaggcttcatcttcgcttaactaagtcttccctgagacgactccatttaaatgaacaagagcaggatttcctgggcacactgagagcaccttccagaggcccctccagagccctaaagcctgtatttcttccagtcggcctgtttctttcctggtgatgtcattaaacgccctttgagagtcccacagtgagcagttctgcggtaaaacccgctgcaattaaagtctgagtcctttcctgtctcaaagggcatattcatatagaagaaaggaaarggaaggactggctgtttgcatttggttccaggcctgttgagtagaggtcgtgctcactccaccgaaggtacagggtagccttcagcagaacctggggatttggttttaagcaagtctttcttaggtgtgggctttcagaacacttccttccttgcaatattatttgaaattctcagtgttttagccgtccccagaatattggttcgttaaagctgtgtatttcagatctccagacagtggtcactgtttgtatattttcaatttcaaaccagaaaacaaaagttcttattgattactttt

SEQ ID NO: 175659 - DNA, 601 bp, Human
aatttcaaaccagaaaacaaaagttcttattgattactttttttatttaaaaaataaaaagtaagtatcttcgtaagaggagctttgttttaattttaaagtttaaaatttgattgtgaagacagagaaaaacttgatgattgtagatatattcccctctttggctattcaatcagagaactagaaaatcatgagagatttaatgaccactgcctgatacacatatgtgttttacagatgaggaaactgagacccagagagatgatgaaattggctgaggatggcccagctggtcagtgamagactcagagccagagctggtgcagggctctttctattccttcctgttccctttcaggaacactcaccatcggctttcctgtgaataatgttgagataaaatccttggtgcattatgttttctagtcacaacattgactaggctgccagagtcctctgttctcccagttggttggctgtaggtgttggcagccgccaggagcattctacagaacagaggaggagtgagactctccttgctcaggaaaggcagacctatgacttagcaaatgactcctaagaggagagtgtttcacccacc

SEQ ID NO: 175660 - DNA, 601 bp, Human; identical to SEQ ID NO: 18725

SEQ ID NO: 175661 - DNA, 601 bp, Human; identical to SEQ ID NO: 18726

SEQ ID NO: 175662 - DNA, 601 bp, Human; identical to SEQ ID NO: 18727

SEQ ID NO: 175663 - DNA, 601 bp, Human; identical to SEQ ID NO: 18728

SEQ ID NO: 175664 - DNA, 601 bp, Human; identical to SEQ ID NO: 18729

SEQ ID NO: 175665 - DNA, 601 bp, Human; identical to SEQ ID NO: 18730

SEQ ID NO: 175666 - DNA, 601 bp, Human; identical to SEQ ID NO: 18731

SEQ ID NO: 175667 - DNA, 601 bp, Human; identical to SEQ ID NO: 18732

SEQ ID NO: 175668 - DNA, 601 bp, Human; identical to SEQ ID NO: 18733

SEQ ID NO: 175669 - DNA, 601 bp, Human; identical to SEQ ID NO: 18734

SEQ ID NO: 175670 - DNA, 601 bp, Human; identical to SEQ ID NO: 18735

SEQ ID NO: 175671 - DNA, 601 bp, Human; identical to SEQ ID NO: 18736

SEQ ID NO: 175672 - DNA, 601 bp, Human; identical to SEQ ID NO: 18737

SEQ ID NO: 175673 - DNA, 601 bp, Human; identical to SEQ ID NO: 18738

SEQ ID NO: 175674 - DNA, 601 bp, Human; identical to SEQ ID NO: 18739

SEQ ID NO: 175675 - DNA, 601 bp, Human; identical to SEQ ID NO: 18740

SEQ ID NO: 175676 - DNA, 601 bp, Human; identical to SEQ ID NO: 18741

SEQ ID NO: 175677 - DNA, 601 bp, Human; identical to SEQ ID NO: 18742

SEQ ID NO: 175678 - DNA, 601 bp, Human; identical to SEQ ID NO: 18743

SEQ ID NO: 175679 - DNA, 601 bp, Human; identical to SEQ ID NO: 18744

SEQ ID NO: 175680 - DNA, 601 bp, Human; identical to SEQ ID NO: 18745

SEQ ID NO: 175681 - DNA, 601 bp, Human; identical to SEQ ID NO: 18746

SEQ ID NO: 175682 - DNA, 601 bp, Human; identical to SEQ ID NO: 18747

SEQ ID NO: 175683 - DNA, 601 bp, Human; identical to SEQ ID NO: 18748

SEQ ID NO: 175684 - DNA, 601 bp, Human; identical to SEQ ID NO: 18749

SEQ ID NO: 175685 - DNA, 601 bp, Human
caacagcattcatgtaattgctaatgccctaaactgcaaggtcatcttttattcttcttacttaaatcctatatttaaaatatgagcaaatgctgtttgctgcaccttcaaaatatgtcttaataaatatgtcacctctcatcatttgtgacatcactactttagtacagtacatcatcatcatcactcaccttaagtagtgtcctaattggtctttctgcgtctcttcttccccttaacccattgtgttttccacacaacagccagaatgattttttaaaaacatactaaatcatgtcakttcctactgaaaacactttcaaggctgtcacacttaaagagatttctgtaagactctgtatgacctatcctcagagttctctgttccttggacttgccatactcctgtttccaggctttaactcttgctgtctacttattctcccccaggatctttccatggcacattttgtcattccattcagtccttgctcaaatatccgcatcactaattgactctatattagatatttattttgtttattgactgacatgagcagagtcttcctctatttcattcattactctatccttagtgctt

SEQ ID NO: 175686 - DNA, 601 bp, Human
caagcttgctatttgctaggagggagtctaggaattttatgtattcccctatagccaaagtgtgactagtagtcagccagccaatagaaatgtcttattttttgtatacatttttctcagctatgattcattctatagaaaagactggggcatagctctgatacttttaaataacggaaaatttcatgtcttactagttcaactattggaaagagactatagagacctcatgtttcgccctgagcccaaactcttgggggaaggggcagattacccagctagattagcttgctgaccccccatgattaagcagctatgacgcagaatggatcacttcatattaccagtattaataaagtagtagaaggtggtggtagtgatagtagtaacagtgatagcaattaatatttattgagcactgatggaatagtgattccttcatggggttagaaaagggtactgacattttacaaccctttcagtttacttatgggtttatagataaggaaacaaagacttaaaagggaagtaacttaggcacgctcacacagttagaatatagtggagtaagttttgcaaaaagataaaaagatggaggata

SEQ ID NO: 175687 - DNA, 601 bp, Human
gactgtgggttctggagccaggctttctggatttgaatcctggttttaccaaatactacctcaagccttaacctttctgagatttagtttcctcattgtaaaatggtaataatactacctacctaataggttgttatgagcattagatgagttggtgccttaaaaagtacttgttaaaacattaagtggcctggaatcagtttcaaattaaatatcaattctaatagaataatatattctggaaatagagcattgaggaagatggcagagagaaaattttccaagaaataatatcaaacamttccccaaactgaaaattgaaagggctcagtgaccaagtaatcagaacaaaggataaaaaaagccccacatgaaatttttgtatatcatagattaaaaaaaagattctgaaaactttccagaaaagaaagacaggaaacatataaaggactagaaatcagaatactggatttctcaatgcagttctggattctagaagaaagtaaagtagtgctgtcaaaattcagaaggaaatgttatctgcctgccgacaagcaaaaaaaataaatttttatacatgcaggaagtcaagaaaattcaa

SEQ ID NO: 175688 - DNA, 601 bp, Human
tcaattctaatagaataatatattctggaaatagagcattgaggaagatggcagagagaaaattttccaagaaataatatcaaacacttccccaaactgaaaattgaaagggctcagtgaccaagtaatcagaacaaaggataaaaaaagccccacatgaaatttttgtatatcatagattaaaaaaaagattctgaaaactttccagaaaagaaagacaggaaacatataaaggactagaaatcagaatactggatttctcaatgcagttctggattctagaagaaagtaaagtagtgcygtcaaaattcagaaggaaatgttatctgcctgccgacaagcaaaaaaaataaatttttatacatgcaggaagtcaagaaaattcaactttttactttctcttaggacactaatagaggatgaggtccaggaaatgtgatccagcagtagagaagggaagtccaaggacttcagacttgtaggagacttgagcagtaaccaatataggttggaaccaaaagttggaagatctgggcctggcacggtggctcacgcctgtaatcccagcactttgggaggccgaggtgggcagatcacgagg

SEQ ID NO: 175689 - DNA, 601 bp, Human
gatggctaagagtttaaatttgttttctatagaaacagtatatgggagggggctaggaattgcagtttttgttataatctctaatagcatgtctttttttaaactgtccacatattaacattattttggatgatataaaataattttttaaaaatcgtgcatagataatgtacaagtgaaagagaagccagtgattttagcatacctctaaagaaaaaaaaaagcaaattcttactgaactgaattcctgagtagttatttcactaagtctctcagattgctagcctgctaaatgtagaarttcttgctgccttaatgcccttctctccaatggcagctgcctcttgttctgcgaggggaatagcagttgttaacacacagtagaacaaaacgattgtagtcagatgttaaccacatatttagtatactaatgcagtagaatgaaatgaaacaatagacaaaaatagcacaaatactgacttaacagaaacactggattgttgtgtacatccctacttcagggaggtgaagtgtgacttaggtagcttaaaaacaaactcattttgttgatgctgaatgatatcagaattaagttgagatt

SEQ ID NO: 175690 - DNA, 601 bp, Human
caagttctggaccaggaagtccatttcagctcccaggtaagactttattttattgataccaaaaaaaaaaaaaattcctaagaatcacagttgttcttactgtgggccctctgggtgaactgttacatgccaaggtatagctgtttctgactctttattctttaggtaattgtttgatttccagaagagtttagattttattttgccaattaccgtatgtttaaaaaatggaagtagccctatttgacttaaatattttcttctattttatgacactcagtaccatttattgtcttttatrtaactgatactgtgatgaaagctatggcattcaatttaatcttcagaatgactatgtgagatagatattcctgttttacagatggaaaaagaaattctaaagtaaattttaaacttttaagtaccttacctagggtagggctaagaactagaggttcagacccaggtttgtctaactctaaagtctgtgatctttcacctttactgtgtggcttttcaaattatttaagactttagaagttaaaatgaatcctggttatctttagttagataactgatgaactgatttcactggagaaag

SEQ ID NO: 175691 - DNA, 601 bp, Human
gtaaccagagaaaactcaaacaaacatggggagaatgttcagactcacacagacgtggccctggctgggaatggattttttttctcatcagcatcataacaaaatgatgctgaacaaaacaccattgaacaaaacattattcaaggacctacagtatattctttgtgatttctctactgcagcaaaatatcaattggtatagttttttcttttgaagagaaattaagtgccagctgtttaacttgctattaggaatttgctcaaaaacaaattttcatagtttgtcttagattcagtgctrattgtagttctgtctcaaaatacatcctgtacaaaacattgggatgaaagacaaattcggttcttatttataattactgagacaaaaaagtatagctgtagcttttgcaaaattttcaactatgagtgttgaaactcaaagattttctagttaacatttagtttcctaagtgaattacctaaccatttaataggacacaacagccatatttggatgttgcacaagcgttagacaattgctgttagtgttgatggcaaattttgaagggacatagttttactttccagttttaaatgacag

SEQ ID NO: 175692 - DNA, 601 bp, Human
gggagggtagaacatcaaaccaaagaggtttattctccagccttaaggcctaatgcaatttgctttgctaggttttcagcttccttgacccatcatcactcccttattttttgtttttccattttggaatgggaacgtctatcctgtgtctgtcccaccataagcacgtaacttacctggtttcataggtttacagctggaaaggaattttgcctcaagtctcgtatgtcatatgtagatgatatttggatgatactgggtttacaacattagagttgatgtggaaatgagttaagacttyaggggctgttgggatagaatatatgtgtgtattttacatgtaagaatgatgtgaattttgggttgctggggtggaatgctaatggaccatattgaatctccctaaaattcatatgttgaagtcctaactaccagtgtgatggtatttgaagatggaaataattaggcttgagagtgggattgtcataatgagattagttcccttataagaagaggaaaagaaacagatctttctctaagagcatgcactgaggaggggccatatgagcacacagtgagaaagcagctgtctgcaagccag

SEQ ID NO: 175693 - DNA, 601 bp, Human
tctccagccttaaggcctaatgcaatttgctttgctaggttttcagcttccttgacccatcatcactcccttattttttgtttttccattttggaatgggaacgtctatcctgtgtctgtcccaccataagcacgtaacttacctggtttcataggtttacagctggaaaggaattttgcctcaagtctcgtatgtcatatgtagatgatatttggatgatactgggtttacaacattagagttgatgtggaaatgagttaagacttcaggggctgttgggatagaatatatgtgtgtatcttacatgtaagaatgatgtgaattttgggttgctggggtggaatgctaatggaccatattgaatctccctaaaattcatatgttgaagtcctaactaccagtgtgatggtatttgaagatggaaataattaggcttgagagtgggattgtcataatgagattagttcccttataagaagaggaaaagaaacagatctttctctaagagcatgcactgaggaggggccatatgagcacacagtgagaaagcagctgtctgcaagccaggaagcaggtcctcactagttaccaaatcttctg

SEQ ID NO: 175694 - DNA, 601 bp, Human
cctaactaccagtgtgatggtatttgaagatggaaataattaggcttgagagtgggattgtcataatgagattagttcccttataagaagaggaaaagaaacagatctttctctaagagcatgcactgaggaggggccatatgagcacacagtgagaaagcagctgtctgcaagccaggaagcaggtcctcactagttaccaaatcttctggcaccttgatcttggacttcccagcccccagacctgtgagaaataaatttctgttgtttaagccactcagccttacggtattttatagcstgagcaagctacgactattgccgatcctggtatttctataactttttaaattgtcatattcaagctgatttctagtgcttgttttcggatatagattcacagctaggaaggacagtgagacttgtgaaatatctgaaaattttctttttcatgtaatacttgggttgggttaaaagataaacacatggacaatctgagtttctgatatgtattaaactctttctgtgtctggtttgttcacagatgttcagcctgttgcctatgaagagcctaaacattggtgttcaatagtctactatg

SEQ ID NO: 175695 - DNA, 601 bp, Human
ctgatatgtattaaactctttctgtgtctggtttgttcacagatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtaatcttgtcattttcctacatttaatcgaattcartcatttgttgtacttgccatgaaccatgcattgtgaaaggtgctagaaacatacaaagaagtttgacacgtggcctctgccttaagttgccgatattgaagaatgtattaatcaaataaagacatgatgttccctcatttttttgtcctgcttagtgtttcttcccagtgctaaggatctgaaatcatactaccactttgttttttgagtgttaccctgactggaacataagctgtacaggaacttgctttgttcacagcagtatccccagtagctagaagagtgcctcattgtaaatac

SEQ ID NO: 175696 - DNA, 601 bp, Human
gtacaggaacttgctttgttcacagcagtatccccagtagctagaagagtgcctcattgtaaatacacaacacatatttatggaatattgtgtatgaatgctggtgaaggattagaattttataattaaggtatttgtggagtattttgggttgagatgacttgtaagtgttaccatgatgtgagaggagcggaattagaaatgggaaatctagtgtgaatgatactccagtggcttcaccaccactgctcccatcttttaaatttaggcaataaggttttattaataattcatcctgcaagatagttgccataacaaaccgggcccttttcatactgcaataaaatgtcaaagtctcatgcatcaagtgatcaggaaggaaacccatcccaggtaaagtgtattgcctgtttcttgagaagttttgtttttaccccttgctgcattttgcttctttaacttgagggcatcttggtccaaaataggaataaaaggtaaataaatataattgtgataggatttcttatagaagtgattcaaaaaaatcctgcggccaaaaataagttacgaaacaaagttttcattgtcttgagtttactgc

SEQ ID NO: 175697 - DNA, 601 bp, Human
gtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaaggtgagttgtgacctctaacataatttgagtcactataaatgtgtatattatgactttaggttataatttttaaaaattgttaaatgaaagttgataattgcttttggcstgatttaacaggtttttaaataaaattattgaatttgtaattttaactacataatagatctaagatttcattttgtaatctagacattataaaatgcatgattgatattgattttgatattgaataggggctgagattataaggaattttagttaaaagactaaatttctagaaagcatttgtattagtccattttcatgctgctaatagacatactcaagactgggtaatttatgaagaaaaagaggtttaatgaactcacagttccacgtggctggggaagcctcacaatcatggcgg

SEQ ID NO: 175698 - DNA, 601 bp, Human; identical to SEQ ID NO: 19616

SEQ ID NO: 175699 - DNA, 601 bp, Human; identical to SEQ ID NO: 19617

SEQ ID NO: 175700 - DNA, 601 bp, Human; identical to SEQ ID NO: 19618

SEQ ID NO: 175701 - DNA, 601 bp, Human; identical to SEQ ID NO: 19619

SEQ ID NO: 175702 - DNA, 601 bp, Human
cccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacaggtacgctggggccggggctgggcggcccgcggggagtggggagtgcttggggtgggtgcagggcgggttggcgtcatctgtgggctgcaggcgcgggcgtggccgggcgataggccaaktgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcggtgagtcatggcttctggttttgcagtaaacggaaccagggagaggagggaacgcacaatttccacaactggttagatttcaagttggaaatgatgagcttggcttgggttaaacctttctggactgtgaggggtccgagttaat

SEQ ID NO: 175703 - DNA, 601 bp, Human
catactggcatcgttaccagtaggttacgagtagaagattgaataaatcttcaaacttattttttaaaggtattaccaagtatatatatattttattatttttaaattaggcagtcttgaaaggacgtgaaactcaatatgactgcccaaaagggcacgttggtttctctttcagatttctttttacagttgaggctggttacctggacagaatttaagcttcagcttgtgaaagtaaactcattttttctgaaagtatactcattttctaataaaggtgcagttttaaaatatgtccatrtgatattattttaaaaatatctttactgagcaagtggagctaggattgtcatgaaatgcttttatttgttttgtttttgttttttaagagaaaagtgaaagcaagtttattaagaaagtaaaggaataaaagaatggctactccataggcagagctgccatgaaatacttctaagaaggctggagtttctagaatttcatttcctggaattaaatactcctcttaacgccccaatttcagaggtagaatcctggaaaactatatattactttagaaatagcttttccctttttctaaagt

SEQ ID NO: 175704 - DNA, 601 bp, Human
atttcagaggtagaatcctggaaaactatatattactttagaaatagcttttccctttttctaaagtgggaggaagagctggtatatttattaagcggaccatgaccttttctgcaaacagatacttgaacgtaccttgtactagatactgttttaaaaagcaaccttttgctgtgacaaatgacccataaacacatagttcatttgaggtgtttttgctttttctgccaaagttggggtggtgtttttgtgggcaaatggcagattttcaacgttttgtttatcaaagcattttgaaaasagaagcagggccacttgttttctagcaaacaggaatagcttctatttcagtaattttaatttctctaccaaggacacttcaatcagtaagaaaaaatatatttacgagtgaaataaaaacaagaattatttggagcacttttcaaaatgcagcattgtaagaataagtaaacaatataatttttaaaggacttcatcttttgttaacctctcaaaaaagtaatgaaattagcattgctgagtgtaaatgtttttaaaaatgttttataatgttttgttattgttcctcaccactgtgtga

SEQ ID NO: 175705 - DNA, 601 bp, Human
caaggacacttcaatcagtaagaaaaaatatatttacgagtgaaataaaaacaagaattatttggagcacttttcaaaatgcagcattgtaagaataagtaaacaatataatttttaaaggacttcatcttttgttaacctctcaaaaaagtaatgaaattagcattgctgagtgtaaatgtttttaaaaatgttttataatgttttgttattgttcctcaccactgtgtgatgaaaaacattttattcttctaatgtcaaataatctgtgatgcagaaagaatgggagtttgttgcttcmgggcttatttgaattctgagcttgtttaacgtgggcttttgggtttgcgctatgttccactaaaaggcatcataactgatgatcagtagaagggtgaatttagcttgtcatcatcagtaagagagatgaatttatactcagtcatatacataatactcctctaactttttgtgattatgaatatatggatctggtttttcggaaccattataagtaaactgtcctgtaaggatattgaatagacatccttgatttcacgctcatctcttgatcttcccaactagtgtttggtggttgcat

SEQ ID NO: 175706 - DNA, 601 bp, Human
gatggcacaggatgcagtaggagaaatgggaagaggtcagacgttgagctttggaagttaggttaaggattccaaatagaagctattggaagattttaagtgaaggaatgatgtgatctaatttgtattttaaaggtatttcactgaatcttagttgctgtcacttgtaagacatattgttttatgtaacagcaggggaaaatgctgtcaattgatatgtcattgattttaggaagtatcttaatttcaaagatgtcaaaaaaaatttgtgcatcttagaattgaggaaagcatggattartgatagaggattactgtatcccgtcccccaggtggagagttttagccattagaaatctatagattaggcattcattgataaatacttttgataattttctcaaaactataagcttgatagggtaatgcgtgcctatagtcctagctcctctggaggctgaggtgagaggattgcttgagcccaggaatttgaggctgccatgagctgtgattgtgccacttcactccagcctgggcaacagagtgagactctgtctctaaaaacaaacgaaaacaaaaacaaaaatgtagctggacatgg

SEQ ID NO: 175707 - DNA, 601 bp, Human
aaggaatgatgtgatctaatttgtattttaaaggtatttcactgaatcttagttgctgtcacttgtaagacatattgttttatgtaacagcaggggaaaatgctgtcaattgatatgtcattgattttaggaagtatcttaatttcaaagatgtcaaaaaaaatttgtgcatcttagaattgaggaaagcatggattagtgatagaggattactgtatcccgtcccccaggtggagagttttagccattagaaatctatagattaggcattcattgataaatacttttgataattttctcraaactataagcttgatagggtaatgcgtgcctatagtcctagctcctctggaggctgaggtgagaggattgcttgagcccaggaatttgaggctgccatgagctgtgattgtgccacttcactccagcctgggcaacagagtgagactctgtctctaaaaacaaacgaaaacaaaaacaaaaatgtagctggacatggtggcttatacctgtaatcccagcaacccaggaggctgaggcaggaggattgcttgaggccaggagcttgagaccagcctggacaacatagtgagaccttgtc

SEQ ID NO: 175708 - DNA, 601 bp, Human
acggggtttcagcatgttggtcaggatggtctcgatctcttgacctcgtgatctgccctcctcggcctcccaaagtgctgggattacaggcatgagccactgcgcctggctgcagattatatttttatagaatatattttttttaactgccaaatgcctgtaccaatatggggctggcatcccaaagtacctagtgtctgtctgttttgttcacatactctccttcagatcagttattccttgacttctattattgttcctaagctcatgattcctagccttgcttctctgatctggtccrctcattaaggctatagatgtggtctaattatttccagatgacttgcaggatatttatacctggattttaaattgtcattgcagactttagatgttgaacataaatttggaaatatgtgtgctcagttcccttctttgtcagtggcactgctggttttctgtgatttttgactccttaaatctagcccattaataagctttgtcagttcttcttttccatttcgggttccatggctttattcctcagtctgttttctggatttgccttcttcctacatggttctgatgctattgttccctt

SEQ ID NO: 175709 - DNA, 601 bp, Human
agtttctgttcttccttcctttaaactgtcatctccaatcagaacagacccatcattttcccccgcccccaccaaccagcacattcacctgcttgcatgcatgtgcacacacacaacctggtgactacttttgtgactttgctcttgctgttcacccagactggaacctgttacctttcctccctctctagtctatatttctacccatcttcctaagcccttgccaaccatagcccaatagttttctttaatttctttgtattgattatctgattatctttattgccttgtacatgcctcmtcatttttcccaccttttttttttttggtgacaggatcccactccctcacccaggctggagtgcagtggcacaatctcagctcactgcaaccctacccttccggggtcaagcgattctcccacctcagcctcccgagtagttgggaccacagacaccaccacgcctggctaatttttgtatttttggtagagatggggtttcaccatgttgctcaggctggtcttgaactcctgacctcaagtgacctgcccaccttggccacccaaagtaatgggattacagatgtgagccaccgtgcc

SEQ ID NO: 175710 - DNA, 601 bp, Human
gttcttatggagtagtagtaaggcttgacaagcccagcaggggattttgatatctccctctcatgtactcagcctagggtaccctttttcatttttcctcatatattctgtcccacacaactgccaataagtagtaaatggccaaaagttagacatagtggtaaagaagcaaaacctatgtttcatagtttagcttgatgttaagtggtttttaatgtagttgtttctgttttcttaggaaatatggaaatatttttgtgccatacctcctttttgggtaatgtgacttgtcattggcctytaggttttaacaggtgactttggatcttttccataagccctagggcttaggtcctcagagattttggaagaacagctgtcacctccggctcccctccatttctccaaccttttacatatactgtgtaattttaatttcctttgccccttctttaaacaaaccctaaaaagacgaaacgtatgctttgcattaagagttgggcatatgcctaggaaacaagctttctgagcaaacttaatataggtaacttagttttttttgaagccatgtattacatctcaaagccctgaactgcaagtt

SEQ ID NO: 175711 - DNA, 601 bp, Human
tttgctctgggggataatatttaatattatccaatattatcagtatttgataataggagtgaaatgagcctattacacatgaactccttggagaatactttttctttatgcctgtggatggctttatttttttaacgaaggtcttgaactgagacatggggagctagacctggggtcaccatttatccaagttggcatccctgtgaccagcaatgcacaacaacaatgctaagtttactggggccttagtaagtatgtgttttatttgctgggcctcccccaacaaatgtcactctgtatraataacttttcctgtttatttttcatattaagaaatttcactggaatagcaatgcattccatctctgtgttttagttcaggtaccactttgtttcatatcaactcctagtgttctgtcataatcacacatactggagatccatttgaatgactaggagctttcatttttgttctgttttgttttttgagatttatccttttagttagaaagatagcgtggtaagattgggagggctgcgtttgttgtttttttattcagtatagctcatctttttcgtttagcaaaggcagttgctttgg

SEQ ID NO: 175712 - DNA, 601 bp, Human
aggatacttaatataaaaagaataactgctgaatgtcttgatgatttcctaatttctgatgttttgtttctttactgttcttggcaaatcagctcttggcagacttgcatggcagccagccgttccaggattgattctttgaaaaggagcagtgtgtctttaaatctttccttcacccaaggcatcctgcttggtgcacatgtgcataagcacatcactgggctctttcatggaatgagatgaagtgcgcctttgtatacatgattaaaattgaaccctctggtgatgtcaagtatatttrtcctttgggtctggaagagagatgatgctgtgaaaactagcaagattattttaatgaacaaaggaagactcattgccaagggttaaataaaaaataaatggagtttttagtgacttcattagaaataatgattttattgtgtttagttgcctctgattaaccttgttgcatatctttaagttactaataagctgctgcctagtggattttatataaagatgcttactgtagtttttaaaggtggtgttgtagagtgattttacttcatgtgatgccaggtttacacttttgaacttgcta

SEQ ID NO: 175713 - DNA, 601 bp, Human
tttgtttctttactgttcttggcaaatcagctcttggcagacttgcatggcagccagccgttccaggattgattctttgaaaaggagcagtgtgtctttaaatctttccttcacccaaggcatcctgcttggtgcacatgtgcataagcacatcactgggctctttcatggaatgagatgaagtgcgcctttgtatacatgattaaaattgaaccctctggtgatgtcaagtatatttatcctttgggtctggaagagagatgatgctgtgaaaactagcaagattattttaatgaacaarggaagactcattgccaagggttaaataaaaaataaatggagtttttagtgacttcattagaaataatgattttattgtgtttagttgcctctgattaaccttgttgcatatctttaagttactaataagctgctgcctagtggattttatataaagatgcttactgtagtttttaaaggtggtgttgtagagtgattttacttcatgtgatgccaggtttacacttttgaacttgctatcagagaaagaaataggcgaagaacagtttgttttgtataatgtgtccttagtatattagga

SEQ ID NO: 175714 - DNA, 601 bp, Human
actaaaaatcaacaatgagattagaagtgtgaaaagattgcagctgctaccagaatcttttatttgcaaagagaaactaggtaatacaaacattatttaacttttggggtgaaactctgtgaaattcatataagaaaaaaatctgaaagataatgttcaaaagactgaaaatttctatatgagattaaagcatattgaagacaatgtggtttgtttaagaatgcaaaggtttaaaaaatgtgaaagttttgcttataatttgaggagtttgtttctttcctgtttttcttagggtcatagwgtgctgaattatattgttatgagataacactagtatgtaatttattacactctgatgatagttcatagtttctgtactaatctttggagatctccctattgagatctccatattggtatttaaccaatatggaggggatctgtgtttcatgaaagtaattcaatgtcaagttcattattgaagattattggaggaaaaactacaatcaaaatgtttgtttaaacctatataaatttgatggctattttatacagattgatactttaccaaaggtttgcattctaggtaaggttttgctta

SEQ ID NO: 175715 - DNA, 601 bp, Human
ttacactctgatgatagttcatagtttctgtactaatctttggagatctccctattgagatctccatattggtatttaaccaatatggaggggatctgtgtttcatgaaagtaattcaatgtcaagttcattattgaagattattggaggaaaaactacaatcaaaatgtttgtttaaacctatataaatttgatggctattttatacagattgatactttaccaaaggtttgcattctaggtaaggttttgcttaaactctataaaattattaatagatacaaagaagacaggttttccyttttatcatttttcagttaaaccaaactgtgagaggcagttataggtggttggagcagaagagataaggtggagaggggaactgacattttttaagtgcctgtttcattctgtacttgtgcctgtacatatgttattccatttaatcttcttagtaaacttaggagggttttaagagcctagtgggaatgttgtggtacaatgggaagatggcatttatagcagtcctttaggaaaggctggctagattgacattgttgctttgaaggcctaaaggcttattcttgttcattcctagggg

SEQ ID NO: 175716 - DNA, 601 bp, Human
gttttatgcccattttatagatcaggaaacagatctagaggaggctcacttacttaagggtcacagagccaataaatggtgaaatacaggataggaatagatttggctgactcccagccttttaaaacaacttttacaggaatgtagctcagattgttattctttatctggtttctcttaaataaagaaaaatgaaatggaagggaggaggaacattaaatactgttaaattacaagtttatggactgttataatgaagtatttttaataaagtcttatgttgagtaggaatatgctgctyatttggcaagtcattttaatgaatttttactgtggttcatagcacctagtaactataactaggcactgttatttatccttttatttataagttcctaattaaatagttacataccaggttgctgaaggaaaacattcatttaaagaaaatcaattttcacatttgaaaaaagcccttgagccaaattgattttaaagaatgatatcttgacagcaaatttcaactcaagattgcaagtcacacaacaaagatttagacattagctgcatatctctttccttcttcttatcgatcctgtta

SEQ ID NO: 175717 - DNA, 601 bp, Human
cgtggagctttcaattataacaacgcttatctggtgtagtggtggtgtctcctttaaacagttgagcaaaaaggtgaggatcagaggggcaggttatttgtccaaggctatacacttggtaaatagcaaaacaagtgggaacctcggctgcagtttgctagtgcgtccgtactttactatgagtcacctggggatcttattaaaatataggttctgatttggtaggtctgtgggggcctgagattcagtagttctaaacagttccaggtattgtcagttctggtgatctgtcgcccacatkttgagtagcagtgtggtgactaaaaatgagtgcttttgagccacacggacttgggtttgtgcactgttctgccactaaccatggggccttggacaggctttctgtaccttgacctgtttttaaaatggagatagtaattaggaaagaacttctgatgtgaaagcttgaaaaacgcttgacacaggtgctgatacatagtcatcatgcgataaatgctattaatttaccaggttctaagcgttaacaggagcagttctccactgtatccttagtgcccagaacagattgatagctatcagg

SEQ ID NO: 175718 - DNA, 601 bp, Human
tcagtagttctaaacagttccaggtattgtcagttctggtgatctgtcgcccacatgttgagtagcagtgtggtgactaaaaatgagtgcttttgagccacacggacttgggtttgtgcactgttctgccactaaccatggggccttggacaggctttctgtaccttgacctgtttttaaaatggagatagtaattaggaaagaacttctgatgtgaaagcttgaaaaacgcttgacacaggtgctgatacatagtcatcatgcgataaatgctattaatttaccaggttctaagcgttaacaggagcagttctccactgtatccttagtgcccagaacagattgatagctatcaggaaatcttcgtatgtatgaatctctcacaagtcttttctacaactgcagcctatgagctagagaggttgggcacagctctactaatttgatatcatggaatttttagcttttatatctaagattcagtttcatcaagtcttgcactgtacttcttccatgagggaatttggttcatgcttatctttgtgaattatttgtgaatatttattcaccatgttgattgggtttggcagaaatagaggac

SEQ ID NO: 175719 - DNA, 601 bp, Human
gcagtgtggtgactaaaaatgagtgcttttgagccacacggacttgggtttgtgcactgttctgccactaaccatggggccttggacaggctttctgtaccttgacctgtttttaaaatggagatagtaattaggaaagaacttctgatgtgaaagcttgaaaaacgcttgacacaggtgctgatacatagtcatcatgcgataaatgctattaatttaccaggttctaagcgttaacaggagcagttctccactgtatccttagtgcccagaacagattgatagctatcaggaaatcttygtatgtatgaatctctcacaagtcttttctacaactgcagcctatgagctagagaggttgggcacagctctactaatttgatatcatggaatttttagcttttatatctaagattcagtttcatcaagtcttgcactgtacttcttccatgagggaatttggttcatgcttatctttgtgaattatttgtgaatatttattcaccatgttgattgggtttggcagaaatagaggacagttttttcacttgattttgggttttgattttactttaaaaaatattctaggggaaaatgtagc

SEQ ID NO: 175720 - DNA, 601 bp, Human
aatttaccaggttctaagcgttaacaggagcagttctccactgtatccttagtgcccagaacagattgatagctatcaggaaatcttcgtatgtatgaatctctcacaagtcttttctacaactgcagcctatgagctagagaggttgggcacagctctactaatttgatatcatggaatttttagcttttatatctaagattcagtttcatcaagtcttgcactgtacttcttccatgagggaatttggttcatgcttatctttgtgaattatttgtgaatatttattcaccatgttgaytgggtttggcagaaatagaggacagttttttcacttgattttgggttttgattttactttaaaaaatattctaggggaaaatgtagccaacatatacaaagatcttcagaaactctctcgcctctttaaagaccagctggtgtatcctcttctggcttttacccgacaaggtaagagatgaaatactgtcacaatttaaatgactgtaaagaatagtaagtatacttaatattcttggtgagtatgacatctgactgccctcttttctgctcctggcgaaatgttcctcttctaagacta

SEQ ID NO: 175721 - DNA, 601 bp, Human
cagctctactaatttgatatcatggaatttttagcttttatatctaagattcagtttcatcaagtcttgcactgtacttcttccatgagggaatttggttcatgcttatctttgtgaattatttgtgaatatttattcaccatgttgattgggtttggcagaaatagaggacagttttttcacttgattttgggttttgattttactttaaaaaatattctaggggaaaatgtagccaacatatacaaagatcttcagaaactctctcgcctctttaaagaccagctggtgtatcctcttytggcttttacccgacaaggtaagagatgaaatactgtcacaatttaaatgactgtaaagaatagtaagtatacttaatattcttggtgagtatgacatctgactgccctcttttctgctcctggcgaaatgttcctcttctaagactaagcttaatattccttaagtgctatttactttatctttgtatctccatgccattttgtacatatttttattgtagtctcttttccatggactataattgttgatatgatttctttccacctaaggttgggaataccttgaaggtagggaatat

SEQ ID NO: 175722 - DNA, 601 bp, Human
gaggtcaggtacataatagatgctctttctctctgtgtagatacatatatatatgtctatatagacatatatttagatatatatgtctatatagacatatatttagatatatatgtctatatagacatatataaataatacatggtctgtaattggatctaagtttttttttttaaaccatttattggaggctctttgcaggcacttagttggatatttcacatgcattcttatttactgctaatgacttcgaagtaaattatgtggtacttattttatagatgatgaaatcataattcartaaggtttataattcactcgagatccttatattagcttctcatttttttgcagttaaaaaaattaaaatctcagtgtcttacagtgaaatttacttctcactcgtgtacatgttgtgtgtgggtttgctttggctgaaggagttgtctttatccaggacatgctcctcttgtagtagaaggaaaggagtgccagtggcccaattatgtgttggttcaacgcttttgcccagaaattatatatgtcacttccactcacgttttgtcagaaaaaataagacaaaaatggccaagcctgatgg

SEQ ID NO: 175723 - DNA, 601 bp, Human
aaacaggcttattttctcactagagaccatagtcagtatctgacgtagaaacgagctggcatttctgaactgctttcatggttgagaccaatgtgtaagttaggagagttttgttgacctgttccaagttgctagggtagctttatttctgtatggtcacattatggtgacctggtaattattttggcagtgatgatggtagaacttgtgcatcaggatttcctgctacaaggccaaaagcctgattgtggaacttttttttctgctaccaccattttactacatattagtgttttcagawtgtttgaccctggggtgggtcatgaaatccatttaatgggtcatgttacaaaaaaacaaaacccacaatggaaaaatccatatttattttataaatagtattcctatttataaaataggagtaaacttctatttcaattatgtataggtaggtgtatactgtgttgcaatgtaaaatttttatgtggttcacataaatgtttgaatgatactgctatatgtgatgttaacacataccaccttagtaactgtaaaaatgtggtgggtagatagctcccttaaaaaaaaaaaaaaaaaaaag

SEQ ID NO: 175724 - DNA, 601 bp, Human
ctgtaacacagaagctcagaggttgttgcccagtttggtgtaacgtgagatgttggattagaagcaggtgacacacctaaatgagattagggggagaagaggtagtgtaggaccagttaatgcaggaagagagtagccacatgttcctccatagtccctgaggaatcacactgcattgaattaccatgtagcacagagcagcaatgatcacccttaaccatcaataaagtgtttgaattagataagaaagtacaaatgatatagtgtgtgttatataaatggttagtttttttttttttttatgcttaacgggtaagtttcacttttcttaggagaaaaacaaaacccactgtttaatgcaggacgaatgaaatgtttttaaatccttatttttcccttttcctttgtagacaatactgtcagagttcaagacacagattggaaagaagtaggtatttttaaatattaagactaatgtccataacacagaaatgactagtgaattaatatattaagggtatattttcacttttatatgatgtagtgaaatctgttttaatttattgctaaatttcagtaaatgaaaatgttttcaactttt

SEQ ID NO: 175725 - DNA, 601 bp, Human
acagctttctattggaagaagacgccatctatttcatagctagagagaagtagtcagtgcccagcttcaaaggacaggctgactcttttgttaggggctaatgcagttggtgatttttgaagccagtgcttgttgaccattctgaaaatcctagggcccttaacaattatgctaaatcaggccgggtgtggtggctcacgcctgtaatcccagcactttgggaggccgaagtgggcggatcacctgaggtcaggagttggagaccatcttggctaacacggtgaaaccctgtctctactamaaatacaaaaaattagccggatgtggtggtgtggacctgtaatcccagctactcaggaggctgaggcaggagaatcgcttgaacccaggaggtggaggttgcagtgagccaagatcgctccattgcactccagcccaggagacagtgtgagactctgtctcaaaaaacaaacaaaaaaacaacaaaaaaaggaattatgctaaatctgtgcctttgctctgtaaatggaacaacaaagcctggatgacagtacatcatttatggcatggtttactgaatatttcaagtccactattgagg

SEQ ID NO: 175726 - DNA, 601 bp, Human
agaaggttgactctgattttgaaagttttactgtgggtaaaatgccatcaaacagcatcgcatgtacagagaaatctttcatgaaaggaagagtgagtcaatgtgacaaacttcactgttgtattattttaagaaattgccacagccacttcagcctttagcaaccagcaccctgatctgtcagcagcaacgaacatggaggcaagaccctctattagcaaaaagattgcaacttgctaaaggctcaggtgattgttagcatatttttaaattaaggtatgtacattgtctttttagatayaatgctattgcacacttactatagtgtaaacatagcatagcatttatatacactgggaaaccaaaaaaatttgtgtgacttggtttattgcattggtttgggactaaatccacaatatgtctgaggtgtgcctatagatctttactatgaaagcaaattagaactaaagggaaacatccagatcacttaccttatcttgttcttttatttttcttttttctacagctgtacaggaagaggcacatacaaagaaaagaatccccgaaagggcggtttgtgatgctcctgccatcgtcaact

SEQ ID NO: 175727 - DNA, 601 bp, Human
attttgaaagttttactgtgggtaaaatgccatcaaacagcatcgcatgtacagagaaatctttcatgaaaggaagagtgagtcaatgtgacaaacttcactgttgtattattttaagaaattgccacagccacttcagcctttagcaaccagcaccctgatctgtcagcagcaacgaacatggaggcaagaccctctattagcaaaaagattgcaacttgctaaaggctcaggtgattgttagcatatttttaaattaaggtatgtacattgtctttttagatacaatgctattgcacayttactatagtgtaaacatagcatagcatttatatacactgggaaaccaaaaaaatttgtgtgacttggtttattgcattggtttgggactaaatccacaatatgtctgaggtgtgcctatagatctttactatgaaagcaaattagaactaaagggaaacatccagatcacttaccttatcttgttcttttatttttcttttttctacagctgtacaggaagaggcacatacaaagaaaagaatccccgaaagggcggtttgtgatgctcctgccatcgtcaactcacaccattccattc

SEQ ID NO: 175728 - DNA, 601 bp, Human
gaagtagccaaagaccaggagattgtggaatcaaaaagaaaaaaagaaacaaaaaatcttcgatgctctggcacggatcccaaattgttctgcctgggtttggtgagctgcactagtggcagggatgagctaatgcttttaaaatgggaggtgtgggtgtgagctgcttgcctgccgacctccctcgccttgcacagcaccctgctggcgtccagtacttggctcccaagtttcattgctcagagcctttctggtttccagtctgggttgaaactgtctattctcgccctcaaacaaataygaaggagctccccattccttgggacccacacaaccccaccagtcaactttgtagccccctaaaggtgttcacatcagcccatcaacttcctgttttaaaaccatcatggtggttttctcttcatggcttggtgccatgttggcctagcaaaaggcacaggaggcctggcctggtcctctccggggggctgcccgatggcctttcctcctgtctctgctcatccacaggtgtctctttttgtcttttttccccaaagtcctagggcctggcatggcattctgggggaggaggagttaaaag

SEQ ID NO: 175729 - DNA, 601 bp, Human
ttctatggcaactccaggccctgcaccctatggaagtgtttaggagaagaataaactacatgccggcttataagacacactgtgggggaaagaaagggacttggcagcaggcaggatgtctgtggtccccctccctggccagtcattgcccctgaaactcctgacaaaaccttgactctagaagaggaatgggagggggctggagatgaagaaggcggcctcggcccgggcaaatctgccctggcagctctgtccagctcaggaaggggtgggctgtgccaagggctttctgaaaatgtgygtgtgtgcgtgtgtgtgtgtgcgcgtgtgtggcttctgcaaaggtggctggcagggctgaggggggttgcagcagagaaagagaattttgcttcagaatgccaagcccttctctccttctctcttgccgcctttgcatgggaggaatggggctgtaggatgaagtgtgttcggggcctgcctctgagcctgttgggaatttgagcatgaggctcagctggggggccggctgccagccccagaggatggcccctggatagctccaaattgttctgacaggggccagtgccagcagattctt

SEQ ID NO: 175730 - DNA, 601 bp, Human
tgcaccctatggaagtgtttaggagaagaataaactacatgccggcttataagacacactgtgggggaaagaaagggacttggcagcaggcaggatgtctgtggtccccctccctggccagtcattgcccctgaaactcctgacaaaaccttgactctagaagaggaatgggagggggctggagatgaagaaggcggcctcggcccgggcaaatctgccctggcagctctgtccagctcaggaaggggtgggctgtgccaagggctttctgaaaatgtgcgtgtgtgcgtgtgtgtgtgtgcgcgtgtgtggcttctgcaaaggtggctggcagggctgaggggggttgcagcagagaaagagaattttgcttcagaatgccaagcccttctctccttctctcttgccgcctttgcatgggaggaatggggctgtaggatgaagtgtgttcggggcctgcctctgagcctgttgggaatttgagcatgaggctcagctggggggccggctgccagccccagaggatggcccctggatagctccaaattgttctgacaggggccagtgccagcagattctttcagtatcagatctgaggttg

SEQ ID NO: 175731 - DNA, 601 bp, Human
gtttcccattcaacaatgcgtactagagatctttctacttaatatatatataaaactgtcagaggagcaccttctccagctgggacccagtctcctgactgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatataaaaatatataatatataaatatataatttatatataatatataaatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagct

SEQ ID NO: 175732 - DNA, 601 bp, Human
tatatatataaaactgtcagaggagcaccttctccagctgggacccagtctcctgactgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatattaatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaagg

SEQ ID NO: 175733 - DNA, 601 bp, Human
atatatataaaactgtcagaggagcaccttctccagctgggacccagtctcctgactgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatatawatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggt

SEQ ID NO: 175734 - DNA, 601 bp, Human
ctgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatataaatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggttatactgctagcaaggaatacagcctgtatttaagccccttcaccctggctctaa

SEQ ID NO: 175735 - DNA, 601 bp, Human
ggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatataaatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggttatactgctagcaaggaatacagcctgtatttaagccccttcaccctggctctaaaatatatttaacaactatactataggtcac

SEQ ID NO: 175736 - DNA, 601 bp, Human
cagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatataaatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggttatactgctagcaaggaatacagcctgtatttaagccccttcaccctggctctaaaatatatttaacaactatactataggtcacat

SEQ ID NO: 175737 - DNA, 601 bp, Human
atataaatatataatttatatataatatataaatatataatatataaatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgasgcttagaaaaatgaggtaactcgtttaaggttatactgctagcaaggaatacagcctgtatttaagccccttcaccctggctctaaaatatatttaacaactatactataggtcacattataccatatcatattatatatactactacatactcttatattattataattatataatatgcattttcaattttaatagttcctgccaatttggcctccacagtggctgtgttaacacagttcttttcatatatgcaacatgaggggatggaggaatgttagagccctgtgcttaagagac

SEQ ID NO: 175738 - DNA, 601 bp, Human
ccaagagccattccggaactagagatcttaaatactacatggtaattatcccctctgcctctgcccatgagggtgtcaggcacagggccgcctggctgcctgcagagaagagctgtttcattcagaaacttcagagctcctgcaatgcctggattaggatgtggggatggtgagtttcgcaaccagggtcagatttcatgaagacttggtttcgtgacttgaggtgtttgactaaggtgtttgcatctcatgtatttaggaagggctcccttttgacttagactttatcatcatgaataakctccctgccttttcgatttggaaacatgatagctctagtgagctctgctactcccaagcttgggcaggttctttgcctcagtttcctcatctctaaaatggggggaaatatattatgtaccacgtggtaacttcattggcaattaagtgaaatacttcatggaatgtttagcactaaatattccttagtgttgaaaaggctgggaaccactgagacagttgaaagggcactgggttaggaggtaaggcttggttatgttaggatcccagaactgactatacggtaataaaatttgggggc

SEQ ID NO: 175739 - DNA, 601 bp, Human
tattctcacttcactttcggtgaggaaaatggcgctctgtggtgtgatgtgatgttttccagggtcatatagagagagctgagtttcaattcaaaatcgtggtttgatccccccgcctccaaatctaatgtgttccattttgtcacagtgcttcccacagggcagagaaagaaacaacaaagttcctactctattttcacaactcttcacattttagagtcttaagtccatttgatctcatttgatgacaacttcgcaacgaggaaagcaggatggtgattggggggtcggtcatagttcstagttagtggatgtcagtattgagaatggcggggttctgtggcttagccatatagccaatacatggaatgggattggaacccatgtcttctgagggcaagcccaacacttgtcaaggatctggtgctgcccttccctctttagacagctcccattgataagcagaggtagaagtcactagggtagccaaagagagggccctagaaatggaatggtgacaatgaacttggctgaagagtcagcaaccgctcccctatccactgccagggctaggaggtgcagtgtggcatggaggaggagc

SEQ ID NO: 175740 - DNA, 601 bp, Human
cacaggttctggagttagaccacttggctcaaaccttggcctcgttcatggctagttgcctgtccctggacaagttaattccctggtctcatttttcctatctgtaaaatggagtatgcaataatagtactcttaacctcataggttgtggaagaattcacagacacaatggaaataaaaggcctggctcattgcctggcatgtagtaaggacctgataaatgtcagccatcatattattactacatggtattactgcctccccttagatgggagccaagtcttgctcaccagctcattgyctgatgttagtaggcattcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaaga

SEQ ID NO: 175741 - DNA, 601 bp, Human
ctcaccagctcattgcctgatgttagtaggcattcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagcagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggc

SEQ ID NO: 175742 - DNA, 601 bp, Human
tcaccagctcattgcctgatgttagtaggcattcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggct

SEQ ID NO: 175743 - DNA, 601 bp, Human
gctcattgcctgatgttagtaggcattcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaagraagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctccttta

SEQ ID NO: 175744 - DNA, 601 bp, Human
ttcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctg

SEQ ID NO: 175745 - DNA, 601 bp, Human
tcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgc

SEQ ID NO: 175746 - DNA, 601 bp, Human
caataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagaragaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgct

SEQ ID NO: 175747 - DNA, 601 bp, Human
aataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgcta

SEQ ID NO: 175748 - DNA, 601 bp, Human
ataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgctaa

SEQ ID NO: 175749 - DNA, 601 bp, Human
tgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagaagaaaggaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgctaaaatagaatgctc

SEQ ID NO: 175750 - DNA, 601 bp, Human
tcctgcaggctggagacctctgttacctttacttctctacttttgttgtcttgagaccagcttttttatttttggtgaggagaacagcaggcagttcaaatgtcagggaaagacaagttcagcttgctttttccttatttctgtcttgttacctgctatcctgccaggttagaaagatggaatcactcccttttgccctatcatcaagacttcagtgttccctggagcactctaaatttgccatcagacttggatcatcctctaataccaagctcctgggtccttcctgaaggctgcctcyttgtcttgctgagaagaattaaggttgcttccctgggaggaattcagcagcacctcttgtaagtcatcaggtgtgctgtaaggatggggcaggcaacatttctttgtactgtgggaaggcctaaatcagtgtttctcaaggtgtgatccttgcaccaccaatcttaagaaatgttctttggagccgggcacagcggctcacgcatataaccccaccttgggaggctgaggcgagaggatcgcttgagcccaggaattgaagaccagtctgggtcacatagtaagattccctgtctctact

SEQ ID NO: 175751 - DNA, 601 bp, Human
ttctttggagccgggcacagcggctcacgcatataaccccaccttgggaggctgaggcgagaggatcgcttgagcccaggaattgaagaccagtctgggtcacatagtaagattccctgtctctactaatttaaaaaaaaaaaaaaagaaaaggtggttgggcctgtagtcccagttactcttgaggcttaggtgggagaatcgcttgagtccacgaggttgaggctgcagtgagccatgattgtaccactgcactccagccagggtgacagagcaagactctatctcaaaaaaaaaaaaatgttatttgggagagctgtttattgtattcccctcttggagagacatgtggctattagcatagtaaaagctctgagaagtcctgctgcatggtgacctgtttggctctgtttaatccagtgttctctgaacatatctagccaaggaactaattttcccaagaagcacctacaaatgcagttggtgagacactgcccagatgaggattctgaaaaccccttttgcccacttgcctgccattgtgattgctgagtagggaagaagaaattaggaagtatcatctgcattacacagggaagct

SEQ ID NO: 175752 - DNA, 601 bp, Human
ctgggaaacccattagcttttttgtttgttttagagcccaagggaatcagggccttgaggggattttttggtgtggggggtggtgcaagcttctaacactgagagtgggtgcttttctgattcctatgaaggtggagtgtaggtgtcgttcctggctcagcagagtcagccctctcatcctattcaggccgtctctgaggctggctcctgtgcccaagcccttcctcactccctcagggcatgatcacagggcatttccttagcattcctcctttctcccctgtgtgtgtgtgtgtgtgtgcgtgcgcgtgtgtgtgtgtgtgtgtggtgtgtgtggtgtgtgttctactccgtgtgtgtgtcatcctctgctcatccacccattccactgcgtgtgtgtgtgtgtgtgtgtgtgtgtggtgtgttctactccgtgtgtgtgtcatcctcctctgctcatccacccattccactgcagcacctagcatcacctaggggcctggaaaacctgcacctgaaagccgtaactccccggcacctggctggttgacttcttcccccttaaccccatttactttgaggatggaggtagtctttaggg

SEQ ID NO: 175753 - DNA, 601 bp, Human
ggaaacccattagcttttttgtttgttttagagcccaagggaatcagggccttgaggggattttttggtgtggggggtggtgcaagcttctaacactgagagtgggtgcttttctgattcctatgaaggtggagtgtaggtgtcgttcctggctcagcagagtcagccctctcatcctattcaggccgtctctgaggctggctcctgtgcccaagcccttcctcactccctcagggcatgatcacagggcatttccttagcattcctcctttctcccctgtgtgtgtgtgtgtgtgtgcgygcgcgtgtgtgtgtgtgtgtgtggtgtgtgtggtgtgtgttctactccgtgtgtgtgtcatcctctgctcatccacccattccactgcgtgtgtgtgtgtgtgtgtgtgtgtgtggtgtgttctactccgtgtgtgtgtcatcctcctctgctcatccacccattccactgcagcacctagcatcacctaggggcctggaaaacctgcacctgaaagccgtaactccccggcacctggctggttgacttcttcccccttaaccccatttactttgaggatggaggtagtctttagggtca

SEQ ID NO: 175754 - DNA, 601 bp, Human
gccgagcgcagtggctcacgcctgtaatctcagcactttgggaggccgaggcaggcggatcacctgaggtcgggagttcgagaccagcctgaccaacatggagaaaccccatctctactaaaaatacaaaattagccgggcgtggtggcgcatgcctgtaatcccagctactcgggaggctgaggcaggagaattgcttgaacctgggaggcagaggttgcaatgagccgagatcgcaccattgcactccagcctgggcaacaagagcaaaactccatctcaaaaaaaaaaaaaaaaaaaagaagttggagctctgtctgtctgtcctttccccaactccccatctccgaggctggctcctgtgcccaaagtcttcctcgctgtctctgggtatgttcacagggtatgatcacatttcccctgcatgccctgcgtgggatgtgctccatgtgctgatgcctctggggatttccagatgatgtccctggacttggcagagcagtgtggggaatctgggacttgcacttcctatcctcatggagtctggtctctcaccttcacaggccactaagaggaaaggcaactggtgtgacgtctgggg

SEQ ID NO: 175755 - DNA, 601 bp, Human
cacagtgccctgccacaggtgattataggtgaaggtcttctgacacctatacgtctaagggtcatggagtgacatcttatgaagtcagcatatagaaagtcaaaaaacccttacattcctgtaaaatacagtgcaggccaggcgcggtgactcacgcctgtaatcccagcattttgggaggccaagggtggcggatcatgaggtcaggagatcgagaccatcctggctaacacggtgaaaccccatctctactaaaaatacaaaaaattaaccaggtgtggtggcgcacatctgaagtccyagctacttgggaggctgaggcaggataatcacttaaacttgggaggtggaggttgcagtgagacgacacctcgccactgcactccagcctgggcgacagagcaagactccatctcaaaaaaaaaaaaaaaaatacagtgccatctctccataactccacctgagccagcagttccatcagtgttgtgacagattactatttttttttgttgtcaagtaccctcaggttgagcagctgagatgcttttagggagtgagacaatctcaggatctgtctttaaaccccgtagtcatataggga

SEQ ID NO: 175756 - DNA, 601 bp, Human
ttagggagtgagacaatctcaggatctgtctttaaaccccgtagtcatatagggactggcaccaccagagacaacagcagatccctgtctggagctcactgaagaatcaggggtgggaggaattgcccttttaaaatggagtgtatatatgtatatattttttgcataattaaataatatatatatgtcattgaactcaggctggttagaggcatgcatgtatgatataaattctctgtatacaaataaaaggaagttacttgtattcgttgaatgggttgttatgatgactcccttcatrggaaacatttggatccatttcctctgctttcgatgttgttctttcgcttctgaaccagtgtttgaggcagatgtctttgatactgagtaaagacatggcagtttgcattcactctctgaccaaaagagatgctccctactcttgcagaatactgattgcccatgacaaccagagtacttttataagaaaaggagcacacagaaggcagaaagggaccttgtttggggaggcggctttgagcagtgactttatgacataaacgattaggctcttcctggccccgcctgtcttgggatatct

SEQ ID NO: 175757 - DNA, 601 bp, Human
tgttctttcgcttctgaaccagtgtttgaggcagatgtctttgatactgagtaaagacatggcagtttgcattcactctctgaccaaaagagatgctccctactcttgcagaatactgattgcccatgacaaccagagtacttttataagaaaaggagcacacagaaggcagaaagggaccttgtttggggaggcggctttgagcagtgactttatgacataaacgattaggctcttcctggccccgcctgtcttgggatatctactcagaccctggaactttgaaatcgcaggctgggtycaatgagcgcagaaaagggacaggactcaggcagataggatttctttcgggtttggtaaacagctggcctctaggggtagggacaagggcagtgggtgggaggacttgggggagggatgggtgagctcgtgggaactgagaaactgtgtctagggcttccttagttatactgaatgctgcatgtagaggtctgcagggtggccagctgatggctggcggaagatctgctgacttggattcagttactactaaaatggcaggtttagaaagaggagagaacttctagatccagaggaaata

SEQ ID NO: 175758 - DNA, 601 bp, Human
cctagcacctgccatcatattgggtatttgtcttattgtttggcctgattcctcctccgttacttaggcaccaggagagtagagaccttgttggtcttgttcaccatctagaagatacttgaaactctaacatttgttaaatgcaggaaagaatgcccttttgacagctaggaaattgaggctgagacaagtgaagtgtcttgccctggtttcccagctagtgagtgtctgtgctggattcaaacttagctcttatgctccagccttcaagtgggggaaactcaagagggcaagttcttayggggccacttaggagcagacagcttcttaggacaacattcttttatgttgatgtgaagtagcaaatctttcagagatacaggcctctaaaaaattctgccatctgccggctgctgtgttagagccagcctcagaaaaaggtcagagatccaatccctggctgggtgctgtgcacccaggaaagaaggagcagaattgaaataagtcttttccactcttctagaagagccttctaggccacaggcagggcatacccatgcatagactttaagggcctttatttggtctgtttgcttcccag

SEQ ID NO: 175759 - DNA, 601 bp, Human
gcccttttgacagctaggaaattgaggctgagacaagtgaagtgtcttgccctggtttcccagctagtgagtgtctgtgctggattcaaacttagctcttatgctccagccttcaagtgggggaaactcaagagggcaagttcttacggggccacttaggagcagacagcttcttaggacaacattcttttatgttgatgtgaagtagcaaatctttcagagatacaggcctctaaaaaattctgccatctgccggctgctgtgttagagccagcctcagaaaaaggtcagagatccaatycctggctgggtgctgtgcacccaggaaagaaggagcagaattgaaataagtcttttccactcttctagaagagccttctaggccacaggcagggcatacccatgcatagactttaagggcctttatttggtctgtttgcttcccagttggggaaacaggcccagggacaggaagtgacctgcctgatgctacctcatgagttagtggtccaggcagttagaaccaaggtttcccaatccagcgggagttcttacctacccactatagacttcttggccggttctgggagactgagctctt

SEQ ID NO: 175760 - DNA, 601 bp, Human
caagggctccaggaggaaatgatttgtcaaactcacatagaaaatgaatggaaaaaaacagaaagagtatctagcttccaattcctggcccagggctcttcttgctattcaatactttctacgtaataagcctgggttttttttttttttcaaaaaaattattatacttggccacccagatgagtacagttatttagtagagtacgtagagttattcactaaatcacatcaaagttgggagacagagtctggtttgaaaaccctcgagtattttattttattttattttattttattgtgrtaatacttaacatgagatatactcgcccctctctttttctgagacagagtctcactctgtcgttcagctggagtgcagtggcatgatactggcttcctgcagcctcaacttcctaggctcaagtgatccgtttccctcagcctcccaagtagctgggactacaggtacgtactaccattcccagctaatttttttttcgtggttttcgtagagacagggttttaccttgttgcccaggctggtctcgcactcctgagctcaaggaattcacctgcctcgacctcccgaagtcctgggatt

SEQ ID NO: 175761 - DNA, 601 bp, Human
aagaaattcaaaggagcttacactgagtgaccctgaaggtcccacccaacctaaagtctgtggcctgtgaaatgtgcccatgccactgtgccgtagtttaacatgtccttctggaaggcaggtaggacccagagatgagaagtaggggctcccaattcaggctgcctggactggcatgctacgtccaccacttccgcattagatgatctggggagagtcacttcttctttacaggcctcgatttctaaaagatgggctaatgacaacacttactttatagggccctagtgaggctcaaatrggaaaatccacggaaagcatttagcgctgatcatgcatggaaagtgcctgatagctgatggcacctattgtaactaataatagtattagaattagtattgtaatcattgacaataggatttttataattagggaaagtggggaactacccacatgaccatcctcctgctttctgtgtcagtgtttgaccaaatgtgttcatccctggtactctcattgcttatcctccgagagcactggcatataatggaaaatgtattccaatttgttctgttattccagccaggaacatctaggaaca

SEQ ID NO: 175762 - DNA, 601 bp, Human
gtgaccctgaaggtcccacccaacctaaagtctgtggcctgtgaaatgtgcccatgccactgtgccgtagtttaacatgtccttctggaaggcaggtaggacccagagatgagaagtaggggctcccaattcaggctgcctggactggcatgctacgtccaccacttccgcattagatgatctggggagagtcacttcttctttacaggcctcgatttctaaaagatgggctaatgacaacacttactttatagggccctagtgaggctcaaatgggaaaatccacggaaagcatttagcrctgatcatgcatggaaagtgcctgatagctgatggcacctattgtaactaataatagtattagaattagtattgtaatcattgacaataggatttttataattagggaaagtggggaactacccacatgaccatcctcctgctttctgtgtcagtgtttgaccaaatgtgttcatccctggtactctcattgcttatcctccgagagcactggcatataatggaaaatgtattccaatttgttctgttattccagccaggaacatctaggaacaggggttggaggtgtgcttcagggact

SEQ ID NO: 175763 - DNA, 601 bp, Human
tgcttatcctccgagagcactggcatataatggaaaatgtattccaatttgttctgttattccagccaggaacatctaggaacaggggttggaggtgtgcttcagggactacctgagcccagcttttttttttttgagatggagtctcattcttcttgcccaggctggagtgcagtggcacgatctcggctcactgcagcctccgcctccaaggttcaagccattctcctgcctcagcctcccaagtagttgggattacaggtgccctccaccacatctggctaatttattttttttttttgtatttttagtagaaacggggttccaccgtgttggccaggctggtctcaaactcctgacctcaggtgatcagcctgccttggcctcccaaagtgctgggattacaggcatgagccactgcacccggccaagcccaccttttgataggagcctcccatgggcaggcagagtaagaagtgtcacatgcagccactggtcacttaggcaaaaccctgccagctttcagatgtgcagtggaggtggcagggggaggtggctggtgctgtgtatgttttgcagatactctgtggtgtggcaattg

SEQ ID NO: 175764 - DNA, 601 bp, Human
ctgtggtgtggcaattgctctagaggactctagtgtccagaagcaggcatgtgcagtttatcattacagccctccttcaaagaggacagctggccctgtgctttgcagggagaggtgcactccgggtggcccataaacccagaaaatatgattcctatctggtacagggtaccatcctggcacctggagaggggtctgcatgagacccagaaatgactggatccacaacagacctagtttgtggaacagtcctaaagaatcctccattcaagcttatatctgtcacccagggaactggacrttcccttcagtcagaatgaactagtggcctccccttctcttcagccagggtctttgcagtcctcagccatgtgacctccgacctgtcagtcttggtctgattgctgtacccttgtttgtgctgtttccattgcctggaccatccttcttttctttccatgatcaaaaccctatacattcttctgagtcagttcatgcagcggaattggcattggaatgttgcagctaattgcacatactgggtgacagagtgcacagtagagaaaggtagggtgatacactcttcttaggaagcaatcaa

SEQ ID NO: 175765 - DNA, 601 bp, Human
ctgagtcagttcatgcagcggaattggcattggaatgttgcagctaattgcacatactgggtgacagagtgcacagtagagaaaggtagggtgatacactcttcttaggaagcaatcaataagggccaagatggaaaagatgtcttatttcacccactgagcacctactatgttccagacactgtgagatgttgcggttagatacaattgtgagcaaagcaagatgtaattccggcagaatttagtgagtgtatgggggcagggaagaaagaggatgagacatgattcaaatgaatctacraacatatagttacatacacactagggcccctgagaatacaaaacaggggttctgttctagtcttatgcttgcaggaggtggttggggatggctttatgtgaggaagtgttttttgattttaaatgtgaagtatgagtggcagttgatgggtaatggggagcagaagagggtctcatgcagatagaatggtatgtgcaaaggccccaaggctttgcaactgagagatttagaccagggctgccgatcagatgtctaaaaaagtatacttgttcgccccttgccatactctttggtccaaag

SEQ ID NO: 175766 - DNA, 601 bp, Human
cggtattcggcctctccagatcacatttttacttgtcccttccttttctgagtaactctatggaacaaggactcctgacccagcactccaggaagccaaacacaaaaccatccccgtcttcgttattgtattacctttggttccctcccacagcctcattcattcattcattcaacatttttgggaaccctggccacaatctaggctctatgccatgtgctggagtcccagatgcagtccctgccatccggtaattagcgatgctagtgagtgtccaaggaaccaatcattaaagaacacrtgctggaagaaagagaggaaagccaagcagaagagaggtggactagcttggcctggggtggacagaaggcttcctggaggaggtagcatttcagctgggtgggtcttgcaggaagccaaaggtgcaggcagatgcacagggaggaagtgattctcacctaggcaaggggcatcataggacaggttcatatagtgatgggggctggaagcttcagagtgatagggtttgaggtatggtcccagctctgaagagccatatatatgccaccgagctatgcagaataatcctgtagatactgca

SEQ ID NO: 175767 - DNA, 601 bp, Human
cctgtagatactgcaaacccaagggaggtgtaggtgaggatgtaaatgagggttgtggatcccatttgttcctgggagaatgtgggggacttaggggagaaggactgtgtttcccactgtctatcctttggggctttgacatttcccacctgacagccatttgcagagtaaaagcctcagggattctaatcatgcttggtgaacactttgaggtagtcgcctcattggacccttagaaacccaggtcacagaaacaccatcacccttctgagattcacagtcctccctccccaggtaagtyggccctgaatccaggaatcagccagccctaggacttttgccctgtcccaggccaaggtatctgtacctttcttccaaattgctggtggccccaggaagaaatcaagagtggctgactttaagcagttagattaaacatcaaatgcattcatcccaagtccaggcatatacctagaaggagcgactcttaaattttgtcatttcattgtgtaaaactgaggttgccccttaacacatgaaggccagcatgggatgctaattttgtgttgtgttcttttgggtaatctcaaagttccaggaa

SEQ ID NO: 175768 - DNA, 601 bp, Human
ataggtgcagcaaatcactatggtacatgtttacctttgtaacaagcctgcacatcctgcacatgtaccccagaacttaaaataaaaatacaatttgtttaaaaaaaaagttcatgagagttctaggttggcggtggcaaaagcgtgggagctgtcagttgtgcagatggtgctgagacccacaagctggaagaacatagcaggaccacgagcctgcacctcgatgaccggactgagcaccaagaaggtcatgggtgacttcgacaagcactgctttggagaggttaggggggaggctgcytaggttattgcaggcacctttggaggctggtaattatcacccacaatttatctgctgggatgggaagtgacttgcccaaggtcacagagaaacagggcagcgacttcacccagaccccacgtgctccatgcctgtttttcattccagtacgccgtgatcacttctccagttttcttgatctgtcctttcagcttctgagtctttcaggagggtttttttgggagttgggattgtggtgatcaataggctgggaatcagagggacccagtccaggcaggcccctcaggcctctgcttttca

SEQ ID NO: 175769 - DNA, 601 bp, Human
acccggccagccataaacttttaaaccttatctccccactagactagccatcagtggaagcgggaaataggacttctatttcttgttgtcaccctcaccagcacccaacccaatgttccagacaccaacctagttcatgcctatgttggtttgattgttgggggcactgggtagacagtgtaggggccatactccagcatgaatgggaataaagacaacctgtgtccagcctggcccatctgtaaagctggcttctagccaccacaacaaggtggaaggaatggctagacatgctgccagytaccagtttgaaaagtgtcttctgttgttggaaaagcacaacctcctcccaccccacttcccttgttccctgtggcccctgggccagcgaatgcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagt

SEQ ID NO: 175770 - DNA, 601 bp, Human
agacagtgtaggggccatactccagcatgaatgggaataaagacaacctgtgtccagcctggcccatctgtaaagctggcttctagccaccacaacaaggtggaaggaatggctagacatgctgccagctaccagtttgaaaagtgtcttctgttgttggaaaagcacaacctcctcccaccccacttcccttgttccctgtggcccctgggccagcgaatgcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagttttgtttttgtaaggaaaacactgatgtggcctcttcactgggccatctctgcctcagacttttggaaccatgactgtgatcttgtttggcttgtcttagtaggcaattcttgggttacacatgggtgataaggtgggatgggtacatgtgatagagtaggcactcctgatc

SEQ ID NO: 175771 - DNA, 601 bp, Human
gcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagttttgtttttgtaaggaaaacactgatgtggcctcttcactgggccatctctgcctcagacttttggaaccatgactgtgatcttgtttggctkgtcttagtaggcaattcttgggttacacatgggtgataaggtgggatgggtacatgtgatagagtaggcactcctgatcccaaaatacctcctatacttgttctgactacttcatctgtgcttctccacctctccctgaagttctgtaaggctagaatatttttatgaggttgcctttcttctcatcctagggagaactcccaggccttagcttacagtgcatgttagaagtctgaagatggtatgccctaagatggaataaaaatagacatcaccatagtggtgataatgctaataaca

SEQ ID NO: 175772 - DNA, 601 bp, Human
gcaatttccagttttggtattcaagacctgtccatttgctcctccatgtgccaattttacaaatacctgaagacagctcttgggtgcttctttttcacacaacgtagaaagagaagcacaaccttgtagaatctaaaagtcaagtcctctcctctttctgttcccagtgcatgtggtaaatgcctctctttcagccctcaacccactgggtgtaattacttttgtattcatagttaactagtatctactgggtaaatcctttctgccagacattgtagtgggaaatttcataagatctttygttcaatcctgattccaattccctgatgtaaagagagttataccctctttatagatgagaaaattgaggctcagaaagaggaagtggtttcacttcttggtctgttaccttatctagatcatgtggatgctaatactgcccttgtaagacagttaagagcagtaaataagtgaaatgtacatggcacatagtaggtgtgcaataaatgggagctgttttcattggaacagcccttccatggttagcccatttcatttttggtgatgataatgatgatgatattaataatatttgtctagt

SEQ ID NO: 175773 - DNA, 601 bp, Human
aaagagaagcacaaccttgtagaatctaaaagtcaagtcctctcctctttctgttcccagtgcatgtggtaaatgcctctctttcagccctcaacccactgggtgtaattacttttgtattcatagttaactagtatctactgggtaaatcctttctgccagacattgtagtgggaaatttcataagatctttcgttcaatcctgattccaattccctgatgtaaagagagttataccctctttatagatgagaaaattgaggctcagaaagaggaagtggtttcacttcttggtctgttwccttatctagatcatgtggatgctaatactgcccttgtaagacagttaagagcagtaaataagtgaaatgtacatggcacatagtaggtgtgcaataaatgggagctgttttcattggaacagcccttccatggttagcccatttcatttttggtgatgataatgatgatgatattaataatatttgtctagtgcaaactatgtccaagacagtatcaagagtttcacatttgtcatcttgactaatcccttcagttcaagagattagtatcattatgattcctgttttatagaagagga

SEQ ID NO: 175774 - DNA, 601 bp, Human; identical to SEQ ID NO: 18750

SEQ ID NO: 175775 - DNA, 601 bp, Human; identical to SEQ ID NO: 18751

SEQ ID NO: 175776 - DNA, 601 bp, Human; identical to SEQ ID NO: 18752

SEQ ID NO: 175777 - DNA, 601 bp, Human; identical to SEQ ID NO: 18753

SEQ ID NO: 175778 - DNA, 601 bp, Human; identical to SEQ ID NO: 18754

SEQ ID NO: 175779 - DNA, 601 bp, Human; identical to SEQ ID NO: 18755

SEQ ID NO: 175780 - DNA, 601 bp, Human; identical to SEQ ID NO: 18756

SEQ ID NO: 175781 - DNA, 601 bp, Human; identical to SEQ ID NO: 18757

SEQ ID NO: 175782 - DNA, 601 bp, Human; identical to SEQ ID NO: 18758

SEQ ID NO: 175783 - DNA, 601 bp, Human; identical to SEQ ID NO: 18759

SEQ ID NO: 175784 - DNA, 601 bp, Human; identical to SEQ ID NO: 18760

SEQ ID NO: 175785 - DNA, 601 bp, Human
tccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggattctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgtaggtgccctcccgccctgctcctgccctcttactgtgttaacgattctccacgtgaggagcgtttcttttccagtgttgggta

SEQ ID NO: 175786 - DNA, 601 bp, Human
cctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactgtgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgtaggtgccctcccgccctgctcctgccctcttactgtgttaacgattctccacgtgaggagcgtttcttttccagtgttgggtaga

SEQ ID NO: 175787 - DNA, 601 bp, Human
tggcctttattttgtccttagaagtgggctggatcccagactggccagcgtttcattaggattttccactacaatgctgatgttttgagagttcagtttttagaagctaatttagttttcagaagctaaaggtagatttaaaacctgacaaaaaataggcaatcatgtctatattaattgtgtttgttttaggtatttagcaaaatatgtttccgttgcattttttgaatgagtaactagatgatacatttcctttcggttaagtaatttcttagagatccagatatgaaatgacttactsaaatttttttggtgacattggcacagtgttagagattggactggagcccaaatgcatagagctctctagctgaacatttgtttgcatgtgtattcatcagacataggtattctaaggagataggagggtacagagatatgactagagagaagatgagttgagcaacaggagaatggatggaggatggccacattttgtcaaaaaactaagcacccaattagaagaggcttttgcatgaaagctacttcttctgtaacttatactgcaggtattgggttttgtttgccagtagcttaccct

SEQ ID NO: 175788 - DNA, 601 bp, Human
caggaagtgcgttaacccccattttagagacgaccttgatgttcagagagaccaagtaatctgctcaggaagtggtttgaatagaggaggttttctgaccttttgttgatcctggtccaggatgcttcataggtatacagtaatcaaagagcgctttgcagatatttcagtttacaaaatgctgaattaaaatttatatctggattttaagcttatggaatttgctgttttctttttgcctttttgtaaccctaatgcttatggagttctttccccagtttgacaatagaactttgatagtttttttttttcttaaactcaactgagattagagaggcagggcccctcttatgactgactcttgatgtacagggtgggtcaccttccatcatcgctaaatgatattagcctgtttattagtgagctccctcctccctcaagtccttaaagttctaagaggagatggtggtgtggtcaggtgcaataggaattttgcaagaggaaaagtcattaaaaacagaaggtgtctctggtatcttatggctgtcctttggtggttgtagaacttgaagcaggtatgttattctctttgctttttaac

SEQ ID NO: 175789 - DNA, 601 bp, Human
acagggtgggtcaccttccatcatcgctaaatgatattagcctgtttattagtgagctccctcctccctcaagtccttaaagttctaagaggagatggtggtgtggtcaggtgcaataggaattttgcaagaggaaaagtcattaaaaacagaaggtgtctctggtatcttatggctgtcctttggtggttgtagaacttgaagcaggtatgttattctctttgctttttaacctgcaaaggccagtacctcaaatggtgatcacagttcctttttttttaggaaattgtaagtttccatygaagataaagaattgcagttatgtgaaacttcagagatttagatatgtgattaaaatatgcttacattgtgaacattattttaatgccattatatctaatattttatataggattatttctactttgtaatggaagttaaaaagtaggattttactgacttatatatttcttcataaacagttttcaggaataaatctttttcataccttgaaggattaaaaaatcatagatttcatatttggtgtgttagctcttattttttaagatactgtcatttcaacgaaagatgaaaaaacgtt

SEQ ID NO: 175790 - DNA, 601 bp, Human
cctgtttattagtgagctccctcctccctcaagtccttaaagttctaagaggagatggtggtgtggtcaggtgcaataggaattttgcaagaggaaaagtcattaaaaacagaaggtgtctctggtatcttatggctgtcctttggtggttgtagaacttgaagcaggtatgttattctctttgctttttaacctgcaaaggccagtacctcaaatggtgatcacagttcctttttttttaggaaattgtaagtttccatcgaagataaagaattgcagttatgtgaaacttcagagattyagatatgtgattaaaatatgcttacattgtgaacattattttaatgccattatatctaatattttatataggattatttctactttgtaatggaagttaaaaagtaggattttactgacttatatatttcttcataaacagttttcaggaataaatctttttcataccttgaaggattaaaaaatcatagatttcatatttggtgtgttagctcttattttttaagatactgtcatttcaacgaaagatgaaaaaacgtttaaaattgtaaaccacttttgaatgtccctgaaagtcttt

SEQ ID NO: 175791 - DNA, 601 bp, Human
tttcaggaataaatctttttcataccttgaaggattaaaaaatcatagatttcatatttggtgtgttagctcttattttttaagatactgtcatttcaacgaaagatgaaaaaacgtttaaaattgtaaaccacttttgaatgtccctgaaagtctttgtgcaaacctgacttgctgtattaaatgcaagaagtagtatgactgagatggaagactggtgttctagttgatttggattattgatgcccccaatgaaggaaacacaattcttaacagttgttcgcgatgaagaggcacagamcatagaagaatatattttaactgagggaacaaatttgagtctgctgggcaggacaacaaataagcgacactaaaacactttaaatttttgtttaggtttgatgcagtaactagatattttttattgtaatgtgcaaggccctggtacctgtgaggaaagcatgtgatgagtcttattttctttttaaagtcgtcataaccatgttagtacagcctaaacacttcattaaagcctgctgtacttctcatttctgaaataatcactctttagtgtgggttgaatttgggaattagcaccttg

SEQ ID NO: 175792 - DNA, 601 bp, Human
ctcagtcattggaaattcagctcgccggtccctaacgtccccgccctctttttcagctgagttaataaatgatcagtgttccgtcagctgagggccgagtttagatagcttctgttaggtagctgtgcctttttggataaggtcccttaaggttctgcccactgggatagtggtgtttaaataaaatttcaggctgaatggccacattgtgatggaagctgtttatcaaatattttcacagttgagttggtccatatgcccccgcctgaggcttctctccctagaactgctgcctctgaartgtctctaaatatagatctttacgatagtatattcactcattcacaaaatcccaccctccatcccgtaacatttttgttctaaaaaaatggagagagaggaaatatttggggccagtgccattgctagcatctgtcctcttcaaaacccgtctctgctctctgaataactggggcttatttttctagtgcagatgtgctctttcccagtctagaggttttaaaaatatatattcggagagtgcctcttttctgcccaggcacaggtctttcttggtagtatttccatgcagctaaaaatg

SEQ ID NO: 175793 - DNA, 601 bp, Human
ggattgaagcctgaggatgaaggtgcaaatggtgaccagtctcttgctactcccagggtcggccacacatgacagcatcagcttcccaaaggggcttgctagaaacgcagagcctcagacctcaccccagaccagctgaatcagaatctccatttcatccagggacttgtaaagatgcccaggtgatttgtaggcatctcaaaatttgagaagccatgagctggttcagtcttccctccatcctgtccatgagaaacagctggccacttctctgactgctcctttcctatctggcaaagargttcttgtagcaatagtgaccatttgtttctaaatagaatatgagtagcaaggggagggagaattctcccacagaaaacacttatttctcagtatggatggtaggagacacaggaatggacaggaagtacttgagtaaatgtgggctgcagctattgatcagacctgctgttcatcccttgattctgtggcagccccatgtggtgcggcttctgctaagtggggcagcattaagtactttgtcctttatgtagttggagacccccgtttcaggggttccctcagcttccaccaaatcccc

SEQ ID NO: 175794 - DNA, 601 bp, Human
gcaagtacaaaatggaagtttcataccctggtaactaagagaaagaagtggcattggccaagacagacaagaaaactggattgggagctagttcggggaagttgatgagttggctgagatttcagaagtgggtgggatcagatgtagctggagagaggccaggcaaaagaaggatctcgggtaccaccgcagtaggtagagagattggagctctccacacatctgtggttagaagtggggttctggtcccttcccttatgtggttcctgaccttttctttgggagctgtagagaaaatccratgactctgatcctgcccctcctgcctcgcagggtttttcagaggtgagatgccacatctgcaaagactcttgagaagacgtaagtgccagaaaactgcaaaagtggaaatgccctatgcctgaaattgccagcctctcagtcactcagaaggccagaaacggtcgctggggctctaagcaggactctttctttagctctcattagatctttttctttttctttctttttttttgagacagtgtttcactctgttgcgcaggctcatatgtaacagtgtgatcacagctcactgcagcct

SEQ ID NO: 175795 - DNA, 601 bp, Human
aagtacaaaatggaagtttcataccctggtaactaagagaaagaagtggcattggccaagacagacaagaaaactggattgggagctagttcggggaagttgatgagttggctgagatttcagaagtgggtgggatcagatgtagctggagagaggccaggcaaaagaaggatctcgggtaccaccgcagtaggtagagagattggagctctccacacatctgtggttagaagtggggttctggtcccttcccttatgtggttcctgaccttttctttgggagctgtagagaaaatccgaygactctgatcctgcccctcctgcctcgcagggtttttcagaggtgagatgccacatctgcaaagactcttgagaagacgtaagtgccagaaaactgcaaaagtggaaatgccctatgcctgaaattgccagcctctcagtcactcagaaggccagaaacggtcgctggggctctaagcaggactctttctttagctctcattagatctttttctttttctttctttttttttgagacagtgtttcactctgttgcgcaggctcatatgtaacagtgtgatcacagctcactgcagcctcc

SEQ ID NO: 175796 - DNA, 601 bp, Human
tgagatttcagaagtgggtgggatcagatgtagctggagagaggccaggcaaaagaaggatctcgggtaccaccgcagtaggtagagagattggagctctccacacatctgtggttagaagtggggttctggtcccttcccttatgtggttcctgaccttttctttgggagctgtagagaaaatccgatgactctgatcctgcccctcctgcctcgcagggtttttcagaggtgagatgccacatctgcaaagactcttgagaagacgtaagtgccagaaaactgcaaaagtggaaatgcyctatgcctgaaattgccagcctctcagtcactcagaaggccagaaacggtcgctggggctctaagcaggactctttctttagctctcattagatctttttctttttctttctttttttttgagacagtgtttcactctgttgcgcaggctcatatgtaacagtgtgatcacagctcactgcagcctccaccttccggactcaagggattttcctacctcatcctctcaagtagctgggactataggtacacatcaccatgcccagcttttttttttttttttttttttaaataatttttt

SEQ ID NO: 175797 - DNA, 601 bp, Human
tgcctgaaattgccagcctctcagtcactcagaaggccagaaacggtcgctggggctctaagcaggactctttctttagctctcattagatctttttctttttctttctttttttttgagacagtgtttcactctgttgcgcaggctcatatgtaacagtgtgatcacagctcactgcagcctccaccttccggactcaagggattttcctacctcatcctctcaagtagctgggactataggtacacatcaccatgcccagcttttttttttttttttttttttaaataattttttgtaragacagggccttgctatgtggcccaggctggtctctaactcctgggctcaagtgagccatctgcttcagcctcccgaagtgttgggatcacaggcatgagccagcgcacccagccatagatctttttcaaggctttgtttcttggggcagcccttggctaaatgctttagcttaaacgacagcattcctaatgtgagttgcagccagtttctgagttcctggacggagattttactttggatattactgttggacacaatagagttttttctcccctaaaatagaataagctgcaacatt

SEQ ID NO: 175798 - DNA, 601 bp, Human
gtgcaggtgtgtgctgtttaaacgccattgccaaatatggaaacagctggatgctgcagtgttgaagccaggagtgaaaagcccactgagcaggctcagattcagcagaaactcttgtgtaccatgtctgtgtgctaggtttttttcattatagaaataattatatcccttaatcctgcaaggtgggtgacttctatagataaggaaactgagtcctctggatggtttaaattaagggagcagtaaactttctgtaaaagacctcatagtacatattttaggctttctgggccattccgtstttgtgcagcatctctgctgttacagttcaaaagcagccagagacaacatgtaaatccatgttccagtagagttttagttgtaaaaacagactgcaggttgtagtttgctgattcctggttatacggatgattggtacagggctcagacttatgtcccctttggcctgggcaatctttgttttctgttctctctctctaagacatctcatttatgctcatggacttaaataatatgtgccgataatgccccaatttatagccttccctctcatctgagcactgtaattttcctttttttt

SEQ ID NO: 175799 - DNA, 601 bp, Human
acggggagggcagggggtgaggggcaggctgtccctttggcattctggcctgtgtgtgagagcgctgagtttggacccccaaacctgtgactagcggagtttgtgtgagcaggcgaaggcttgtgaccaggagcctggggcctaaagaggtgtttctgggcagagctgtacccagaacatcctcagacaggttttgcctgtggcctcagcttgggtacctttggttgcaagtagaaaaaaaccaattcaaactgacttagagaaaagagggcatatatcgcctgtgcctgacaggtgagaktcctacaggggtaattgctaggatggctttagagaaatgtgccctcctcaccccagacaaccccaaaaagtccaaagcatcagagtttttgggttttagaatcacctttgatctagaacagctgacttactcctgtggcttcctggggctgcctcatcctctctgcaacctccttggcagacatactggcttccagctgctggggaagtttgtgccccagcctcagtgacccagagccaggctggggtctgaaaagagagcggggctccacgccctgggctttggcttggcccacgaatg

SEQ ID NO: 175800 - DNA, 601 bp, Human
gaggagtgtggtcatatgtggcactgtgttcccaggagccctgctgctgatggccctggggtcagtggggaagagcaccaggcaagaaaggaaaacatgtctgtggaaggtggtcctttgcctgccctgcgagatgaggggaagcaggacttcaggagccagaggtcttccttcttcatgtccttcctgcccagcctttctggtaacagataagggaagagcatggctgagcctgctatggagcacacaccatgaaagccagcccctctctgggggcacagctcttaccctccagccccawgcacgttccaggctccatgacctggggccagcagccacctgctcccatagacagggaagtgggctaggctgggctgggctgagccaagccaagcctaggctgcggccagcggagctcttctgcccgcctcctctctccctttgtgggatgggactgtcccttttgtcctggtcatgccacagggctcggtggactgtccaagggttctttgtcctgattgtagtttctccatttcctctttgtttttccactgggtgcaactatcagtccatatctgtgacctgcatattttacctggac

SEQ ID NO: 175801 - DNA, 601 bp, Human
ttgtagtttctccatttcctctttgtttttccactgggtgcaactatcagtccatatctgtgacctgcatattttacctggaccaacaagacaggtggcctaggggctgagggtgtgcctggtaaactcagccagcactcccaagatagagcctgcccagatcagccttagccagcgatctctgctgttaagaacagtgcaacgctttggcaatacctcccagaaaaatagctagtgggcaatggcactggctcagcgcagacctgccctaggtttctgggcacatgacagtgcccactcrctccatgggcttgagaagactggcattcagggcctcatttatgatgtcggtgaaatggaattaacctcccacccgtgtctccctctctgttgctaaagaattctgtaggtaagaaagagaatgcataaagcgtttagggaaccaggagaagaattggtgcataaaacgttcgtgaaacactatgctcctgtttttttttaaattgagaaataaaaattccattgtagaatggctaaatcaagctaattaatgtattacctcccctcctttttgtgtgtgtagaatacacttaaaatctac

SEQ ID NO: 175802 - DNA, 601 bp, Human
ggatatcattgtgttttacaaaagggcagcttttcagagccactcctgtgtctgcagtttctcagaataaccagccccaaatatgacaagtatagtttggggtggtatattctggcctcctacagttgcattttggggtggtattgtcccgagccccaacacagaaaaggagggcagtaggaatttaagaatttcagataaagcattctcattttggaaggagcagtggagggaggctggaacagagagaaagtcaactgcatttggaagatgcagtttgaaaaacaatgagatgtttgtrcacagggccttttaaaaattataatgatgggaggatggagttgcagggatgatggcatgaacctataatcccagctgcttgggaggctgaggcaggagggtcacttgagcccaggagttcaaggctacagggcacaatgattgcacctgtgaatagccactgcattccagcctgggtaacatagtgagacctgtctctaaaataataaaatgatggcccagggagtggatggctcataggtgaaaggttttctgagcagcaagagaatgaagctggggaggagataaggcccaagcctct

SEQ ID NO: 175803 - DNA, 601 bp, Human
gcgcagtggctcacgcctgtaatcccagcattttgagaggccaaggcaggtggatcacttaaggccaggaatttgggaccagtctggccaacatggtgaaacctcgtctctactaaaattacaaaaaatcagccatggggttgtgcgcctgtagtcccagctactcggaggctgaggtgggaggatcacctgagccttaaagtttgaggctgcagtgagtggtgatcaggccactgcactccaggctgggcagagtgagaccctgtctcaacaaaacaaaacacaggataaacccctactktttttaaagcaatttacattacaattccaagtgaaaccagaagcatgacttttaagtagcaggaacattgagataatggaaaacttggagcctttgagaaaacaaagcacaaagctgctcttgaacaccttgccatgaaagtaacaaaacgctgaagcatgtttataagtcagggctgaaaatcatgatgaagaggaaaagccaggtgactgctgtcagtttcaataccttatcctgtttcttttatcatgaaattgagtagttcgtcagcaagaaggtcaggtctgagcatctatttaa

SEQ ID NO: 175804 - DNA, 601 bp, Human
ccatgaaagtaacaaaacgctgaagcatgtttataagtcagggctgaaaatcatgatgaagaggaaaagccaggtgactgctgtcagtttcaataccttatcctgtttcttttatcatgaaattgagtagttcgtcagcaagaaggtcaggtctgagcatctatttaaactcttaaccttgagactgtgatgcttatgtgatgtgggaaattgtatctgctcattagagctctgatatgtaattgaaatctgagattacttatctgccttgtcgtatttaaaccactgattatggctctgrcatttttgttactcttcaatcaaccagtatataaaggattcagaatctcttggaattaagaaaaagctattatcttcctggtatcaattatagcgcaagtaaaaagcaatgccttttttagccaaaactttgcaaaagtacatgctgggatctcagatctttccttgatgcccttcactttaacccctacttttatgtgtgacacaaacccggccacttctcaccttggaggcgagcaagctccatacccttcttccactcctgctcctgctgctgttgttacagctgtcagaatggcct

SEQ ID NO: 175805 - DNA, 601 bp, Human
tcgtatttaaaccactgattatggctctgacatttttgttactcttcaatcaaccagtatataaaggattcagaatctcttggaattaagaaaaagctattatcttcctggtatcaattatagcgcaagtaaaaagcaatgccttttttagccaaaactttgcaaaagtacatgctgggatctcagatctttccttgatgcccttcactttaacccctacttttatgtgtgacacaaacccggccacttctcaccttggaggcgagcaagctccatacccttcttccactcctgctcctgytgctgttgttacagctgtcagaatggccttctaaaaacaactcaggggccaggcctgggggctcatgcctgtaaccccaacactttaggaagccgaggcaggaggatcacttgagcccagaagtttgagaccagcctgggaaacattgggagcccttgtttctacaaaaaatgtttttaaaaaattagcagacgtggtggcttacacctgtagtcccagttatttgggaggctgaggcgacaggatcacttgagctcagtagtttgagaccagcctgggtagcatagggagccaccatct

SEQ ID NO: 175806 - DNA, 601 bp, Human
aaaataagcttttaagactttctagattttcaggctttctactaagctgttgtagcttctccatcccacatctgggtttgctcactttatttctatgtgccaaatcatgattgagactcgttgagacacacagtagaccacaggttgccatatttagcagagcagggaaagaactctggagagtttgcctttttgattagggagaaacgctgtgggaggtatttgttgagcagctactctgggcaggaccctgagaactatcaatttttggatgcgtgaaatagaccaaacatgaaacctrctctggacgcaggttctctctgaatcaggcaaagcttcaggcctctgaaggcctcattcaggagcatgttatccatggcagggagggtgtgatgcctgattaaaattccagctgcttggctcccaccaggagctcaccacgatttctgagttgcttgggatttagccaactggtttgcaaactgcatgtaaggtgtgtctgtgtttgttaaaaacaatgacttctcagcaggactcagtaatgggtttccacggagagaaacattaccaagagatgaatgcaggggcgtgattgtcctgt

SEQ ID NO: 175807 - DNA, 601 bp, Human
ataagcttttaagactttctagattttcaggctttctactaagctgttgtagcttctccatcccacatctgggtttgctcactttatttctatgtgccaaatcatgattgagactcgttgagacacacagtagaccacaggttgccatatttagcagagcagggaaagaactctggagagtttgcctttttgattagggagaaacgctgtgggaggtatttgttgagcagctactctgggcaggaccctgagaactatcaatttttggatgcgtgaaatagaccaaacatgaaacctgctstggacgcaggttctctctgaatcaggcaaagcttcaggcctctgaaggcctcattcaggagcatgttatccatggcagggagggtgtgatgcctgattaaaattccagctgcttggctcccaccaggagctcaccacgatttctgagttgcttgggatttagccaactggtttgcaaactgcatgtaaggtgtgtctgtgtttgttaaaaacaatgacttctcagcaggactcagtaatgggtttccacggagagaaacattaccaagagatgaatgcaggggcgtgattgtcctgtgca

SEQ ID NO: 175808 - DNA, 601 bp, Human
gccaaggtgggtggatcgcttgaggccaggagttcgagaccagcctggccaagatggcgaaaccccatctctaccaaaaatacaaaaagttagatgggcgtggtggcacgtgcctgtaatcccagctagtcgggtggctgagggatgagaatcacttgaacctgggaggcagaggttgcagtgagccaagattgcgccactgcactccagcctgggtaacagagtgagactctgtctcaaaaaaaacaaaaaaacaaacaaaaaaaacaacagggggtgggggcttaggagccaggattcyaaggccatacctgctcctgctctgaatcctgtggcctcctgtttgcaagagtccaccctgagattagtcatcctctcagtctcccgttggctctatgatggtgttgccctttgcccaggatgtgagtaatgagagtaacagaattcagggttgacctgactttcctgcagaggtctgggaagacctccatgtgacagccttcccatgtcactccctgcgggttccaagaatctcaggcctttgcagctgggatggcatggcatagacatgtgagacaccccctccttgtttgtatgagcg

SEQ ID NO: 175809 - DNA, 601 bp, Human
acagccttcccatgtcactccctgcgggttccaagaatctcaggcctttgcagctgggatggcatggcatagacatgtgagacaccccctccttgtttgtatgagcgaaagggccaaaagaatagggtggaggtcctggctggctgcccccgtgggctgctatggatctagatgcagaaactctgctgattcgttcccctggaggagaggttgctctgggaaactgcagctgccaaacctactggagactgatttgcaaataaggactccagcctgttcacatacaggagcctccgtgagyggggagggcagttgggtcaggctgaggctcagaagacacgtatgcctgtcttggctctgcccttgcccctgagtggttctgagctctcaggcaagatgctgaaccgcttggctccaagttctcatcctcagaacccaggaggacttgagcatcttgagagtgggagcttatctgtctggttcaccagcccaggtgcccgcaggtgatggggaataaataggtccttctgaaaccgtgaatagtcagggaatgatacccatgtgcctctcctgttgtaaggatcagtcatgaggaagctct

SEQ ID NO: 175810 - DNA, 601 bp, Human
gagtggggagggcagttgggtcaggctgaggctcagaagacacgtatgcctgtcttggctctgcccttgcccctgagtggttctgagctctcaggcaagatgctgaaccgcttggctccaagttctcatcctcagaacccaggaggacttgagcatcttgagagtgggagcttatctgtctggttcaccagcccaggtgcccgcaggtgatggggaataaataggtccttctgaaaccgtgaatagtcagggaatgatacccatgtgcctctcctgttgtaaggatcagtcatgaggaagytctgagggacggtaacatgtcagctgaggtgagcggccgtggggttattcccattcctgacacttcgcagcccctggctgaggcacccccatcctggtccttgggtacctgcctgagaaaccacacttggaatcggaaggacacttggtgagtgtggaacatcagcctccgatgcagaatggatgtgtcttgctggctgggggagcacttggagggggtccccgaggcacccctgataatacagcctgggggtgggggggtgccctggtgggtgtgtcttccctggccagtgcagagggg

SEQ ID NO: 175811 - DNA, 601 bp, Human
ggaactcctgggctcaagcaatcctcctgcctcggcctcccaaagtgccgggattacaggagtgagccactgtgcctggcctatcacatactcttttctttctttttttttttttttgagatggagttttgagttttgctcttgttgtccaggctagagtgcaatggcgcgatcttggctcactacaacctccgcctcctgggttcattcaggtgattcccctgcctcagcctcctgagtagctgggattacaggcacatgccaccatgcccagctactttttgtatttttagtagagatggggtttctccatgttggccaggctggtctcgaactcctgacctctagcggtccacccgcctcagcctcccaaagtcctgggattgcaggcatgagccaccgcacctggccatactctttatcagtgctatctatgtgcctgcctccaacattaccctgccccttctcatttaatttggattctgaaaccagataccaaacctattagactagactgtaagagaaggctaagtgtgttttttcagagaagaccaggtggagctttttattgagtaatgtgcaggatcctttagtgcaagct

SEQ ID NO: 175812 - DNA, 601 bp, Human
aaaagggtggtccgaggctcttttttctttatttctcctgacacttgattcagtctggcctttctccaggaaggcgtagcaggatctagttacaaatcggtgaaatcatgagcccagggtgtgggggccggcttagtgtcactctgcgcttcctgcagtgggccctcagccactagaaagtcacttctcttttgcgaggaacctggtattgtcacaaataagccaatttcaaaactaagtatgtttgtgttggggagtgaggagtgagtttcagcagacacatgtatgcacacccacatgrgcacagtgccacactgagcccccttcattctggaagcagtcccttggccctggacctggttgtgtgccccttgaggggaggatgaagttgacctcagcactacccggagctcgccctttcttcggtacactctggtgtccacaggtggcctggcttagcaccagccacagtttgttcctggcctccagggtctctttcctgtccagctcagcagctttgaccaagtaaaatagaggacttggtctgcttgctagcagaattacatttccccaaatttcttttctttctttcttttttttt

SEQ ID NO: 175813 - DNA, 601 bp, Human
ggggccggcttagtgtcactctgcgcttcctgcagtgggccctcagccactagaaagtcacttctcttttgcgaggaacctggtattgtcacaaataagccaatttcaaaactaagtatgtttgtgttggggagtgaggagtgagtttcagcagacacatgtatgcacacccacatgggcacagtgccacactgagcccccttcattctggaagcagtcccttggccctggacctggttgtgtgccccttgaggggaggatgaagttgacctcagcactacccggagctcgccctttcttyggtacactctggtgtccacaggtggcctggcttagcaccagccacagtttgttcctggcctccagggtctctttcctgtccagctcagcagctttgaccaagtaaaatagaggacttggtctgcttgctagcagaattacatttccccaaatttcttttctttctttcttttttttttctgagacagagtctcgctctgtcgcccagactggagtgcagtggtgtgaccttggctcactgcaatctctgcctcccaggttcaagtgattctcatgcctcagccccgtgagtagctggaat

SEQ ID NO: 175814 - DNA, 601 bp, Human
ttctcttgcctcggcctcccaagtagctgggactacaggcatgcgccaccacgcctggctaatctttgtatttttctttttttttagtagagatgggtttcaccatattggccaggctggtcttgaactcctgacctcaggtcatctgcctgccttggcctcccaaagtgctgggattacaggcatgagccacggtgcctgaccatgctttagtttaaattcagaattgggttcctgtttcttgcaactgtattcaattaacacctggccataacccaggcatgggactcctcaatctgcrgtgctctttccacttggtcatgctgctgctataacctagcgatggtcaggacggcgatggccagcgccccgggaaccccagtaacatcacaacatagccacgaagtgatagctacttgattctgaaaataggacctgctgggaatctcggggtaaatgtgttgtcatctgctttgatttttcgcgaggcagccgtaggtgtcagcctggaaaattctagcagcctggcttgccagagctagcttggtgtttgttcatggaaggcagtacctggctggctgcttctcagtcacctgaccgt

SEQ ID NO: 175815 - DNA, 601 bp, Human
tattttgttgtcgtagttcatagaagtaaaaacctgaaaatatttaaaccagatcacaaatacagggaaataggctcttagggtctgcattttccagctacctgactcttgctttggggccaatttccacgcccttctttcacacggtgtgtcagctgtggaggtgtttaattcagcattgtgtggagcagagcttttccgactgtgctctgtgggactctagagaccaagaaagtacttgaaaaaacgtttttaagccgaactagtacacagtcgaggagctcggcagggtcctgttttygtggccagcacagtctgtccccacctggggttacgttgttccctctttcctgcttggttgtacacaccgcactgtgtgctattggataccattagcacattgattgcctggtacggatagattaattcggttggtacagctggttgaccctcctgccctgtctgccttattaaaaattattgcatgaacacaggacaggccgttaaaaatcaggggctgtttgtaatgactcatgggtgcatctcaggactcttcccagtgatgtgcagcggggggagaaaccaacgggcatccggctac

SEQ ID NO: 175816 - DNA, 601 bp, Human
accaagaaagtacttgaaaaaacgtttttaagccgaactagtacacagtcgaggagctcggcagggtcctgttttcgtggccagcacagtctgtccccacctggggttacgttgttccctctttcctgcttggttgtacacaccgcactgtgtgctattggataccattagcacattgattgcctggtacggatagattaattcggttggtacagctggttgaccctcctgccctgtctgccttattaaaaattattgcatgaacacaggacaggccgttaaaaatcaggggctgtttgtratgactcatgggtgcatctcaggactcttcccagtgatgtgcagcggggggagaaaccaacgggcatccggctacctcatgtctccagcccccagtgtcaggtttttgagttcctccaaacaacttaattgctctcgatgatggaccttatacaagcatattgtaaattgctattacattacatatcgtaaaatgctattacaagcatattgtaaattgagcttgctgaaaatgtttggaagccacagatgtagcgaaaagggcacagattttagagacaggcagttctggatttgagac

SEQ ID NO: 175817 - DNA, 601 bp, Human
aaaagctgccatccacctcctctaattaacttgctgtctgctcccaagagagggttcagaaatatgaaaacaagacaggcagcaccggaagtgaatgccattctcgtggtctgtggtggtccctggtgttttgatgcagagatcgttcatagtaaacaggcaagggaccacaaagaggcttggtgtgccctggcccaccccatgctctgccttccacacagggcgatcgtgaacggcggtccctctgagcaggtgcacaggctgggcagttgctgcagcggagaactcattggaattcagsggctagaaccgaggggcatccggccctccctgttgcttgcttgtgctgttgagaaagagcagagccctttgtgcttcagagcctgctgtcgccagtgcccaggaatgcagaagccaggggatggacgagtactcaggctttcctcgaatctctgcttgagtggggcagcctcggggcctccggacgctggagaagctcacagcatctgtggccggtggtgcagctaacttttttggtgacattgaaagagatttaggtccaagagatacgagcaggggaattaggggtgggaatttgggg

SEQ ID NO: 175818 - DNA, 601 bp, Human
gggtcttgctctatcacctaggctgggatgcactggcacagtcatagctcactgcagcctcaaacttctgggcttaagtgatcctcctgcctcaccctccctagtagctgagaccataggcacatgccaccaagcctgggtaattttttatttttatctttttatagaaatagggcctcactgtgttgcccaggctggtctcaaatgcctgacatcaagcgatcctcccacctgagtctcccaaagcgctgggattagaggcatgagccaccgcacctggcctgttggttcctcttcaacycaggccaaggcttggccagtggcctctccttgttagtgggcagagtttctccacatggatttttggtccagttctctgggtgaagagtcttccttgagaacagactttcctgcagaccagcgagggccattttcactgtgtcggggttggtggccgtgctttgtgtcttggtctgatgcaccctctgcctggccggcttgctggcttccttcgttcactccattcacccactcaacacatgttcattcccggccctccactgtaggcttggagatactgtgataaacaaggccggctgcc

SEQ ID NO: 175819 - DNA, 601 bp, Human
agtggctggatgacaaacacattgtaatctctaggtcaaatgtgtgattaagaataaactattctggccgaggcgggcagatcatgaggtcaggagatggagaccatcctggccaatacggtgaaaccccatctccgttaaaaatacaaaaaattagctgggcgtggtggcgggcacctgtagtcccagctactcgggaggctgaggcaggagaatggtgtgaacccaggaggcggagtttgcagtgagcggagatcacaccactgcactccagcctgggtgacagagcgagtccgtctcaaaaaaaaaaaaaaaaaacaaaaaaacaaagaataaactatgcttggccgggcatggtggctcacgcctgtaatcccagcactctgggaggccaaggagggtggatcacctgaggtcgggagttcgagaccagcctgcccaacatagtgaaaccccgtctctactaaaaatacagaaattagccaggcatggtgccgcacgcctgtagtcccagctactcaggaggctgaggcaggagaatcgcttgaacccgggaggtggaggttgcagtgagccgagaccatgccactgcactccagcc

SEQ ID NO: 175820 - DNA, 601 bp, Human
ttggccgggcatggtggctcacgcctgtaatcccagcactctgggaggccaaggagggtggatcacctgaggtcgggagttcgagaccagcctgcccaacatagtgaaaccccgtctctactaaaaatacagaaattagccaggcatggtgccgcacgcctgtagtcccagctactcaggaggctgaggcaggagaatcgcttgaacccgggaggtggaggttgcagtgagccgagaccatgccactgcactccagcctgggtgacagaaccggactctgtctcaaaataaacaaacaaayaaatgtttagaagaaaatgatagcatgttatagggcatgtaccatccccagcaccaaggagtgtgcggagaggccacttgtggccacaggtgcgtcttctgggattcccagtccgacatcctgccagctctgggatgaatgggatgccactctgttctcttctttgatcctgtccttcttccttctgcctaacttcctttcaacaaagcagagaacaatctccattcttaaaacgaacacgcacaacatccatctttttcttagatggcagttactaaaagaatgagcattattgaggat

SEQ ID NO: 175821 - DNA, 601 bp, Human
taattgctgtggagtcacagcccctcagaaccttggattacaccaattggagtgtttgaacggggactttatgtttctcctcctttgaaaacggcagcaaggctagctgtgtgaggattgtacactcaggagacttacggttggaactgtgtctgctgaaagcccccctagcttgggctgtacaaagatccatttgatttgctgccctggttagaaaaccgcctcccaggcggagggtcccctcgtccattctgtagaccagcatggggcattacgaaggcgtgggaaggcagctgtgctwgctagtgtaggtggctgtaggagaagaaagatttgttctctcaaccataggaaagaagggtaccaggggaaaatctattgtttactttcctctgcacagtgcccgggatgttgcgaaaggtgctgtgggaaccacgtgaattaatacacaacacctttggctgtgaataaagatggtttttccccctggcaacctacattttataaagcactcacttgccctacattgggtcctaccagcgtgtctgggctccctgggatggaagatgtgtgggccagagcagtcccatgagcctgtcct

SEQ ID NO: 175822 - DNA, 601 bp, Human
gcagctgtgcttgctagtgtaggtggctgtaggagaagaaagatttgttctctcaaccataggaaagaagggtaccaggggaaaatctattgtttactttcctctgcacagtgcccgggatgttgcgaaaggtgctgtgggaaccacgtgaattaatacacaacacctttggctgtgaataaagatggtttttccccctggcaacctacattttataaagcactcacttgccctacattgggtcctaccagcgtgtctgggctccctgggatggaagatgtgtgggccagagcagtcccaygagcctgtcctgagggctgtagcctggaccacactcctgaggcagaagatggggcaaaggattgcacctgctgccagctggggcgggccaggactcagctcatctgaacgcagttcccttatctgtgaaatgaagagggtgatctgtgggtcccttcagatccttccagctccggcctcccgaggtcctgtgaagggaatggttggctgatgtacagtgaccgtgttattagaactcaaaaccggccaccaagggtcataattacatgtcatgtaattaaataatagctcccattcaagc

SEQ ID NO: 175823 - DNA, 601 bp, Human
taaagatggtttttccccctggcaacctacattttataaagcactcacttgccctacattgggtcctaccagcgtgtctgggctccctgggatggaagatgtgtgggccagagcagtcccatgagcctgtcctgagggctgtagcctggaccacactcctgaggcagaagatggggcaaaggattgcacctgctgccagctggggcgggccaggactcagctcatctgaacgcagttcccttatctgtgaaatgaagagggtgatctgtgggtcccttcagatccttccagctccggcctyccgaggtcctgtgaagggaatggttggctgatgtacagtgaccgtgttattagaactcaaaaccggccaccaagggtcataattacatgtcatgtaattaaataatagctcccattcaagcatttgccttgtcagggctatgctaggtcctctgagtgtttcatctcccactcaggtgagggaggatcagccgtatgcacacagcatccctgtatagtggatgtcttcccctgattccccagtgacacgcggaggttacgaacctcatacgccatctcacagcgataaggggactctggt

SEQ ID NO: 175824 - DNA, 601 bp, Human
gaagatgtgtgggccagagcagtcccatgagcctgtcctgagggctgtagcctggaccacactcctgaggcagaagatggggcaaaggattgcacctgctgccagctggggcgggccaggactcagctcatctgaacgcagttcccttatctgtgaaatgaagagggtgatctgtgggtcccttcagatccttccagctccggcctcccgaggtcctgtgaagggaatggttggctgatgtacagtgaccgtgttattagaactcaaaaccggccaccaagggtcataattacatgtcatrtaattaaataatagctcccattcaagcatttgccttgtcagggctatgctaggtcctctgagtgtttcatctcccactcaggtgagggaggatcagccgtatgcacacagcatccctgtatagtggatgtcttcccctgattccccagtgacacgcggaggttacgaacctcatacgccatctcacagcgataaggggactctggtgtcagaacccaggcctccccacttccaagcccggctcccttccatttggaaccagactgctctctgcgcaggtacagtgagctggtgcctttgt

SEQ ID NO: 175825 - DNA, 601 bp, Human
caggcccttagtaggtgttgagtgaaagttgttgctggacctgctgttgcttagatgtgtgctggggcagtcctgccagcctgtcctgagagctgcagcctaggccacgcccccgaggcaaaggatggggcaaaggattgcgagtcagtgggtgatcagtgggggcgacatggcaggagagctgaggcaggtccattctgacagttgcccacctgcccttcagggacattgttcagcattggggaatgcagcttctttactcattcttgctaggagattgccaagcccagggaaaggcccrtgttggggccttggaggtaatgggggcctccctgtgccctgcgtgcctatacctttcctctgtctcccaggacatggtccccaggcactgattgtggcactgcacctgggggcccgagccattgagccaagggtatacagattcacagccaccagatccaagcaccagtgtcctcgccaggcactcgttgtgctccaagtggctgtttgtggacagctgtcctcacattgacttggaatggagctcagtgcccagcctggctgcagagcacacagtggcttcccttttctttgggcccgc

SEQ ID NO: 175826 - DNA, 601 bp, Human
gggcccgagccattgagccaagggtatacagattcacagccaccagatccaagcaccagtgtcctcgccaggcactcgttgtgctccaagtggctgtttgtggacagctgtcctcacattgacttggaatggagctcagtgcccagcctggctgcagagcacacagtggcttcccttttctttgggcccgcctctggttttcgtatacactgtcacctgcttttgtctccaaagaggccatacgtgggtgctccctgtagccacgggagacttcctggcatggggtggggcatcccagaayccagctgaggcccttcccagcctggggcaggggcacaggggtgggtgtcaccatggcgtgtgaagagcagggggctgtggttgccttttcctgacacctgctatgacctgggccaggtgcttacagactctccctcttcacccacacaagaattccctatgacagctgatgacagcacactgtcttaggtctgatcacacggctatcaacgtaaccatagaccaggtacctgttagcaacagaaatgtattgcttacagttctggaggctgggaagtccaagctcagggcactggcagat

SEQ ID NO: 175827 - DNA, 601 bp, Human
agcctggctgcagagcacacagtggcttcccttttctttgggcccgcctctggttttcgtatacactgtcacctgcttttgtctccaaagaggccatacgtgggtgctccctgtagccacgggagacttcctggcatggggtggggcatcccagaacccagctgaggcccttcccagcctggggcaggggcacaggggtgggtgtcaccatggcgtgtgaagagcagggggctgtggttgccttttcctgacacctgctatgacctgggccaggtgcttacagactctccctcttcacccrcacaagaattccctatgacagctgatgacagcacactgtcttaggtctgatcacacggctatcaacgtaaccatagaccaggtacctgttagcaacagaaatgtattgcttacagttctggaggctgggaagtccaagctcagggcactggcagatttggtgtctagtgaggacctgctttctgttcatagacagcacctcctccctgtgtcctgacatggtgaaaggacacacagtcttcctcagtcctctttcgtaagggcactaatccactcatgaggacactgcccccatgagctc

SEQ ID NO: 175828 - DNA, 601 bp, Human
tcgtatacactgtcacctgcttttgtctccaaagaggccatacgtgggtgctccctgtagccacgggagacttcctggcatggggtggggcatcccagaacccagctgaggcccttcccagcctggggcaggggcacaggggtgggtgtcaccatggcgtgtgaagagcagggggctgtggttgccttttcctgacacctgctatgacctgggccaggtgcttacagactctccctcttcacccacacaagaattccctatgacagctgatgacagcacactgtcttaggtctgatcacayggctatcaacgtaaccatagaccaggtacctgttagcaacagaaatgtattgcttacagttctggaggctgggaagtccaagctcagggcactggcagatttggtgtctagtgaggacctgctttctgttcatagacagcacctcctccctgtgtcctgacatggtgaaaggacacacagtcttcctcagtcctctttcgtaagggcactaatccactcatgaggacactgcccccatgagctcatcacctcccaaaggccccacctcctgataccatcaccttatatgaggatttcaac

SEQ ID NO: 175829 - DNA, 601 bp, Human
acataggaatttcggggacacacacattcggaccagagcacacagcaagctgagggccgagccttttcaggcctggatctggctgccacaggcactcgggccctcttgggccggctgctccctcttcacaatgtgagtgtttcatgggcccaggaccagggaacaggtgagaccactggagattctgatgcagtccaggcagaggctggcactgcacctgggggccctggccattgagccaggggtatatgggttcacagccaccagatccaagccccgttcatcccaggctggaaggacratggagagtttggggcctgcatagagccaggtgaggagacatgagaggatggcgacctcacctgcccacagtggccacatctacagtgagaggacgggcacctcacctgcccacagtggctgtgttcacatggggaggacagttacctcacctgcccacagtggccacatctacagtgagaggacgggcacctcacctgcccacagtggctgtgttcacatggggaggacagttacctcacctgcccacagtggctgcgttcacatggggaggacggccacctcacctgcccacagtggc

SEQ ID NO: 175830 - DNA, 601 bp, Human
tttggggcctgcatagagccaggtgaggagacatgagaggatggcgacctcacctgcccacagtggccacatctacagtgagaggacgggcacctcacctgcccacagtggctgtgttcacatggggaggacagttacctcacctgcccacagtggccacatctacagtgagaggacgggcacctcacctgcccacagtggctgtgttcacatggggaggacagttacctcacctgcccacagtggctgcgttcacatggggaggacggccacctcacctgcccacagtggccacatctayagtgagaggacggccacctcacctgcccacagtggccacatttacagtgagaggatggccacctcacctgcccacagtggccatgttcacatggggaggacggcgacctcacctgcccacagtggccgtgttcacatggggaggacggccacctcacctgcccacagtggccatgttcacatggggaggacggcgacctcacctgcccacagtggccacatctacactgagaggatggcgacctcacctgcccacagtggccacatctacactgagaggacgaccacctcacctgcgcac

SEQ ID NO: 175831 - DNA, 601 bp, Human
tcagtaaccggctgagcccttgtgctgatgctggggctctgcctgggggactgtggccccttggtcggcagcccaccagggaagcaccccagcaggacaacaggtggggatgtggcaaggaaagctgctcatctctggctgacaccagagaagtgacagtcagcaaagcaggacagagagggacatgtgggccgggtacggtggcccatgcctgtcatctcagcactttgggaggctgaggtgggaggatcgctggagcccaggagtttgagaccagcctgggcagcatagcaagactgcwtctctacaaaaaatttaaaaactagccaggtgtggtgtcacgagtttggctagccacttaggagggtgaagccagaggatcacttggagttcaaggttgcaatgagctatgataacgccactgcactgcagcctgggtgacagagtgagaccctggctcttcaaaaaaaaaaaaaatgacgtgtggcatgctctaggtggagccaggatcagcccagggctgctgaagtcccagctgtctgaaccgcccgcacagcacagtggggctgtcactccaacagtgctcctgggtgccttctta

SEQ ID NO: 175832 - DNA, 601 bp, Human
tttctgggaattgaacagaagtttgagagcagacatacgagagcaagatagacctcaggaagcagaggagcacagccccacccggtgggggttcctggggtctctgtgagatcctgaacacccactggtctgaggacagaaggcagccatggcacgggcctcctgctctcttgctggtcggttttgggtttggtttcttgagctgtctgttttggaccacatcagaggagggtgggcaccaaaggacagcctctgcctggtacttctgcagcactgatgcctcacgcctctggggtaaaamccccacaggaacttggagctcaaaggcccatccaagcttatcctcaaagctgactcatttttgtggccaaatactaaagtgttacccactggaggtttaagaatgaggataggcccagatagaagcagatgaggtgagatagcccagttccagacttcccgatgaggaggcgcacctgtggcacctgttacgatgggggccctgagcccccaccccagccctgcagaaggaagtgctgctctgcagaggaaggggcggatggaggcggagtctggggttttaatgagtgtctcaggtgtg

SEQ ID NO: 175833 - DNA, 601 bp, Human
tctcaggtgtgtcttaggctagacaaatttgggaaatgttgaattcatcacggacttgctctgagctacccacagcaaccagcaaactgccacagaaagaccaagtactgctttgtatctcgttagcctacttaaaatggacaccttttcccagaataaatattactaactgaagattactatttgtgtacttagaagatacaaagccatgctctctgtgtaggagaccatctacccgtgatgcggcagcttaagagaagagtctgtgaatgcctgggcacacctctggccctctgggcgycaaggattcctgtgcacagtgaactcactggggggcggggggaaagaggggaggatggagaggcgccagtgcgggggctggcagcaagtgcttctgtgagaaacagtccagcaaggctaagggtgtggcctttggagaaggtagggtgacatcagctgggtgatgtctgctgccctgtcctggctttgtctctttcctgggagccccctgtcatctctaacacattcgctttccctcaacttgggcattttactgggcagcactggtgctatggcctgaattgtggcctccaatgtttgt

SEQ ID NO: 175834 - DNA, 601 bp, Human
tgttgaattcatcacggacttgctctgagctacccacagcaaccagcaaactgccacagaaagaccaagtactgctttgtatctcgttagcctacttaaaatggacaccttttcccagaataaatattactaactgaagattactatttgtgtacttagaagatacaaagccatgctctctgtgtaggagaccatctacccgtgatgcggcagcttaagagaagagtctgtgaatgcctgggcacacctctggccctctgggcgccaaggattcctgtgcacagtgaactcactggggggyggggggaaagaggggaggatggagaggcgccagtgcgggggctggcagcaagtgcttctgtgagaaacagtccagcaaggctaagggtgtggcctttggagaaggtagggtgacatcagctgggtgatgtctgctgccctgtcctggctttgtctctttcctgggagccccctgtcatctctaacacattcgctttccctcaacttgggcattttactgggcagcactggtgctatggcctgaattgtggcctccaatgtttgtatgctgaagccccaacccccaatgtgattatttgta

SEQ ID NO: 175835 - DNA, 601 bp, Human
tgctttgtatctcgttagcctacttaaaatggacaccttttcccagaataaatattactaactgaagattactatttgtgtacttagaagatacaaagccatgctctctgtgtaggagaccatctacccgtgatgcggcagcttaagagaagagtctgtgaatgcctgggcacacctctggccctctgggcgccaaggattcctgtgcacagtgaactcactggggggcggggggaaagaggggaggatggagaggcgccagtgcgggggctggcagcaagtgcttctgtgagaaacagtycagcaaggctaagggtgtggcctttggagaaggtagggtgacatcagctgggtgatgtctgctgccctgtcctggctttgtctctttcctgggagccccctgtcatctctaacacattcgctttccctcaacttgggcattttactgggcagcactggtgctatggcctgaattgtggcctccaatgtttgtatgctgaagccccaacccccaatgtgattatttgtagggaggacctttaaggagacagttaaggttgaatgggttcatacgggtggggccctaagcccatggggacca

SEQ ID NO: 175836 - DNA, 601 bp, Human
gcagcaagtgcttctgtgagaaacagtccagcaaggctaagggtgtggcctttggagaaggtagggtgacatcagctgggtgatgtctgctgccctgtcctggctttgtctctttcctgggagccccctgtcatctctaacacattcgctttccctcaacttgggcattttactgggcagcactggtgctatggcctgaattgtggcctccaatgtttgtatgctgaagccccaacccccaatgtgattatttgtagggaggacctttaaggagacagttaaggttgaatgggttcatacrggtggggccctaagcccatggggaccagtgttcctatacgaagaggaagagaccaggagtgtgcagagaaaaggccatctgcaaaccaaggagagcggcctcaggagagacaaacccactgatgccttgaccttggacttgcagcctccagcactgtgagaaataaatttctgtggtttaaaccgcccagtctgtggtccttggtgatggcagcccagcaagctcatgtaactgggataccctagtgacccttttcatctgatgaactgcgggtgctgactttgtcatcagactgagcca

SEQ ID NO: 175837 - DNA, 601 bp, Human
tccaatgtttgtatgctgaagccccaacccccaatgtgattatttgtagggaggacctttaaggagacagttaaggttgaatgggttcatacgggtggggccctaagcccatggggaccagtgttcctatacgaagaggaagagaccaggagtgtgcagagaaaaggccatctgcaaaccaaggagagcggcctcaggagagacaaacccactgatgccttgaccttggacttgcagcctccagcactgtgagaaataaatttctgtggtttaaaccgcccagtctgtggtccttggtgayggcagcccagcaagctcatgtaactgggataccctagtgacccttttcatctgatgaactgcgggtgctgactttgtcatcagactgagccagaaacctggagcctgtgtgcaaggcactgttctctggggcattgcccagatctgtgtcagtggagacatgaggtggaggaagtgttgtgtatgtattcatctgggttcctatccttccttacctctatgtcctcggcacaccccccagtggctgatgtatgggaggcaccccaggttatttgtggaatgaacaaatgaatcacacagt

SEQ ID NO: 175838 - DNA, 601 bp, Human
aatccagtaggggagcagggaggctgggtgtggtggctcacacctgtaatctcaacactttgggaggctgaggcagacggatcacttgaggtcaggagttcaagaccaacctggccaacataatgaaaccccatctctactaaaaatagaaaaattagccaggcgtggtggcacacacctgtaatcccagctactcgggaggctcagacaagagaatcacttcaacctgagaggtggaggttgtagtgagctgagatcgcaccactgcactccagcctgggtgatggaatgggactatttmaaaaaaaaaaaaatgcagtaggcgagcagggaggacttcgaacccagttggaccacaggagcccttctagccctgtgaggggccccgtggagcagcctgctctggtaaccaacacaataagacagccgttcccaaccagggaggattttgcccccacaagggtacatggcaatgtctagacacagtgttggttgtcacagctggggtaagggtggggcctactggcatccattgtgtggaggccagggatgctggtaagcatcctacagggcacaggacagcccccagcataaaaatctg

SEQ ID NO: 175839 - DNA, 601 bp, Human
ctgtaatcccagctactcgggaggctcagacaagagaatcacttcaacctgagaggtggaggttgtagtgagctgagatcgcaccactgcactccagcctgggtgatggaatgggactatttcaaaaaaaaaaaaatgcagtaggcgagcagggaggacttcgaacccagttggaccacaggagcccttctagccctgtgaggggccccgtggagcagcctgctctggtaaccaacacaataagacagccgttcccaaccagggaggattttgcccccacaagggtacatggcaatgtctrgacacagtgttggttgtcacagctggggtaagggtggggcctactggcatccattgtgtggaggccagggatgctggtaagcatcctacagggcacaggacagcccccagcataaaaatctgactgcccccaaatgaccataatgccaaggataagaaaccctgcagcaagattaggtttcctggttcatgatgagctaatgagagcatgtcagttctaaagaggaaagccatgctaagcaggcagggagctctttcttctggaggaagcaatgagcagatggttaagctcattgttgcg

SEQ ID NO: 175840 - DNA, 601 bp, Human
agttggaccacaggagcccttctagccctgtgaggggccccgtggagcagcctgctctggtaaccaacacaataagacagccgttcccaaccagggaggattttgcccccacaagggtacatggcaatgtctagacacagtgttggttgtcacagctggggtaagggtggggcctactggcatccattgtgtggaggccagggatgctggtaagcatcctacagggcacaggacagcccccagcataaaaatctgactgcccccaaatgaccataatgccaaggataagaaaccctgcagcaagattaggtttcctggttcatgatgagctaatgagagcatgtcagttctaaagaggaaagccatgctaagcaggcagggagctctttcttctggaggaagcaatgagcagatggttaagctcattgttgcgtgataactgctgacatttgaagggcctccgaaggcttccttctgcaggctgcagaggcacgtgtaacggcctgagagggagagggttggtgtttgtgggccttgacgacgggataggctgaggctcgtgcttcctcctgccaaggcccatttgaaagcacctggtccc

SEQ ID NO: 175841 - DNA, 601 bp, Human
agattaggtttcctggttcatgatgagctaatgagagcatgtcagttctaaagaggaaagccatgctaagcaggcagggagctctttcttctggaggaagcaatgagcagatggttaagctcattgttgcgtgataactgctgacatttgaagggcctccgaaggcttccttctgcaggctgcagaggcacgtgtaacggcctgagagggagagggttggtgtttgtgggccttgacgacgggataggctgaggctcgtgcttcctcctgccaaggcccatttgaaagcacctggtccccytcagcatcccctggtcctctgttccctccgtgtatccaggggcaattacagagcaggaagaggaggtcacggctggtgggaggatggggtacttgagagtactagggcctagaggaaacagggagttgattttagaaagaagcgaggcaacaccttttgaaatgagaaggaaggagtgtttggagaaaccgtttggtagaaagagctccgtatttagggcgtctgctccaggtaggccctgggtggagaagaggagagtgagaggcttgaaaccaggactagctcatagatgtgcttcca

SEQ ID NO: 175842 - DNA, 601 bp, Human
agagtactagggcctagaggaaacagggagttgattttagaaagaagcgaggcaacaccttttgaaatgagaaggaaggagtgtttggagaaaccgtttggtagaaagagctccgtatttagggcgtctgctccaggtaggccctgggtggagaagaggagagtgagaggcttgaaaccaggactagctcatagatgtgcttccaaatgatgctttcaatccaagcgtttattgatcctgtaagaaagtgtgaccagtcaagggggaaacaaagccaaggccagttcctgaactcaagaascttgaagttttcttgtgttgtgagctgagttctctgccaggtactccaggagaaaggttgctatgagcaaagcttggtaagcactctgcagaatactcactgcccagagatttgcagtcgggagcatgaattgctctgagaaaatcgacaggaagagaccagttcaggggttaattgtgcatttcccaaaccttgtttgtttgttgggatgagagatagggctccctgatttagcaaatgaaaatacagggtgcccattaaatctgaatcttagataaacaaagaatcatcgagacatgg

SEQ ID NO: 175843 - DNA, 601 bp, Human; identical to SEQ ID NO: 35445

SEQ ID NO: 175844 - DNA, 601 bp, Human; identical to SEQ ID NO: 35446

SEQ ID NO: 175845 - DNA, 601 bp, Human; identical to SEQ ID NO: 35447

SEQ ID NO: 175846 - DNA, 601 bp, Human; identical to SEQ ID NO: 35448

SEQ ID NO: 175847 - DNA, 601 bp, Human; identical to SEQ ID NO: 35449

SEQ ID NO: 175848 - DNA, 601 bp, Human; identical to SEQ ID NO: 35450

SEQ ID NO: 175849 - DNA, 601 bp, Human; identical to SEQ ID NO: 35451

SEQ ID NO: 175850 - DNA, 601 bp, Human; identical to SEQ ID NO: 35452

SEQ ID NO: 175851 - DNA, 601 bp, Human; identical to SEQ ID NO: 35453

SEQ ID NO: 175852 - DNA, 601 bp, Human; identical to SEQ ID NO: 35454

SEQ ID NO: 175853 - DNA, 601 bp, Human; identical to SEQ ID NO: 35455

SEQ ID NO: 175854 - DNA, 601 bp, Human; identical to SEQ ID NO: 35456

SEQ ID NO: 175855 - DNA, 601 bp, Human; identical to SEQ ID NO: 35457

SEQ ID NO: 175856 - DNA, 601 bp, Human; identical to SEQ ID NO: 35458

SEQ ID NO: 175857 - DNA, 601 bp, Human; identical to SEQ ID NO: 35459

SEQ ID NO: 175858 - DNA, 601 bp, Human; identical to SEQ ID NO: 35460

SEQ ID NO: 175859 - DNA, 601 bp, Human; identical to SEQ ID NO: 35461

SEQ ID NO: 175860 - DNA, 601 bp, Human; identical to SEQ ID NO: 35462

SEQ ID NO: 175861 - DNA, 601 bp, Human; identical to SEQ ID NO: 35463

SEQ ID NO: 175862 - DNA, 601 bp, Human; identical to SEQ ID NO: 35464

SEQ ID NO: 175863 - DNA, 601 bp, Human; identical to SEQ ID NO: 35465

SEQ ID NO: 175864 - DNA, 601 bp, Human; identical to SEQ ID NO: 35466

SEQ ID NO: 175865 - DNA, 601 bp, Human; identical to SEQ ID NO: 35467

SEQ ID NO: 175866 - DNA, 601 bp, Human; identical to SEQ ID NO: 35468

SEQ ID NO: 175867 - DNA, 601 bp, Human; identical to SEQ ID NO: 35469

SEQ ID NO: 175868 - DNA, 601 bp, Human; identical to SEQ ID NO: 35470

SEQ ID NO: 175869 - DNA, 601 bp, Human; identical to SEQ ID NO: 35471

SEQ ID NO: 175870 - DNA, 601 bp, Human; identical to SEQ ID NO: 35472

SEQ ID NO: 175871 - DNA, 601 bp, Human; identical to SEQ ID NO: 35473

SEQ ID NO: 175872 - DNA, 601 bp, Human; identical to SEQ ID NO: 35474

SEQ ID NO: 175873 - DNA, 601 bp, Human; identical to SEQ ID NO: 35475

SEQ ID NO: 175874 - DNA, 601 bp, Human; identical to SEQ ID NO: 35476

SEQ ID NO: 175875 - DNA, 601 bp, Human; identical to SEQ ID NO: 35477

SEQ ID NO: 175876 - DNA, 601 bp, Human; identical to SEQ ID NO: 35478

SEQ ID NO: 175877 - DNA, 601 bp, Human; identical to SEQ ID NO: 35479

SEQ ID NO: 175878 - DNA, 601 bp, Human; identical to SEQ ID NO: 35480

SEQ ID NO: 175879 - DNA, 601 bp, Human; identical to SEQ ID NO: 35481

SEQ ID NO: 175880 - DNA, 601 bp, Human; identical to SEQ ID NO: 35482

SEQ ID NO: 175881 - DNA, 601 bp, Human; identical to SEQ ID NO: 35483

SEQ ID NO: 175882 - DNA, 601 bp, Human; identical to SEQ ID NO: 35484

SEQ ID NO: 175883 - DNA, 601 bp, Human; identical to SEQ ID NO: 35485

SEQ ID NO: 175884 - DNA, 601 bp, Human; identical to SEQ ID NO: 35486

SEQ ID NO: 175885 - DNA, 601 bp, Human; identical to SEQ ID NO: 35487

SEQ ID NO: 175886 - DNA, 601 bp, Human; identical to SEQ ID NO: 35488

SEQ ID NO: 175887 - DNA, 601 bp, Human; identical to SEQ ID NO: 35489

SEQ ID NO: 175888 - DNA, 601 bp, Human; identical to SEQ ID NO: 35490

SEQ ID NO: 175889 - DNA, 601 bp, Human; identical to SEQ ID NO: 35491

SEQ ID NO: 175890 - DNA, 601 bp, Human; identical to SEQ ID NO: 35492

SEQ ID NO: 175891 - DNA, 601 bp, Human; identical to SEQ ID NO: 35493

SEQ ID NO: 175892 - DNA, 601 bp, Human; identical to SEQ ID NO: 35494

SEQ ID NO: 175893 - DNA, 601 bp, Human; identical to SEQ ID NO: 35495

SEQ ID NO: 175894 - DNA, 601 bp, Human; identical to SEQ ID NO: 35496

SEQ ID NO: 175895 - DNA, 601 bp, Human; identical to SEQ ID NO: 35497

SEQ ID NO: 175896 - DNA, 601 bp, Human
gtggggaaggagatttgacttccacttgcctcggtgactttgtctgttaagcagaaccataatactggcccttcccctcctgtgctttgggcagtgactctccctagctcattgggaaccctggttgcccaaacagctctcaatccaacactagaggtgtggggggtcactgtggaatgttggggggcaggccccagtatgagagaaaaacccagagggatggtcctgatcagggctacccatgcccctgaggatggtggaatgaaggcagagtcgggggctgcataaaggaaagtctctyccagggaccaaagcttggagaactgagggtggaagggggattaaacagaagtgggtagggcagagccttctgcctgtgggctggatttcctcaggcaagaagcctgtgggtaagctctgtataatgcgaggaggagtccccacaaagcaggctggtcagtggtcacgctagtgtgagtctttcaaacatcccgtgtaagtagatactgtcattgcacagaggaggaaatggagcctggcccaaggtctcaagaaacaacccagccgggattcagactcggcagcctgcgcacttaacagc

SEQ ID NO: 175897 - DNA, 601 bp, Human
agctctcaatccaacactagaggtgtggggggtcactgtggaatgttggggggcaggccccagtatgagagaaaaacccagagggatggtcctgatcagggctacccatgcccctgaggatggtggaatgaaggcagagtcgggggctgcataaaggaaagtctcttccagggaccaaagcttggagaactgagggtggaagggggattaaacagaagtgggtagggcagagccttctgcctgtgggctggatttcctcaggcaagaagcctgtgggtaagctctgtataatgcgaggagkagtccccacaaagcaggctggtcagtggtcacgctagtgtgagtctttcaaacatcccgtgtaagtagatactgtcattgcacagaggaggaaatggagcctggcccaaggtctcaagaaacaacccagccgggattcagactcggcagcctgcgcacttaacagccgtgagcaaccaggaactccccagccctttctcttgtgccttcaagagtgcaagaaactgaccactgcccctagagagctctctgaagagcattcccatggctacagattgggtttggagccgcttgggctcac

SEQ ID NO: 175898 - DNA, 601 bp, Human
gctctcaatccaacactagaggtgtggggggtcactgtggaatgttggggggcaggccccagtatgagagaaaaacccagagggatggtcctgatcagggctacccatgcccctgaggatggtggaatgaaggcagagtcgggggctgcataaaggaaagtctcttccagggaccaaagcttggagaactgagggtggaagggggattaaacagaagtgggtagggcagagccttctgcctgtgggctggatttcctcaggcaagaagcctgtgggtaagctctgtataatgcgaggaggmgtccccacaaagcaggctggtcagtggtcacgctagtgtgagtctttcaaacatcccgtgtaagtagatactgtcattgcacagaggaggaaatggagcctggcccaaggtctcaagaaacaacccagccgggattcagactcggcagcctgcgcacttaacagccgtgagcaaccaggaactccccagccctttctcttgtgccttcaagagtgcaagaaactgaccactgcccctagagagctctctgaagagcattcccatggctacagattgggtttggagccgcttgggctcacc

SEQ ID NO: 175899 - DNA, 601 bp, Human
ggctacccatgcccctgaggatggtggaatgaaggcagagtcgggggctgcataaaggaaagtctcttccagggaccaaagcttggagaactgagggtggaagggggattaaacagaagtgggtagggcagagccttctgcctgtgggctggatttcctcaggcaagaagcctgtgggtaagctctgtataatgcgaggaggagtccccacaaagcaggctggtcagtggtcacgctagtgtgagtctttcaaacatcccgtgtaagtagatactgtcattgcacagaggaggaaatggarcctggcccaaggtctcaagaaacaacccagccgggattcagactcggcagcctgcgcacttaacagccgtgagcaaccaggaactccccagccctttctcttgtgccttcaagagtgcaagaaactgaccactgcccctagagagctctctgaagagcattcccatggctacagattgggtttggagccgcttgggctcaccatgggccagcattgttttggatggcctgagggcaaggactgtccctgctcttcatgcatcctgaagattagctcagtacctggcacagagtcgatgtt

SEQ ID NO: 175900 - DNA, 601 bp, Human
cctgcaggtactgcacgttctagctaggcaggggtcttgtttattgctttgctgtccctagggtgcatagtcaggaaaccttggggcccagttcttaggttcaaagttcagtcagcaatttgctagatgtgttagcctcaggtggtacttaacctcagcatcaccgtgtataaaatgggggctcctctaaacagtgctcaggttttatggttgtgagaattaaatgagatggtggatataaaggatttagcaccatgcttgcatgggatgctctcaatatctcgagcaccacaaatacgargtaccattcatagcatccttctatttgtcccctcctccctgctcccctgctgtaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtac

SEQ ID NO: 175901 - DNA, 601 bp, Human
ctgcaggtactgcacgttctagctaggcaggggtcttgtttattgctttgctgtccctagggtgcatagtcaggaaaccttggggcccagttcttaggttcaaagttcagtcagcaatttgctagatgtgttagcctcaggtggtacttaacctcagcatcaccgtgtataaaatgggggctcctctaaacagtgctcaggttttatggttgtgagaattaaatgagatggtggatataaaggatttagcaccatgcttgcatgggatgctctcaatatctcgagcaccacaaatacgagrtaccattcatagcatccttctatttgtcccctcctccctgctcccctgctgtaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtaca

SEQ ID NO: 175902 - DNA, 601 bp, Human
ttaaaaaagaaggaatctacaacattgacctgaaccttcatatttccaccaaaacttgagaacgaaggccagtgggtggccatccctcagacagggccatattcttctccctacgtatgttctaaaacaggcttcctgttttgcttttggctgcaaagggaaaagaataatgctataagaacatcccactaggatgttcagatgtcaaagttcaaggatgtcaccccagcactccttcaagcccccttctcaaccagagagccagggcccaggcacgtgagggtgatgggaagacccgccyccccccccacctcggagccctcagacccagcctgcggggtgccacggcagccacttacgtagatgagccctgagtagtaacgctccttgaggttgtgcagcaccgaggcttcgttgaggcacgtgagctctgccatgtcctccaccttggagaacttgggcgggttcatcttctggatgtcatccttgttcaccttcaccttcttcccattctccaccagctccacgatggcctcttcgcccacctcctccttgaggctggctggctcaaagccactcttgtcggaaggcacccatacca

SEQ ID NO: 175903 - DNA, 601 bp, Human
aattaaaaaagaaggaatctacaacattgacctgaaccttcatatttccaccaaaacttgagaacgaaggccagtgggtggccatccctcagacagggccatattcttctccctacgtatgttctaaaacaggcttcctgttttgcttttggctgcaaagggaaaagaataatgctataagaacatcccactaggatgttcagatgtcaaagttcaaggatgtcaccccagcactccttcaagcccccttctcaaccagagagccagggcccaggcacgtgagggtgatgggaagacccgsccccccccccacctcggagccctcagacccagcctgcggggtgccacggcagccacttacgtagatgagccctgagtagtaacgctccttgaggttgtgcagcaccgaggcttcgttgaggcacgtgagctctgccatgtcctccaccttggagaacttgggcgggttcatcttctggatgtcatccttgttcaccttcaccttcttcccattctccaccagctccacgatggcctcttcgcccacctcctccttgaggctggctggctcaaagccactcttgtcggaaggcacccatac

SEQ ID NO: 175904 - DNA, 601 bp, Human
aaacaggccaggtgcggtggctcgcgcctgtaatgccagcactttgggaggccgaggcgggtggatcacctgaggtcaggcattcaagaccagcctcgccaacatggtgaaaccccgtctctactaaaaatacaaaaatcagccaggcattatggcaggtgcctataatcccagctactcaggaggctcaggaaggaaaatcgcttgaacccaggagacagaggttacagtgagccaagatcacaccattgcactccagcgggggcaacagagcaagactccgtctcaaaaaaaaaaaaaattaaattaaattaaattaaattaaaaaagaaggaatctacaacattgacctgaaccttcatatttccaccaaaacttgagaacgaaggccagtgggtggccatccctcagacagggccatattcttctccctacgtatgttctaaaacaggcttcctgttttgcttttggctgcaaagggaaaagaataatgctataagaacatcccactaggatgttcagatgtcaaagttcaaggatgtcaccccagcactccttcaagcccccttctcaaccagagagccagggcccaggcacgtga

SEQ ID NO: 175905 - DNA, 601 bp, Human
aaaaacaatagtaagatggcagagataccaaaaatgggcttggggcaaatggtgaagggagaggagatccagtgatgcaagaggaacaaagcaggaaaccaggaactggcactccctactttagaaggaatctactacatttttaaagtgcaaaaagcttattggaaagaaatcaaaagagataaagatatttttaaaaatatcttttaaaatatttcattattttaataatataataaataataaataaataaaatatttaaaatattttattttaagatattttttaaaatattttaaattaagatattttatttaaaaaaatttttaaagatatttaaaaaataaaatgttaaaaaagaagattttttaaagatattattaaaaataattaaaattcaaaaaaacaggccaggtgcggtggctcgcgcctgtaatgccagcactttgggaggccgaggcgggtggatcacctgaggtcaggcattcaagaccagcctcgccaacatggtgaaaccccgtctctactaaaaatacaaaaatcagccaggcattatggcaggtgcctataatcccagctactcaggaggctcaggaagga

SEQ ID NO: 175906 - DNA, 601 bp, Human
caggagttcgagaccagccctaggcaacataatgagaccctgtctctaataaaaatattaaaaattagccaggcgtggtggcacaggcctgtagtcccagccaccagagaggctaaggtgggaggatcgcttgagcctaagagtttgaggctgcagtgagctgtgatcatgccactgcactccagtctgggcaacagagctactttgggaggctgaggtgggtggatcacgaggtcaggagttcgagaccagactggccaattaaaaaagaccctgtctcaaaaaaaaaaaaaaaaaacaatagtaagatggcagagataccaaaaatgggcttggggcaaatggtgaagggagaggagatccagtgatgcaagaggaacaaagcaggaaaccaggaactggcactccctactttagaaggaatctactacatttttaaagtgcaaaaagcttattggaaagaaatcaaaagagataaagatatttttaaaaatatcttttaaaatatttcattattttaataatataataaataataaataaataaaatatttaaaatattttattttaagatattttttaaaatattttaaattaagat

SEQ ID NO: 175907 - DNA, 601 bp, Human
ctcaggagttcgagaccagccctaggcaacataatgagaccctgtctctaataaaaatattaaaaattagccaggcgtggtggcacaggcctgtagtcccagccaccagagaggctaaggtgggaggatcgcttgagcctaagagtttgaggctgcagtgagctgtgatcatgccactgcactccagtctgggcaacagagctactttgggaggctgaggtgggtggatcacgaggtcaggagttcgagaccagactggccaattaaaaaagaccctgtctcaaaaaaaaaaaaaaaaaacaatagtaagatggcagagataccaaaaatgggcttggggcaaatggtgaagggagaggagatccagtgatgcaagaggaacaaagcaggaaaccaggaactggcactccctactttagaaggaatctactacatttttaaagtgcaaaaagcttattggaaagaaatcaaaagagataaagatatttttaaaaatatcttttaaaatatttcattattttaataatataataaataataaataaataaaatatttaaaatattttattttaagatattttttaaaatattttaaattaag

SEQ ID NO: 175908 - DNA, 601 bp, Human
gagtcccagagcaagtcttactcttggtggctcacctctgctcaaagcacactccctagggaagtaacccacaccaacaagcatccgtaaagaacaagatgggctgggcacagtggctcacgcctgtaatcccagcactttgggaggcccaagcagaagaatcacttgtgctcaggagttcgagaccagccctaggcaacataatgagaccctgtctctaataaaaatattaaaaattagccaggcgtggtggcacaggcctgtagtcccagccaccagagaggctaaggtgggaggatcrcttgagcctaagagtttgaggctgcagtgagctgtgatcatgccactgcactccagtctgggcaacagagctactttgggaggctgaggtgggtggatcacgaggtcaggagttcgagaccagactggccaattaaaaaagaccctgtctcaaaaaaaaaaaaaaaaaacaatagtaagatggcagagataccaaaaatgggcttggggcaaatggtgaagggagaggagatccagtgatgcaagaggaacaaagcaggaaaccaggaactggcactccctactttagaaggaatctact

SEQ ID NO: 175909 - DNA, 601 bp, Human
ccctgtctcctaacttggtgatggactgcgtttctgcattttctttcttgccagaagaaagaaaatgacgcccctgatctgctgcatgtgctggccctttgcacatgctgctctctggactctcaatacacttccccttggtcaagcctggcaagggaccagcactaaagtgctggacagagtcccagagcaagtcttactcttggtggctcacctctgctcaaagcacactccctagggaagtaacccacaccaacaagcatccgtaaagaacaagatgggctgggcacagtggctcacrcctgtaatcccagcactttgggaggcccaagcagaagaatcacttgtgctcaggagttcgagaccagccctaggcaacataatgagaccctgtctctaataaaaatattaaaaattagccaggcgtggtggcacaggcctgtagtcccagccaccagagaggctaaggtgggaggatcgcttgagcctaagagtttgaggctgcagtgagctgtgatcatgccactgcactccagtctgggcaacagagctactttgggaggctgaggtgggtggatcacgaggtcaggagttcgagacc

SEQ ID NO: 175910 - DNA, 601 bp, Human
gggctcacactggaattccagcacttggggaggccagggtgagaggatcgcttgaggccaggagttcgagaccagcctgggcaaaaaagcaagtttccatcactacaaaaaattaaaaaattaaaataaaaattagctgcgtgtggtggcatgcacctgtagtcccagctactcaagagactgagataggaggatcacttgaggccaggagttcgaggttgcagtaagccatgatggcaacactgtgctccagcctgggtgacagagggagaccctgctcttaaaaaaaaaaaaaaaaaaagagcagctgagcttagaaatggacaagcgtgtttggctgcttggaaaaggagatgcagggcccttgatttcctttcttcctgggataattagtcacttgttttccctccaactgctcttttcacaagagaccaggaaagctctgaagaagtgtaaacacggtattggcaacctgcgggcccaggcatttcaggaggaagagacacgggagcctgttctggtttttcctctgcgtgaatgttgagtggggacaagagagaaggccagggagcagcaaggtcaccccaggagctcagaaaca

SEQ ID NO: 175911 - DNA, 601 bp, Human
tgatcacatttacatcccagaaagatgaccagctggtggaagcacagggtagggggctctattaagagtaaagttggccaggcacggtggctcacgcctgtaatcccagcactttgggaggccgaggtgggtggatcacctgaggtcaggagttcgagtccagcctggccaacatggcaaaaccccgtctctactaaaaatacaaaaattagccgtgcatggtggcacaagcctgtaatcccagctactaggggggctgaggcaagagaatcgcttgagcctgggaagcggaggttgcagwgagccaagatcatgccactgcacactccagcctgggtgacagaacgagattccgtctcaaaaaaaaaaaaaaagaaagaaaggaagtggtagagactgtccgatgctggggagaggtgaggtaggaactcctgagagccgtggacttagcaacacacaggtcatacataggtgacctctgttggccagtctggagaaggggtggggacagacagccagggcgaggggagtgaccaggaggtggggatagaggcagtgagcacagacacttcctccacaaagcttcactgcgatggaacag

SEQ ID NO: 175912 - DNA, 601 bp, Human
gcgattacttttgcagcaacctaatagctctgggggaatgaggagcctttctatgatttgtcaagatttcaaatcaagtgatttgatcacatttacatcccagaaagatgaccagctggtggaagcacagggtagggggctctattaagagtaaagttggccaggcacggtggctcacgcctgtaatcccagcactttgggaggccgaggtgggtggatcacctgaggtcaggagttcgagtccagcctggccaacatggcaaaaccccgtctctactaaaaatacaaaaattagccgtgcatggtggcacaagcctgtaatcccagctactaggggggctgaggcaagagaatcgcttgagcctgggaagcggaggttgcagtgagccaagatcatgccactgcacactccagcctgggtgacagaacgagattccgtctcaaaaaaaaaaaaaaagaaagaaaggaagtggtagagactgtccgatgctggggagaggtgaggtaggaactcctgagagccgtggacttagcaacacacaggtcatacataggtgacctctgttggccagtctggagaaggggtggggacagacagcca

SEQ ID NO: 175913 - DNA, 601 bp, Human
ccgcgattacttttgcagcaacctaatagctctgggggaatgaggagcctttctatgatttgtcaagatttcaaatcaagtgatttgatcacatttacatcccagaaagatgaccagctggtggaagcacagggtagggggctctattaagagtaaagttggccaggcacggtggctcacgcctgtaatcccagcactttgggaggccgaggtgggtggatcacctgaggtcaggagttcgagtccagcctggccaacatggcaaaaccccgtctctactaaaaatacaaaaattagccgtgcatggtggcacaagcctgtaatcccagctactaggggggctgaggcaagagaatcgcttgagcctgggaagcggaggttgcagtgagccaagatcatgccactgcacactccagcctgggtgacagaacgagattccgtctcaaaaaaaaaaaaaaagaaagaaaggaagtggtagagactgtccgatgctggggagaggtgaggtaggaactcctgagagccgtggacttagcaacacacaggtcatacataggtgacctctgttggccagtctggagaaggggtggggacagacagc

SEQ ID NO: 175914 - DNA, 601 bp, Human
tgaagggcactgtacactaacacagagtcacagtgttattaggctagtgcaaaagtaatcgcggtctttgccattacttttaatggcaaagaccgcgattacttttgcagcaacctaatagctctgggggaatgaggagcctttctatgatttgtcaagatttcaaatcaagtgatttgatcacatttacatcccagaaagatgaccagctggtggaagcacagggtagggggctctattaagagtaaagttggccaggcacggtggctcacgcctgtaatcccagcactttgggaggccraggtgggtggatcacctgaggtcaggagttcgagtccagcctggccaacatggcaaaaccccgtctctactaaaaatacaaaaattagccgtgcatggtggcacaagcctgtaatcccagctactaggggggctgaggcaagagaatcgcttgagcctgggaagcggaggttgcagtgagccaagatcatgccactgcacactccagcctgggtgacagaacgagattccgtctcaaaaaaaaaaaaaaagaaagaaaggaagtggtagagactgtccgatgctggggagaggtgaggta

SEQ ID NO: 175915 - DNA, 601 bp, Human
ctgggattacaggtgtaagccaccacacccagccgaagaagaaggaaaatagcctagagacgtccttcgtcagtcaatgtgggagctcaagagctgcagcaagtccaatgctagcagaaggcaaagtgaaaacctctcagactgagggttagaaaacacatggacccaattcctgcacggactgctttaaaggaggcatcaacaatacaagtttcccgtgctcacaaatgtatttcctatccctggtctccaaaagatgaaatcgcccacctggctgggtgcggtggctcacacctataawcccagcactttgggaggccgaggcgggtggatcatgaggttaggagttcaagaccagcctgaccaacatggtgaaaccccgtctctactaaaaatacaaaaaaattagccaggcgtggtagcatgcacctgtaatcccagctactcaggaggctgaggcaggagaattgcttgaacccaggaggcggagcccgcaatgagccgagatcgtgccactgcactccagcctggatgacagagtgagactccatctcaaaaaaaaaaaaaaagaaaaagaaatcgcccacctacctgccctcat

SEQ ID NO: 175916 - DNA, 601 bp, Human
ccaaagtgctgggattacaggtgtaagccaccacacccagccgaagaagaaggaaaatagcctagagacgtccttcgtcagtcaatgtgggagctcaagagctgcagcaagtccaatgctagcagaaggcaaagtgaaaacctctcagactgagggttagaaaacacatggacccaattcctgcacggactgctttaaaggaggcatcaacaatacaagtttcccgtgctcacaaatgtatttcctatccctggtctccaaaagatgaaatcgcccacctggctgggtgcggtggctcacrcctataatcccagcactttgggaggccgaggcgggtggatcatgaggttaggagttcaagaccagcctgaccaacatggtgaaaccccgtctctactaaaaatacaaaaaaattagccaggcgtggtagcatgcacctgtaatcccagctactcaggaggctgaggcaggagaattgcttgaacccaggaggcggagcccgcaatgagccgagatcgtgccactgcactccagcctggatgacagagtgagactccatctcaaaaaaaaaaaaaaagaaaaagaaatcgcccacctacct

SEQ ID NO: 175917 - DNA, 601 bp, Human
agattcaaatggctgcctggaagatgcatttggccatcaccttcattaagcgagcaggagtgtggacggaaggaatgagcgatttgaagcctccgtggaaggcggggcagttcagtcaagaagtgtttggactcctactgccagctctaacaggtacttatcgcaggcatcacacacacggcgtcttacttcttaccatggccctgcccaggagtgtcatgaagcccaagaggaggacaagaggacaaaggctcaattagagtgagttgacttgctccagccaggttgcagttaggaagckaaagaggcagattcctgctctgtctagtccaaaacccacagtctctcctccacgacacacttcctcttgctcaaaggcaatacgtggcactattcccaagtctaaggctgagacaggcccagcagcccctttttggtgccctatagaagtgctgtgtcatctatcaaaggcccgtacccaccccagaagctctcgaggctcggtggggcgcccctcctctgtgctagtctctggctctcatcttgaagctgatttgcctgtctctgagcacgaaacagtcacctcctccaggcaggcccc

SEQ ID NO: 175918 - DNA, 601 bp, Human
ctccactgggcttcttgagaaatgggtatgggccaagaaagaaaaacaggaaaaagggcagtttcaggttggacaacatgcccacgttgggtgagactgatgggataatctgagacaaatgggaccaaaactttccaccaccagggagtcttctgctttcagggaaactccagagtggcccctggggggtggcttgctatatgtgttggcactgtgagccctgccctgcgttgccaggatggcttgatcagagttgcacaaatggggctgagaactcaggtctctggaaacctcacgcacmccaggactcccctccatcgaacacccctatgagcacagcactcggcacctcccgcaggcctgcctcagtgctgcaaagaaagggccgcgacactctcatgacgagaagctctgcttctccacagccagctcaattcacaagcttgggttacaagtctttgggaggcaaacagagaggtgaagaaaagcaagtgcaaaatgatgcttcatattagcagaggctgcagatctgtgccgagtggggtggagcttcctggcagcctgcctgcctagcaatctgccagcaaaggaggaagcccct

SEQ ID NO: 175919 - DNA, 601 bp, Human
catgcgcacacacgtgtgcaaagccatatacatagatccacacaaggcacacagctgcacacgcattcacagatgcatatccacaagcacaagtgcaaacacaggcacgcaaggcacatgtattcacaggtgaatgtgaacatacatgtatgtacatagccatgcacacacacggatgtatgcacaggcacacacacttcaaattccgaaaccccagagccaaattcagtgtctcctctccatccacccgagcgtccctagctctcccacttctccagccttccccgtccaattcctgaarccaatttaccactgtcaacacagcctaaccataccttaaagaaatctggatttgttctgccaggaacattcatctggacaaatgctttctgaaaggcaaactgctgggaggcctcctcattgcatctcttaccgcactgcttagtatcctaaatccaccggccggatgcaccacgaatcgtaccatggccccatgcaaccgaaaaggtctttccaatgctcaggaagggttttggtctgttatcttgtgtggcctccaataaccttacaaggtattgtattgtaatgtacaaagcaggta

SEQ ID NO: 175920 - DNA, 601 bp, Human
tttctgtgacaacctgttctctagccgggtgtcaggaactttcagcaactatcaacagctctatgaactgctcggcaaggaaggttataaatacccaccctcccccagtacaggaggggcagtaatgcccacactctgaaagctaagtttgccagaaacactaaggcatcctggctgttcagtactgggtattcaagcaacagctgaaaatataaactcatttttttccgttttatcccgccccatctaatagcctcaccgtccttgaagtcaaattggcctgaatccaggatcaggctayttacaaatatttgagctgcagtgaggtatttaattctgagtctcagtttctacatccacaaagtaagatctgctactaactcccttgcaggattagtttgaaaaatagaaataacacataaaatggacctgccgcagtccctgtaaagacagtaagctccacaaacggttgctgtctataccgacttccccaacgcgacgtcgccacgatgggtggcagtggcgttgtcagggcagtgggagcatccgtggctgttggtacagtatcagccctgggtggaaacacggattcagcgacgtg

SEQ ID NO: 175921 - DNA, 601 bp, Human
ttgggaatgggggactctgcaagccccagttgtggtttcagtaggagacctcaagaatgagaacagactggggtgaaacgaaccactacccagacggagaaatacttacgtgcacaagatggattgatcttctcggtctgaaacaaagaagacatcagattaactcccgccagatgcaaaagcctccccaccttgctcccaaagagctgcccgtttcccagacagggagcacagtgtcacagatgctgtctttgtggggatctcgcagtctaccctcacacctggctaggaggagcatctkcgggggagagtgccattgggcagctgctcctgccgcccaggagctcagattgtccacccacgctgttcagcccccaccagaaaaccagaaatagttctgtgtctcccaccttagaggaactagtgtgtggaaaactctccaggagtcgacttccctgggagctgagtgggacctgccctgtgtgtttataacggggtggggggctgaagctgttagaaagaagcctgctgcaggtgctctaaataccatccccactgaaggaaggagcaccatttaagaggctggggaaggaggggtgac

SEQ ID NO: 175922 - DNA, 601 bp, Human
acttcaattcaggtaaagaaaagccaccatccagagcaagaaggaatgccttccacccagaagttacggaggagctggttcccagctggattgtggagagatcttgcttttcctttctgccataagctccaccctccttcccactggctccttgaggaaggatgattgaaattgagctcatccatgcagtgggaccactgagtagcaaacacacaaactgaagtcctatcccttggagaagtggaggaggggccttgaattgggaatgggggactctgcaagccccagttgtggtttcagwaggagacctcaagaatgagaacagactggggtgaaacgaaccactacccagacggagaaatacttacgtgcacaagatggattgatcttctcggtctgaaacaaagaagacatcagattaactcccgccagatgcaaaagcctccccaccttgctcccaaagagctgcccgtttcccagacagggagcacagtgtcacagatgctgtctttgtggggatctcgcagtctaccctcacacctggctaggaggagcatcttcgggggagagtgccattgggcagctgctcctgccgcccagg

SEQ ID NO: 175923 - DNA, 601 bp, Human
tccacccagaggcatttcaacagcagggaaaagaaatggaatcaaatacaggtctgcctgagacctttcaagcctccatcaacttgaggaccaagtcttggaatctgccttccagcctcagaaggggaggacacacagcaacgagctgcaaaagccaagagggctgccatgcaaactccaggacctcgccagtttccatagcaactcagaaggctaggaggccaaggatggaatgggcttgctaccgctggaccactcccaggacaggccacgccactgcctcaatggaaatgggcccagmctctgcttcattccccaaagcatcctcttgtaaagctgaagccaggaccactaagtgctcttcctccatcatcccaccaaggccaagcaggcggccacagggacaagggctgcagcactcacctggtccttcttgctcttgtgcgaggacgccacgtacgccagatactggatgaccttcttggtgttctccgtcttgccagctccagattcaccactaccaagagaggcaaggaagtcccgggcttaggcatggccaagtccttgacctctgtcccttcccactgcacgctccactgcc

SEQ ID NO: 175924 - DNA, 601 bp, Human
ttcgctggggtggtgggggtgggtggctgtccacccagaggcatttcaacagcagggaaaagaaatggaatcaaatacaggtctgcctgagacctttcaagcctccatcaacttgaggaccaagtcttggaatctgccttccagcctcagaaggggaggacacacagcaacgagctgcaaaagccaagagggctgccatgcaaactccaggacctcgccagtttccatagcaactcagaaggctaggaggccaaggatggaatgggcttgctaccgctggaccactcccaggacaggccaygccactgcctcaatggaaatgggcccagactctgcttcattccccaaagcatcctcttgtaaagctgaagccaggaccactaagtgctcttcctccatcatcccaccaaggccaagcaggcggccacagggacaagggctgcagcactcacctggtccttcttgctcttgtgcgaggacgccacgtacgccagatactggatgaccttcttggtgttctccgtcttgccagctccagattcaccactaccaagagaggcaaggaagtcccgggcttaggcatggccaagtccttgacctc

SEQ ID NO: 175925 - DNA, 601 bp, Human
agctgtgttccctgctgacaacagtgatgactaacctatggctttttctctactgacatctaattgggcacagaagagattttaatttttcaatgaaatctgcgtaacatgaaatgatgcggtactgtatgaggtttggggttacccatcggtttctgaagggcttcactgggtggtgtttctgccagtgggccccagctcgtacacaaataacagagcagggagagtcaaaggtcaccgttcaggatccgggcatctgcctggaaagccccttggaccaagctctgctttgccaacctgyggcccaggccaaacctggcctccccgcagcaaggtgaggtctggaacaacccctctgctggtgttgggagggtcaactcggtcactgcaagtgagagagcgctggctcccaaaccaattcaagggtgttctgtgctccggcagcctgtggaaaatcacagcacagcttcaggcaaggaaatcaaccaaaccggccaatggtctttcacgctgacagcctgagctatgactggaagcctggggcaacctactccctcactctagtgggctcagggcagggacggggtgcctaccaaagtct

SEQ ID NO: 175926 - DNA, 601 bp, Human
gcagacagaagggagcgcggcccctccattgcctgtgctcgccctggctgggaggcgaactgaggcctctgtttgggaccacacgctgttgccgtggaaagtggggccgcggggccaagtcgggagcagccacttcagattccagagctgtgttccctgctgacaacagtgatgactaacctatggctttttctctactgacatctaattgggcacagaagagattttaatttttcaatgaaatctgcgtaacatgaaatgatgcggtactgtatgaggtttggggttacccatcggtttytgaagggcttcactgggtggtgtttctgccagtgggccccagctcgtacacaaataacagagcagggagagtcaaaggtcaccgttcaggatccgggcatctgcctggaaagccccttggaccaagctctgctttgccaacctgcggcccaggccaaacctggcctccccgcagcaaggtgaggtctggaacaacccctctgctggtgttgggagggtcaactcggtcactgcaagtgagagagcgctggctcccaaaccaattcaagggtgttctgtgctccggcagcctgtggaaaat

SEQ ID NO: 175927 - DNA, 601 bp, Human
gactccaaccaaggccaggccccggtatcatccaagtgcggccttcccgccaggctttggaaaccttggtcagtttgaacttacttccatggccctggaaacggcaggcaggaagctccctcagctctaggaacctggccctggacaacccatgtgaaagcagcacttaaactagggagccggcggcacagacaccctgggacagtgtctccaccctgtatacaccagcttccctctacctccttgcctctaatcctcacatttttattccttttcataggaaaagcaaatgaggggatcrgatctggaaaatatacacgctcatctcatctgtgtcctgataaatgcttcactttctgtaccagcccctccactgccgcgtccaaaaccaccatgacaggcagtgagcacgggatccatgaggcccactttgggctccaggctgtttactgagaatgtcaataaatcctactgtgaactccagggtgctttgtggtagacaaaatgcacccttgtgccttcttatccctggatccccaccatactcacggggcaggacagagcagccccatttcacagaagaggaagctgaggccaaggg

SEQ ID NO: 175928 - DNA, 601 bp, Human
cagctcgccctgcaaggaacccagggacgcagtgaaggccgggcagcgacctgggctgccgagcctgccctgcctggaagggggacgatggcagagccgtgtcagcatgtccaacgtgccaggaacagaggtttccgggtgggctccagtgtgcgactccaaccaaggccaggccccggtatcatccaagtgcggccttcccgccaggctttggaaaccttggtcagtttgaacttacttccatggccctggaaacggcaggcaggaagctccctcagctctaggaacctggccctggacracccatgtgaaagcagcacttaaactagggagccggcggcacagacaccctgggacagtgtctccaccctgtatacaccagcttccctctacctccttgcctctaatcctcacatttttattccttttcataggaaaagcaaatgaggggatcggatctggaaaatatacacgctcatctcatctgtgtcctgataaatgcttcactttctgtaccagcccctccactgccgcgtccaaaaccaccatgacaggcagtgagcacgggatccatgaggcccactttgggctccaggctgtt

SEQ ID NO: 175929 - DNA, 601 bp, Human
cccagagccggggcgccgccgcgctactcacgaagcgggaggagttgtcattcttcacggtcttggcgttcccgaaggcctccaggatggggttggcctgcagcagctgccgctccagctcgccctgcaaggaacccagggacgcagtgaaggccgggcagcgacctgggctgccgagcctgccctgcctggaagggggacgatggcagagccgtgtcagcatgtccaacgtgccaggaacagaggtttccgggtgggctccagtgtgcgactccaaccaaggccaggccccggtatcatscaagtgcggccttcccgccaggctttggaaaccttggtcagtttgaacttacttccatggccctggaaacggcaggcaggaagctccctcagctctaggaacctggccctggacaacccatgtgaaagcagcacttaaactagggagccggcggcacagacaccctgggacagtgtctccaccctgtatacaccagcttccctctacctccttgcctctaatcctcacatttttattccttttcataggaaaagcaaatgaggggatcggatctggaaaatatacacgctcatctcatct

SEQ ID NO: 175930 - DNA, 601 bp, Human
ggcacattaagactgaataacttgcatggggtcatttgcagcaaccctaacaaaggggctgaatcgggtgtggcaaggacataatttcaagatctcgacatagtcacaggcaaggctcccattaaggaggagctacggcagaaatcattggtgtcctgacgaatggtttggtctcaggaatgaataagggaagccctggtccacatgatcacaagtttaagttattctgaaatgcttacttggtgagaaaaaaaagcagggtcatgtttacgtgtgttttacatctgtatagaaaataccracagatactaacattaaaaagaatagtgtccggaatttccgcaagaccttccctcctgagcaaatccatggccaagcacctgccccattatttccagcgagaggccccgggtgttacctgtgttgtcgggcatggacgcctggtcagtgttccgctccttcttgaagacgatgttgccgagctgaagaacccctgagatgacccgcagcaggcctttgggtgcaatcagaggcagctcagaagcagacatgggtcatggtgattcccgggggtgggggccactcatctagggatcctcaa

SEQ ID NO: 175931 - DNA, 601 bp, Human
aatttttgtatttttaatagagatggggtttcacaatgttggccaggctggtctcgaactcctgacctcgtgatctgcccgcctcagcctcccaaactgctgggattacagatgtgagccaccacgcccggtcaggagtgtcttttacaatccacacacccatgcgttacatctttagagagaccctaaggagggcacattaagactgaataacttgcatggggtcatttgcagcaaccctaacaaaggggctgaatcgggtgtggcaaggacataatttcaagatctcgacatagtcacrggcaaggctcccattaaggaggagctacggcagaaatcattggtgtcctgacgaatggtttggtctcaggaatgaataagggaagccctggtccacatgatcacaagtttaagttattctgaaatgcttacttggtgagaaaaaaaagcagggtcatgtttacgtgtgttttacatctgtatagaaaataccgacagatactaacattaaaaagaatagtgtccggaatttccgcaagaccttccctcctgagcaaatccatggccaagcacctgccccattatttccagcgagaggccc

SEQ ID NO: 175932 - DNA, 601 bp, Human
ccttttgggcagctaagatttttcagagaataagagagggacaaaaagtcctaattagacccaagagagaaagttctaattagacccaagagaataagtccctctgcttgacttgggagcagagaggaagaaagccacggggtgaatgagcaatcattaccaggacaaccgcatctgggcccttctttagcagggccacagacacctagcaccccccagactcagcagccacatacaggtcagtgggcagggcagctgtacctcccctgagccccacggggcagagaggaaggcgtcctgrctggaggccacagcggcagcagtggttcctctgtccactctcagccgcactcctcagagtgtaaaagcaggtccctacccaccaatggggctgagaggagcaggccaacctggtgctggggcacggaacagcacaggatcccacaggaatgtctttttttttttttgagacggcgtcttgctcttgttgcccaggctggagtgcagtggcgcgatttcggctcactgcaacccctacctcctggcttcaagcaattctcctgcctcaacctcccaagtagctgggattacaggcgcacgc

SEQ ID NO: 175933 - DNA, 601 bp, Human
tttttgtaatagaaaatggaggtttctccttaatggtcagggaaacgaacaggtggcaggaataatacgcgatgtcttttgaaaacaacagtcttgtctttcatgcaatgcttctgcacagaaacagccgtgagctgtcagtgtacagtgaatgggagaaagactaacaaaatgagcttccaagtatttttgagagatgggtttggcaccctaaaaacccccatggccagcaccataaaagaaactagaaaccccggagagaggcagaaagcggtccgcactgggcgggacctccactccrggggcaggcaggcacatcagtctggcaggaaggagcaagcgctgctgctcgtctctcagcacacgtggcaagcccaaggcagcaggtggtagagaaacagccgcttggcacaggctcgaggatggcgggagccgccaccctggcaccagaaggagttcagctacagtggcatcaagttcctgcttttataccagacaggacatgcctatatccttgatgaccaatcagccaaaataccatctcaatgtaaagaggcacaatgcagtctcaggatggcacttcctgggcgtgaagccttga

SEQ ID NO: 175934 - DNA, 601 bp, Human
taactgctgaagccgcctacgtgatgggcacgtggggctctttacactctcccctcttctttgttttgcacatttgcaaagctctgtaattaaaagccagaaggagaactaagtttaattcttttttttttttaagtcttgtaggaaagagctgcccaatgatattcatcactgggaattgttttccttctctcgatttttctgtattaagagtcatgtagtatttttgtaatagaaaatggaggtttctccttaatggtcagggaaacgaacaggtggcaggaataatacgcgatgtctyttgaaaacaacagtcttgtctttcatgcaatgcttctgcacagaaacagccgtgagctgtcagtgtacagtgaatgggagaaagactaacaaaatgagcttccaagtatttttgagagatgggtttggcaccctaaaaacccccatggccagcaccataaaagaaactagaaaccccggagagaggcagaaagcggtccgcactgggcgggacctccactccgggggcaggcaggcacatcagtctggcaggaaggagcaagcgctgctgctcgtctctcagcacacgtggcaagcccaa

SEQ ID NO: 175935 - DNA, 601 bp, Human
ggaacatccgctcataggtcgccttggccaaggcctcgatggcaaagtcagcctgcggggcacacccggggagcgtggtgtcagatacaaaggatctgaaaaccctcataccctatgccccagtaatttcacttttagagtcctccccctagaggaacagccctaagtatgtgggggaaaaaaaaaaatcttcgtacacaaatatgttcactgtggtgttatttaaaatgatgaaaagtagaaacaacctaatatctaacaatatggggacaataaacttagatcttttgaaataaaatgrggacacactaaaggatttacagaaaaagtgatgcttcaaaataaggcagtggtctacggccgtaccaccctaaatgcacccgatctcatcaaaataaggcagcagtctacggccataccaccctaaacgcgcccaatctcatcaaaataaggcagcagtctacggccataccaccctaaacgcgcccgatctcatcaaaataaggcagtgggcagaggggcagggggagataagacaaacgatgagccaagactcgccgtgagttagtaactgctgaagccgcctacgtgatgggcacgt

SEQ ID NO: 175936 - DNA, 601 bp, Human
aggaggcgccctgcctcttggtcttgtccagagccttgttgatgcgcagcaccagccagcggaacatccgctcataggtcgccttggccaaggcctcgatggcaaagtcagcctgcggggcacacccggggagcgtggtgtcagatacaaaggatctgaaaaccctcataccctatgccccagtaatttcacttttagagtcctccccctagaggaacagccctaagtatgtgggggaaaaaaaaaaatcttcgtacacaaatatgttcactgtggtgttatttaaaatgatgaaaagtasaaacaacctaatatctaacaatatggggacaataaacttagatcttttgaaataaaatgaggacacactaaaggatttacagaaaaagtgatgcttcaaaataaggcagtggtctacggccgtaccaccctaaatgcacccgatctcatcaaaataaggcagcagtctacggccataccaccctaaacgcgcccaatctcatcaaaataaggcagcagtctacggccataccaccctaaacgcgcccgatctcatcaaaataaggcagtgggcagaggggcagggggagataagacaaac

SEQ ID NO: 175937 - DNA, 601 bp, Human
caaccaacaggccaaggaggcagcagggtgggtaatgaagggcaaggctcacatcaaagatctcgaagccggcaatgtccaggatcccgatgaaggaggcgccctgcctcttggtcttgtccagagccttgttgatgcgcagcaccagccagcggaacatccgctcataggtcgccttggccaaggcctcgatggcaaagtcagcctgcggggcacacccggggagcgtggtgtcagatacaaaggatctgaaaaccctcataccctatgccccagtaatttcacttttagagtcctcccsctagaggaacagccctaagtatgtgggggaaaaaaaaaaatcttcgtacacaaatatgttcactgtggtgttatttaaaatgatgaaaagtagaaacaacctaatatctaacaatatggggacaataaacttagatcttttgaaataaaatgaggacacactaaaggatttacagaaaaagtgatgcttcaaaataaggcagtggtctacggccgtaccaccctaaatgcacccgatctcatcaaaataaggcagcagtctacggccataccaccctaaacgcgcccaatctcatcaaaa

SEQ ID NO: 175938 - DNA, 601 bp, Human
ccgatgctcagggaatatttgctggaagaataaacaggaagcacctgcccaggaagcctccaagaatgtgacctaaaaggtcccatcctcccagcctggacaacatggcaaaaccccatccgtacaaaaaatacaaaaattagccaggtgtcatgccacatgcctgtagtaccagctactcgggaagctgaggtgggagaatggcttatgcccgggaggtcgaagctgcagtgagccatgttcacaccactgcactccagcctgggtgacagagcaagaccctgcctcaaaaaaaaataayaaacaaacaaaaggtctcattttctccagcatttctggttgaaaatgagcccttctgtttagcttaaaacacatctaactgagcctgggccacacctgaggccccatctctacaaaaaatttaaaaattagctgggagtggtggtgcgtgcctatagttccagctactaagggggctgaggtgcgaggatcagttaagcccaggaggcaaaggctgcagtgagctatgactgcacctctgtactccagcctgagtgacaaagcgagaccctgactttttttttttttttttttgagacag

SEQ ID NO: 175939 - DNA, 601 bp, Human
aaattttgaggtagcgatgcataaatgacactaccagatctctgcaacaaccggaatgtaacacgaaaacatctgatttctattggtgacagatcacaagtactgctaatacaactgtggtttgtatagtttgttcagttcgcaactggaaaaaatacatgatttcaatgagaggttagtaaaaaataaagatgtaattttctcatcccagctcatggctcctctcaaacctcccgtggactccaggttaagaacctctaatctactgtaagtatcggtttccctactagacctcaaagtygtcatgggcaagggagatgtcttatcccgatgctcagggaatatttgctggaagaataaacaggaagcacctgcccaggaagcctccaagaatgtgacctaaaaggtcccatcctcccagcctggacaacatggcaaaaccccatccgtacaaaaaatacaaaaattagccaggtgtcatgccacatgcctgtagtaccagctactcgggaagctgaggtgggagaatggcttatgcccgggaggtcgaagctgcagtgagccatgttcacaccactgcactccagcctgggtgacagag

SEQ ID NO: 175940 - DNA, 601 bp, Human
caaatgattctcttgcctcagccttccaaagtgctgggattacaggagtgagccaccgcacccggcctctgtgcttccttattaacaagaactagccatgggcttaataacttccaaaattttgaggtagcgatgcataaatgacactaccagatctctgcaacaaccggaatgtaacacgaaaacatctgatttctattggtgacagatcacaagtactgctaatacaactgtggtttgtatagtttgttcagttcgcaactggaaaaaatacatgatttcaatgagaggttagtaaaarataaagatgtaattttctcatcccagctcatggctcctctcaaacctcccgtggactccaggttaagaacctctaatctactgtaagtatcggtttccctactagacctcaaagttgtcatgggcaagggagatgtcttatcccgatgctcagggaatatttgctggaagaataaacaggaagcacctgcccaggaagcctccaagaatgtgacctaaaaggtcccatcctcccagcctggacaacatggcaaaaccccatccgtacaaaaaatacaaaaattagccaggtgtcatgcca

SEQ ID NO: 175941 - DNA, 601 bp, Human
cacccaggctggagtacaatggcgcaatctcagctcactgcagcctccgcttcctgggctcaagtgatcctcccagcttagcctccctagtagctgggaccccaggcacacactatggtacatggctaatattggtattttttgtagaaatggggtttcaccatgctgctcaggctggtcttgaacccctgagctcaagcaattcttctgcctcaacctctcgaagtgctgggactacaggtgtgagccactgcaccaggcccttctatttttttattgaagagatggggccttgctttgytgcccaggctggtctcaaactcctgacttcaaatgattctcttgcctcagccttccaaagtgctgggattacaggagtgagccaccgcacccggcctctgtgcttccttattaacaagaactagccatgggcttaataacttccaaaattttgaggtagcgatgcataaatgacactaccagatctctgcaacaaccggaatgtaacacgaaaacatctgatttctattggtgacagatcacaagtactgctaatacaactgtggtttgtatagtttgttcagttcgcaactggaaaaaa

SEQ ID NO: 175942 - DNA, 601 bp, Human
cagacaccccttgagaaggagggtggggcagggatacaggaagggcctccttgggcacctccatgccgctgcctttagagcccggatgctcctggccttccctttatccacccagcagtgggcaacatttactctttggagccagtgaccgcgggcagtctggtaaagccttttcagaatagtgctttaaattgcatccaatagattacaaagaaagtagttattttgaaatataatcatcaaaatattgtgatcgagtaatacattgttttttttttttattttttattttttgagacasagtctcattctgtcacccaggctggagtacaatggcgcaatctcagctcactgcagcctccgcttcctgggctcaagtgatcctcccagcttagcctccctagtagctgggaccccaggcacacactatggtacatggctaatattggtattttttgtagaaatggggtttcaccatgctgctcaggctggtcttgaacccctgagctcaagcaattcttctgcctcaacctctcgaagtgctgggactacaggtgtgagccactgcaccaggcccttctatttttttattgaagagatg

SEQ ID NO: 175943 - DNA, 601 bp, Human
gacgccaaccctgcactaaagaggcccagacaccccttgagaaggagggtggggcagggatacaggaagggcctccttgggcacctccatgccgctgcctttagagcccggatgctcctggccttccctttatccacccagcagtgggcaacatttactctttggagccagtgaccgcgggcagtctggtaaagccttttcagaatagtgctttaaattgcatccaatagattacaaagaaagtagttattttgaaatataatcatcaaaatattgtgatcgagtaatacattgttttttwtttttattttttattttttgagacacagtctcattctgtcacccaggctggagtacaatggcgcaatctcagctcactgcagcctccgcttcctgggctcaagtgatcctcccagcttagcctccctagtagctgggaccccaggcacacactatggtacatggctaatattggtattttttgtagaaatggggtttcaccatgctgctcaggctggtcttgaacccctgagctcaagcaattcttctgcctcaacctctcgaagtgctgggactacaggtgtgagccactgcaccaggc

SEQ ID NO: 175944 - DNA, 601 bp, Human
gaagttccactcgatgccctcgcgctggtactcctcctgctccaggatgaacatggtgtggttgaagagctgctgcagcttctcattggtgtaattgatgcacagctgctcaaacgagttcagctgcaaggagagaaaacaatgtcagagagacgccaaccctgcactaaagaggcccagacaccccttgagaaggagggtggggcagggatacaggaagggcctccttgggcacctccatgccgctgcctttagagcccggatgctcctggccttccctttatccacccagcagtgggcracatttactctttggagccagtgaccgcgggcagtctggtaaagccttttcagaatagtgctttaaattgcatccaatagattacaaagaaagtagttattttgaaatataatcatcaaaatattgtgatcgagtaatacattgttttttttttttattttttattttttgagacacagtctcattctgtcacccaggctggagtacaatggcgcaatctcagctcactgcagcctccgcttcctgggctcaagtgatcctcccagcttagcctccctagtagctgggaccccaggcaca

SEQ ID NO: 175945 - DNA, 601 bp, Human
gcaggtcgaggccaaagtcgatgaagttccactcgatgccctcgcgctggtactcctcctgctccaggatgaacatggtgtggttgaagagctgctgcagcttctcattggtgtaattgatgcacagctgctcaaacgagttcagctgcaaggagagaaaacaatgtcagagagacgccaaccctgcactaaagaggcccagacaccccttgagaaggagggtggggcagggatacaggaagggcctccttgggcacctccatgccgctgcctttagagcccggatgctcctggccttccmtttatccacccagcagtgggcaacatttactctttggagccagtgaccgcgggcagtctggtaaagccttttcagaatagtgctttaaattgcatccaatagattacaaagaaagtagttattttgaaatataatcatcaaaatattgtgatcgagtaatacattgttttttttttttattttttattttttgagacacagtctcattctgtcacccaggctggagtacaatggcgcaatctcagctcactgcagcctccgcttcctgggctcaagtgatcctcccagcttagcctccct

SEQ ID NO: 175946 - DNA, 601 bp, Human
aggatgctgggtggtcttctgggactgaaaacaggatgctagggcccccgccacatatgcacctggtccggcagctgggaaaagcccagcccacagctgcagcccagagcatctcctctaatggaggcacccacccaggcctcccaggcactggatctcagccttggggcttcatcctccgggtggcaccaaaaggaaggggagttaagacacctccacaaccaacacagagctgaggtgaggagcgggtgccccggaagggaaaagccagaggcaggtgtgaggtcaaagcaagcctggyactcactggcttctcaatgaggtcgatgcagggctgcaggtcgaggccaaagtcgatgaagttccactcgatgccctcgcgctggtactcctcctgctccaggatgaacatggtgtggttgaagagctgctgcagcttctcattggtgtaattgatgcacagctgctcaaacgagttcagctgcaaggagagaaaacaatgtcagagagacgccaaccctgcactaaagaggcccagacaccccttgagaaggagggtggggcagggatacaggaagggcctccttgggcacctccatgc

SEQ ID NO: 175947 - DNA, 601 bp, Human
gcactcaatgcccagggtctgcactgttccatgctacagtgaaagcagcccgcgatagggccttactacatccatgcatggctgtttctttaagacaaagaaatgcttatcgagcccagccttcaggaggatgctgggtggtcttctgggactgaaaacaggatgctagggcccccgccacatatgcacctggtccggcagctgggaaaagcccagcccacagctgcagcccagagcatctcctctaatggaggcacccacccaggcctcccaggcactggatctcagccttggggcttcrtcctccgggtggcaccaaaaggaaggggagttaagacacctccacaaccaacacagagctgaggtgaggagcgggtgccccggaagggaaaagccagaggcaggtgtgaggtcaaagcaagcctggtactcactggcttctcaatgaggtcgatgcagggctgcaggtcgaggccaaagtcgatgaagttccactcgatgccctcgcgctggtactcctcctgctccaggatgaacatggtgtggttgaagagctgctgcagcttctcattggtgtaattgatgcacagctgctcaaacg

SEQ ID NO: 175948 - DNA, 601 bp, Human
ctgggcagagcactcaatgcccagggtctgcactgttccatgctacagtgaaagcagcccgcgatagggccttactacatccatgcatggctgtttctttaagacaaagaaatgcttatcgagcccagccttcaggaggatgctgggtggtcttctgggactgaaaacaggatgctagggcccccgccacatatgcacctggtccggcagctgggaaaagcccagcccacagctgcagcccagagcatctcctctaatggaggcacccacccaggcctcccaggcactggatctcagcctyggggcttcatcctccgggtggcaccaaaaggaaggggagttaagacacctccacaaccaacacagagctgaggtgaggagcgggtgccccggaagggaaaagccagaggcaggtgtgaggtcaaagcaagcctggtactcactggcttctcaatgaggtcgatgcagggctgcaggtcgaggccaaagtcgatgaagttccactcgatgccctcgcgctggtactcctcctgctccaggatgaacatggtgtggttgaagagctgctgcagcttctcattggtgtaattgatgcacagct

SEQ ID NO: 175949 - DNA, 601 bp, Human
acctgggcagagcactcaatgcccagggtctgcactgttccatgctacagtgaaagcagcccgcgatagggccttactacatccatgcatggctgtttctttaagacaaagaaatgcttatcgagcccagccttcaggaggatgctgggtggtcttctgggactgaaaacaggatgctagggcccccgccacatatgcacctggtccggcagctgggaaaagcccagcccacagctgcagcccagagcatctcctctaatggaggcacccacccaggcctcccaggcactggatctcagcyttggggcttcatcctccgggtggcaccaaaaggaaggggagttaagacacctccacaaccaacacagagctgaggtgaggagcgggtgccccggaagggaaaagccagaggcaggtgtgaggtcaaagcaagcctggtactcactggcttctcaatgaggtcgatgcagggctgcaggtcgaggccaaagtcgatgaagttccactcgatgccctcgcgctggtactcctcctgctccaggatgaacatggtgtggttgaagagctgctgcagcttctcattggtgtaattgatgcacag

SEQ ID NO: 175950 - DNA, 601 bp, Human
cccggaaggcggagcttgcagtgagccaagatcaggccactgcactccagcctgggcgacagagcgagactccgtctcaaaaaaaaaaaaaaaaaaaaaaagaagaaaacccagacacaggaacagctcaggcttcattacagatcataccctcaacaagcctaaaacacaaacaggcgacccaacctctacctggcaagaggtttaagtatgaactcattggaaagggttcctcttttccatcttcacacagctaatgctggcgataaaagcactgctgcttgctggttttatgggggggatgagctgagctttggtacgtgtacacctgggcagagcactcaatgcccagggtctgcactgttccatgctacagtgaaagcagcccgcgatagggccttactacatccatgcatggctgtttctttaagacaaagaaatgcttatcgagcccagccttcaggaggatgctgggtggtcttctgggactgaaaacaggatgctagggcccccgccacatatgcacctggtccggcagctgggaaaagcccagcccacagctgcagcccagagcatctcctctaatggaggcacccaccca

SEQ ID NO: 175951 - DNA, 601 bp, Human
ggccgaggagggcaaatcatgaggtcaggagattgagaccacggtgaaactccgcctccactaaaaatacaaaaaaattagctgggcgtggtggcgggcgcctgtagtcccagctactcaggaggctgaggcaggagaatggcatgaacccggaaggcggagcttgcagtgagccaagatcaggccactgcactccagcctgggcgacagagcgagactccgtctcaaaaaaaaaaaaaaaaaaaaaaagaagaaaacccagacacaggaacagctcaggcttcattacagatcatacccycaacaagcctaaaacacaaacaggcgacccaacctctacctggcaagaggtttaagtatgaactcattggaaagggttcctcttttccatcttcacacagctaatgctggcgataaaagcactgctgcttgctggttttatgggggggatgagctgagctttggtacgtgtacacctgggcagagcactcaatgcccagggtctgcactgttccatgctacagtgaaagcagcccgcgatagggccttactacatccatgcatggctgtttctttaagacaaagaaatgcttatcgagcc

SEQ ID NO: 175952 - DNA, 601 bp, Human
tcaattaaccataatcaaaagaaaacccagagacaggccaggcgcggtggctcacacctgtaatcccagtactttgggaggccgaggagggcaaatcatgaggtcaggagattgagaccacggtgaaactccgcctccactaaaaatacaaaaaaattagctgggcgtggtggcgggcgcctgtagtcccagctactcaggaggctgaggcaggagaatggcatgaacccggaaggcggagcttgcagtgagccaagatcaggccactgcactccagcctgggcgacagagcgagactccrtctcaaaaaaaaaaaaaaaaaaaaaaagaagaaaacccagacacaggaacagctcaggcttcattacagatcataccctcaacaagcctaaaacacaaacaggcgacccaacctctacctggcaagaggtttaagtatgaactcattggaaagggttcctcttttccatcttcacacagctaatgctggcgataaaagcactgctgcttgctggttttatgggggggatgagctgagctttggtacgtgtacacctgggcagagcactcaatgcccagggtctgcactgttccatgctac

SEQ ID NO: 175953 - DNA, 601 bp, Human
cagtgagccgagagcacgccattgcactccagcctgggcgacaagagcaaaactctgtctcaaaaaaaaaaaaggaaatttttttcaaactgaaaaaactttgtcctaggccttctgatcaattaaccataatcaaaagaaaacccagagacaggccaggcgcggtggctcacacctgtaatcccagtactttgggaggccgaggagggcaaatcatgaggtcaggagattgagaccacggtgaaactccgcctccactaaaaatacaaaaaaattagctgggcgtggtggcgggcgcctrtagtcccagctactcaggaggctgaggcaggagaatggcatgaacccggaaggcggagcttgcagtgagccaagatcaggccactgcactccagcctgggcgacagagcgagactccgtctcaaaaaaaaaaaaaaaaaaaaaaagaagaaaacccagacacaggaacagctcaggcttcattacagatcataccctcaacaagcctaaaacacaaacaggcgacccaacctctacctggcaagaggtttaagtatgaactcattggaaagggttcctcttttccatcttcacacagcta

SEQ ID NO: 175954 - DNA, 601 bp, Human
aagctcattacaaaagtaaatttttggccaggcgcggtggctcacgcctgtaatcccagcactttgggaggccgaggcgggcggatcacctaaggtcaggagctcgagaccagcctggccaacgtggtgaaactccgtctctactaataatacaaaaataagcctgtaatcccagccactcaggaggctgaggcaggagaatcgcttcaaacagggaggcaaaggttgcagtgagccgagagcacgccattgcactccagcctgggcgacaagagcaaaactctgtctcaaaaaaaaaaaaggaaatttttttcaaactgaaaaaactttgtcctaggccttctgatcaattaaccataatcaaaagaaaacccagagacaggccaggcgcggtggctcacacctgtaatcccagtactttgggaggccgaggagggcaaatcatgaggtcaggagattgagaccacggtgaaactccgcctccactaaaaatacaaaaaaattagctgggcgtggtggcgggcgcctgtagtcccagctactcaggaggctgaggcaggagaatggcatgaacccggaaggcggagcttgcagtgagcca

SEQ ID NO: 175955 - DNA, 601 bp, Human
tggaaaattcaactgattaaagaaaaaagctcattacaaaagtaaatttttggccaggcgcggtggctcacgcctgtaatcccagcactttgggaggccgaggcgggcggatcacctaaggtcaggagctcgagaccagcctggccaacgtggtgaaactccgtctctactaataatacaaaaataagcctgtaatcccagccactcaggaggctgaggcaggagaatcgcttcaaacagggaggcaaaggttgcagtgagccgagagcacgccattgcactccagcctgggcgacaagarcaaaactctgtctcaaaaaaaaaaaaggaaatttttttcaaactgaaaaaactttgtcctaggccttctgatcaattaaccataatcaaaagaaaacccagagacaggccaggcgcggtggctcacacctgtaatcccagtactttgggaggccgaggagggcaaatcatgaggtcaggagattgagaccacggtgaaactccgcctccactaaaaatacaaaaaaattagctgggcgtggtggcgggcgcctgtagtcccagctactcaggaggctgaggcaggagaatggcatgaacc

SEQ ID NO: 175956 - DNA, 601 bp, Human
gatgagatgggatatgtaggaggagccccttgaggaagatagtcccagggacccagcagccttctgcacactgagtttacaagacaagaaagcaggtttggacactgcagagaggctgacaaaacttgaagcccagtgggttcctattagttggaaaattcaactgattaaagaaaaaagctcattacaaaagtaaatttttggccaggcgcggtggctcacgcctgtaatcccagcactttgggaggccgaggcgggcggatcacctaaggtcaggagctcgagaccagcctggccaacrtggtgaaactccgtctctactaataatacaaaaataagcctgtaatcccagccactcaggaggctgaggcaggagaatcgcttcaaacagggaggcaaaggttgcagtgagccgagagcacgccattgcactccagcctgggcgacaagagcaaaactctgtctcaaaaaaaaaaaaggaaatttttttcaaactgaaaaaactttgtcctaggccttctgatcaattaaccataatcaaaagaaaacccagagacaggccaggcgcggtggctcacacctgtaatcccagtactttggg

SEQ ID NO: 175957 - DNA, 601 bp, Human
gctcccctcagtatgcaagcgaatgcacgctgctgcatcccaggggtgctcccctcagcatgcaggcgaatgcatgttgctgtttatcatgaggtaggtgatgccagtttcctttccccaggctcagaccctcccacccaggccaacatccttgtccttttagcggccacagcacagcccacggaaagacgcaccacagttgatgccatcgtgcaggccccttggtgggctttagggtattcctaattattcagcattacaaataatcccacagcaaaagccttcctggaagcttctgcamtgatgagcgtgtgcgtttcccaaaggtgagagtggagaaaggaggctcgggaaacattccttggttaatggtgtaaatcgcttttttggctttattatttttttcatgggtagtttaagacagttgcttccgcagccccaggaaccagccaagctaaatagaagaggccggcacaggtgtgctagaaccgggcctggactccttgtggcttgggaacagacctgtgaaagctcccacatctcctcgccagtcatcaccaactagtcaccaccaacaaggagatggcgcagcccctgccta

SEQ ID NO: 175958 - DNA, 601 bp, Human
ataagacaagtaatttttgttttttctttgtctttttagaatgttcacattttctctgagtatgtgtcagtttcatctttttggaaatatattctgtttttaaatatatttttttaattgggcagcctcctaaactagagggttcagagagactcccagaaatagattccttttttctcattttaaatagagataggggctgggtgcggtggctcatgcctgtaatcccagcactttgggaggccaaggcgggtggatcacctgaggtcaggagttcgagaccagcctggccaacatggcraaaccccatctctattaaaaatacaaaaattagccgggcgtggtggcacgtgcctgtaatcccagctacagggctgtaatctcagcccctaggggggctgaggcaggaggatcgcttgaacctgggagacggaggttgcagtgagccgagatcgtgccactgtactctagcctgggcaacagaacaagactccgtctcaaaaaaaaaaaaaaaagatagagatagggtctcactatgttgcccaagctggtctcaaacgtctgggctcaaactgtcttcttgccttggcctccccaagtg

SEQ ID NO: 175959 - DNA, 601 bp, Human
cttgtcagaggactggtggagcagtgtggcgatgttgtcattcaggggatccatgttcttcatcagccactcgtcagctttgtaatccacctggcggggtcagagaggcaggagtcacaagctgcgctggggacatgtgtgctcacagggtctccggagcacaggctaaccccatgcgtggaaaagtcagaaaacgtgaagaccctttgatccagcatttccacccctaagaaggaagtggtgaggataaggggagcgaggcatcaagacgttctctgcggcgtctcgtgcagagccaaarcctcaaagcaaggcatggccaacaacgggagcctggctctagacatggcatggtggccacacagtaccgtgctgggtttcagcttttttaaaatttttaggtaatatgaacaaagaaaaacaatcctggaaggacaacaaaatgttactatttctttttagtcataagacaagtaatttttgttttttctttgtctttttagaatgttcacattttctctgagtatgtgtcagtttcatctttttggaaatatattctgtttttaaatatatttttttaattgggcagcctcctaaacta

SEQ ID NO: 175960 - DNA, 601 bp, Human
gtaccatccttccacagctccgagacaaacttgtcagaggactggtggagcagtgtggcgatgttgtcattcaggggatccatgttcttcatcagccactcgtcagctttgtaatccacctggcggggtcagagaggcaggagtcacaagctgcgctggggacatgtgtgctcacagggtctccggagcacaggctaaccccatgcgtggaaaagtcagaaaacgtgaagaccctttgatccagcatttccacccctaagaaggaagtggtgaggataaggggagcgaggcatcaagacgytctctgcggcgtctcgtgcagagccaaagcctcaaagcaaggcatggccaacaacgggagcctggctctagacatggcatggtggccacacagtaccgtgctgggtttcagcttttttaaaatttttaggtaatatgaacaaagaaaaacaatcctggaaggacaacaaaatgttactatttctttttagtcataagacaagtaatttttgttttttctttgtctttttagaatgttcacattttctctgagtatgtgtcagtttcatctttttggaaatatattctgtttttaaatata

SEQ ID NO: 175961 - DNA, 601 bp, Human
cgtaccatccttccacagctccgagacaaacttgtcagaggactggtggagcagtgtggcgatgttgtcattcaggggatccatgttcttcatcagccactcgtcagctttgtaatccacctggcggggtcagagaggcaggagtcacaagctgcgctggggacatgtgtgctcacagggtctccggagcacaggctaaccccatgcgtggaaaagtcagaaaacgtgaagaccctttgatccagcatttccacccctaagaaggaagtggtgaggataaggggagcgaggcatcaagacrttctctgcggcgtctcgtgcagagccaaagcctcaaagcaaggcatggccaacaacgggagcctggctctagacatggcatggtggccacacagtaccgtgctgggtttcagcttttttaaaatttttaggtaatatgaacaaagaaaaacaatcctggaaggacaacaaaatgttactatttctttttagtcataagacaagtaatttttgttttttctttgtctttttagaatgttcacattttctctgagtatgtgtcagtttcatctttttggaaatatattctgtttttaaatat

SEQ ID NO: 175962 - DNA, 601 bp, Human
gagacaccactcgggcggccagtcacctggttctaggtggagaataggaaagcgatgatagaaataggctctctgagtgctctgcatctctgcaacagagaggttaaagcaaaacccaggcaaaggaaaaggagaaaccaacagaaagaattaaaaagaaccactcaaagcaaccagcctaccaaggagtagaggcgggaatgcaacatggcgcggggctgggagcctgggcttcgaggctcggggctgcccttgactttcccacacacggaaagcgctccgcccaggaggacccggccayggtgtgtgcgcaagggcagtggcctcctgtttcggtccgaggagccctctctcatgggagctacagagggcagagaccacctggcctatgtcagggggcacatgtgtaccccttgtttggcagctcggcccactgtggaggtgggaagatgaccagccgcagccaagaggaggcagggggcgaagggcaaagggcgtaccatccttccacagctccgagacaaacttgtcagaggactggtggagcagtgtggcgatgttgtcattcaggggatccatgttcttcatcagccactcgtca

SEQ ID NO: 175963 - DNA, 601 bp, Human
gctttggacgcaccacacacacaagagacaccactcgggcggccagtcacctggttctaggtggagaataggaaagcgatgatagaaataggctctctgagtgctctgcatctctgcaacagagaggttaaagcaaaacccaggcaaaggaaaaggagaaaccaacagaaagaattaaaaagaaccactcaaagcaaccagcctaccaaggagtagaggcgggaatgcaacatggcgcggggctgggagcctgggcttcgaggctcggggctgcccttgactttcccacacacggaaagcrctccgcccaggaggacccggccacggtgtgtgcgcaagggcagtggcctcctgtttcggtccgaggagccctctctcatgggagctacagagggcagagaccacctggcctatgtcagggggcacatgtgtaccccttgtttggcagctcggcccactgtggaggtgggaagatgaccagccgcagccaagaggaggcagggggcgaagggcaaagggcgtaccatccttccacagctccgagacaaacttgtcagaggactggtggagcagtgtggcgatgttgtcattcaggggatcc

SEQ ID NO: 175964 - DNA, 601 bp, Human
ggcaggaaaagccaaggcaaggggggggcgcgagaaaacctaggcagaagcatttcttgcacagctttggacgcaccacacacacaagagacaccactcgggcggccagtcacctggttctaggtggagaataggaaagcgatgatagaaataggctctctgagtgctctgcatctctgcaacagagaggttaaagcaaaacccaggcaaaggaaaaggagaaaccaacagaaagaattaaaaagaaccactcaaagcaaccagcctaccaaggagtagaggcgggaatgcaacatggcgyggggctgggagcctgggcttcgaggctcggggctgcccttgactttcccacacacggaaagcgctccgcccaggaggacccggccacggtgtgtgcgcaagggcagtggcctcctgtttcggtccgaggagccctctctcatgggagctacagagggcagagaccacctggcctatgtcagggggcacatgtgtaccccttgtttggcagctcggcccactgtggaggtgggaagatgaccagccgcagccaagaggaggcagggggcgaagggcaaagggcgtaccatccttccacagc

SEQ ID NO: 175965 - DNA, 601 bp, Human
accctgttggggaagccctggcggcagatacggatgccctcgagaacaccgttgcagcgcagctggtccagcacgagatgcgggtccagcttgccggcctggagaagaaaacacatgcatgcggtctcacttccgtgcctagaacagtcggagaatagtcagggaacccctatgaacctgacagggcaagagcctaagggagggggtcgctacagcccacaggtttggacaatgaagtcaaaggatccaggtctgggaggggccaatgccaccaagaggaagtgcaggctgtgaatgtagygtatctcctaagcgagccaaggcccaccctgcagagaaacgactgaaggctctgtgcatgctggggggctggaggggtgcttttgctggggagacagacaagggctgagcaccccacaccacagtgccctgcccgggccaccccaccaggcagccgcaccttcttctcgtggttggggatgatgcagcggacaaagttggggttcgtgttcctcagcgtagccatcagcttggccagctgctccttgtaaagctgccccacagtgcggaacatgcccttccgcgtcttgaaggccccggg

SEQ ID NO: 175966 - DNA, 601 bp, Human
ggcaaatccaagcagagtcggcctcttcccacccatcactctaaaccccaatcagaaatgccagattcagccaggagcagtggctcatgcctgtaatcccagcactttgggaggctgaggtgggcggatcacttgaggtcaggagttcgagaccagcctgggcaacaatgacgaaaccccgtctctactaaaaatacaaaaattagctgggcgtggtggcgtgcacctgtaacctcagctactaagtgaggctgaggcaggagaatcacttgaacgtgggaggtggaggttgcagtgagcygagaacgcgccacagcactccagcctgggcgacagagtgagactccgtctcaaaaaaaaaaaaaaaaaaagaaaaaaaaaagaactgcccgattctactcctcaaaggtagaaatccaggaacaggggtaggaagagccacctgggcctccctgacaggcatgtgactggctgcagcggggtggcctgctaagtgccctttggcaacagaagggcgtggcaaggcctggcatgcggggcaggagtatctcccgggactcacttcctggccaggtagcccctgcagcaggcctggaaccct

SEQ ID NO: 175967 - DNA, 601 bp, Human
acagatcctactcagtgtggggactgagcgtgacccttggtgattaagccgactggccctgggtgactctggacttcagcttcccacccttcgtgctgttccctatctgagcttttgtttggtgggagaacgtcagaagctgatgtactgtgaaggtgggctgcaggtgtcagctggagggcttttggataaacaagcctccatctgtgcaaatgctcaagcttcgtctcccagagctcggcgctcctgctaggaccccatccccgagcacaaggggacgagtgtgcagtgcccacagccrctgtcctgcagcaggggagccgtcattccccagggagtcaaagatgagtctggactcgaggatggcctgctcccctggaatcacagggttctttagggacaggcaggctctgggtgctgtccccacaagggtcacacggtaaggagtcctggtaagcaggatccttcaggcaggcaaatccaagcagagtcggcctcttcccacccatcactctaaaccccaatcagaaatgccagattcagccaggagcagtggctcatgcctgtaatcccagcactttgggaggctgaggtgggcgga

SEQ ID NO: 175968 - DNA, 601 bp, Human
gctgccgcccagggacagtggaggaagagtaccccgtatctcaacacagagccaccaaggtgtccccaaccccacagtgaccaacacttgcaatgctgcacagatggccacctttacacaggctcgggtctcacggctggcaaagaagagctttctagaggggaaaggacaaacccttccccagggcccctttgcttatgaggaaatccctcaactaaggcccatgggacctccagggagcacttgcagttaagcagaagccctcatgctgcaggcagaagagacaggaagcagcagcagyggggagccaggccctgcaagggtgaccacactctcccatccacggcgcccctggagcagcggcaggcgacagccacgggcctcaccttggccagcttgcagttctggtcctccaggatgatctgctcctcctccagctttttcagcttcgcctcggtggtcaccttctccagctgcagcttctgccgggcgctctcctcctcctccagctgctcctcaagctcctgccgggggccagagacacggtaaggacagcaggcccagaggcatggccaaggtgaaggcagcaaggtccgaaggc

SEQ ID NO: 175969 - DNA, 601 bp, Human
cagcctttggggctcccatgttctgaggaggcccgaaaggtggggaggctgccttctcctgccttctcctctaactggttccccggctgctatctgctccctgggcagacaccgacagggacccaactcattctcaagaggaatagctgccgcccagggacagtggaggaagagtaccccgtatctcaacacagagccaccaaggtgtccccaaccccacagtgaccaacacttgcaatgctgcacagatggccacctttacacaggctcgggtctcacggctggcaaagaagagctttcyagaggggaaaggacaaacccttccccagggcccctttgcttatgaggaaatccctcaactaaggcccatgggacctccagggagcacttgcagttaagcagaagccctcatgctgcaggcagaagagacaggaagcagcagcagcggggagccaggccctgcaagggtgaccacactctcccatccacggcgcccctggagcagcggcaggcgacagccacgggcctcaccttggccagcttgcagttctggtcctccaggatgatctgctcctcctccagctttttcagcttcgcctcg

SEQ ID NO: 175970 - DNA, 601 bp, Human
agcacagaacacttgctagcctcaaagcatgactcgcccggaaatttggggctgaatggagagggctttagacgcttgatcaagttcattaggattttcctagatcaaaggataatttttaaaggtcacgagctcccctgaaacagcgaggtacgcttccttagaaccaaaaaatgtgggtgcccaagcccttccccttcccctgtgggcttgggtgagaaaggattccaggtgacagctagtgtcagcagggacagatggctccactccttcaagaggctgccacacggcgctcacctgygccaccaggccaccttctccgtgcccctctctcacctgccaggtgggccacggcccctccccctcttcagccccgcggtgccccgggctgctctccttgctttctgttctgtgtggcccctgcaacacccctgcccagcggccacagctcggcacaagcacctgagtcccctcatcccagtcccgggtgggcgtcctgccacctcagcctccccagcctttggggctcccatgttctgaggaggcccgaaaggtggggaggctgccttctcctgccttctcctctaactggttccccggc

SEQ ID NO: 175971 - DNA, 601 bp, Human
tgctcgtcaccccctcaccttccaagtcagtgatcattgcctcatgcttgttcttgagcttggcgaggctcttagatttctcctcctcttctgtgaggttggtggtgaactcagctattctgtcttccagcagtttcttttcctggggagaggggagtaggctggcatttagtgttggttgagcacagaacacttgctagcctcaaagcatgactcgcccggaaatttggggctgaatggagagggctttagacgcttgatcaagttcattaggattttcctagatcaaaggataattttkaaaggtcacgagctcccctgaaacagcgaggtacgcttccttagaaccaaaaaatgtgggtgcccaagcccttccccttcccctgtgggcttgggtgagaaaggattccaggtgacagctagtgtcagcagggacagatggctccactccttcaagaggctgccacacggcgctcacctgtgccaccaggccaccttctccgtgcccctctctcacctgccaggtgggccacggcccctccccctcttcagccccgcggtgccccgggctgctctccttgctttctgttctgtgtggccc

SEQ ID NO: 175972 - DNA, 601 bp, Human
actcgttatgaaacgtgtgtcaggcttaaagcatcacaaacacacagacactcgcacccaactcctggatgcaggaagaggacatcactgcaaactgctagcccctggcatgtctctctccaactcaccccttgtccttccctgccaggaattaagtactctcctaaagctggtgtttgtaattcccttggttcccttgaaggctgtaccatgtctgtatctctaaaaaacatgttcaattgtgtgtgaatctgaacttatataatggaactgccttgtgtgaattccacagttggaatcrcacggtcagggctctatgtctagctttataactctgtgatgtcacttgggaaagctactttctatacctcatctgaataataagcaaaaggagacagcctacttcattaggatgctgtgaggcgccaatgagttactatcttaaaaagcacctagaacagtgcctgcctcgtgatggttattccctgccgtgcctttgccaccccatcacatgatcttgagatgtagcccgtgaagtttcgctggaatagatgtgtaaggacatttgtctaggattccattatgagaatacaccacaact

SEQ ID NO: 175973 - DNA, 601 bp, Human
cagactccaggtcttcctggagttcagagatctgagattccagctcccggatcttcttgagggccatgttcttctgggcagcttcctcttccactctgccaaagcgaccagcaacatcagtataaggagagtttcacctccaaggagcagagtttgcaggacaggcctgagagagctgcagcagccaaagctgcctcctgtggtcacaatcatggcacttaggatggctctcagcagaaacaacatctgagacaaccagattgaagggcaacacccctctgagaagcagaaaacctcataraggaatcgtttcaatttccaaagtaagattcactgcttcaaatatttttaaaagtcaaatgatgtgttaaatgggaagaaaaggaaataaaacgctacaccacaggacaactgcaactcagtaaaaatacgaatgtgctacggactttagatggttatgacaggtcaacgtaggttcaccaattagaacagacacagcactgtggtaggggatgttgactgcaggggaggcggtgcgtgagtggggcagcggatagatggagaatcttctgctgactcttctgtgaatctaaaactactc

SEQ ID NO: 175974 - DNA, 601 bp, Human
cgaggctgtccctggggctcttccctgaccaaagagaggcctggccagggcacaggcactccaggcagcttttctacccaccggcccctcctagccatctatcccatagcccaggctcaaatacgccctgtgagagcttctgtagcctttcagctttaaagcccagccttgcctcacccccaactttgagccaggtccttcaacagactttctactctgtagagagaaaccgctgaggaaccagcagcttccatgcctgctggtgcctaagagggccacggtgtgtgtgtgtgtgtgtgttcagaggcccggggtccatgtctccaagccaaggcccccctggctgccctccccatcccgagggacttggtcccagggcacacctgagctcctgctgggcagctgtggaatccagcgtgtcctccaactctgttttcagcgcctctagctcttccccaaggtcccgtttctgcttctcagctttattcctggaagcacgctcagactccaggtcttcctggagttcagagatctgagattccagctcccggatcttcttgagggccatgttcttctgggcagcttcctcttccactctgcc

SEQ ID NO: 175975 - DNA, 601 bp, Human
cctgcagctgggactccagcgcggagaagtccttggtgagcttgctggacttgctgtcggactggctgagaagcccggtcacgttgtccagctccacctgcaccgggcggggagacacaaaggaccatggacccacccccactgctcctgccccacctcatctcctttaggtaaagctggacctgagtcacaagctgaaccatgagggtctgacgagccagtttgagaagagagagagacagagagcacacatgcacctggggacctgggccacaactgctgctagggcccactgcccgcrccagggtcctggcggaggcctcacctgcagcttggtgaccttgtcggccagctctgtgcgcacgcgctctccctcgttgaacttgacctgcagctcctgcagctgcgcctccactttcttgcgcttgtgctccgagtcccctttgccctgcagcagcaccttcacctcgttggccagctccccccgctcgttctccagagtctgctttgccttctcgaggtttgctttcacctagcagggaagaaagcaaagacgtgagtgggggcctcctgacacaaggctggctggtctatcatcact

SEQ ID NO: 175976 - DNA, 601 bp, Human
tgctgtgtccactcagggttaaatggattaagggcggtgcaagatgtgctttgttaaacagatgcttgaaggcagcatgctcttaagagtcatcaccactccctaatctcaagtacccagggacacaaacactgcggaaggccaaagggtcctctgcctaggaaaaccggagacctttgttcacttgtttatctgctgaccttccctccactattgtcctatgaccctgccaaatccccctctgcgagaaacacccaagaatgatcaataaaaaaattaaaaaaaaaaaaaaaaaaaaaaagacagtcaaaccagttcattagagaaaatctgaaaaatgtaaaaaatcagaaaggaaaagtcactcctcaacccatcgcatgaagacgccctcttccgctggccttctccctgggaccctcaacaagccagagcctgagggtcctctaagcactggccccgcacggcccctccccggcgagaccctgagggagcccaggctttctctgatgggccctttgctttggactcagtgcttgaaggagaggaaatgcaaaggatggggccaacggccacacacctggtcaaacttcttctgctt

SEQ ID NO: 175977 - DNA, 601 bp, Human
ttcctctcgtcctccagctctgcctccatctcccgcacctgggggaaggaacatcaacaacttgggaagctggacccactgggagaccctgccctagctctgaactcaggagcctcaggccagttctgcaggatccatggggcctcgggaaaccagtggggattactgaccataagaactctaagaaagtgagtcactgaaccccgagacaggaggctagaaagaaggaatatgggaggggaggcgtggtcaaggggccctaacacaatccaggtggaaggagagaacagaagcctgcgtraagccaaggcagccttgggcacccatggggtagcaggaggccatgcacacctgtctgaccagctgcttcttcttctcctcgctctgctcgtcccggccctgcaggtcccgctcgaactgggccttcatggcctgcaggttgacctccaaccgcagcttggcatcttcggtggcctgcagctcgtcctccagctcttccagctgcgtcttcatctcctccacctgctgctctagggcccgcttggacttctccagctcgtggacctgagccccagagagcccaagtcaggagcaaagggac

SEQ ID NO: 175978 - DNA, 601 bp, Human
ttctgtgttttatgtacccagtcatacaccgtttcgcaagtttgctgttggactatcatgtttccactcacctctgagcctctgagtctctgtcagtgagatggggctggaagcacccaggaccttcccaggaggtgccaccctgccaggttcccgccctgggccgagccctggcaccttcatatgtagttggctcagtcgggtgccgcccaccctcacctgggccccgcccacccttacctgcagcttccgcagctgtttgatggcttcgtcccggttcttgttggccgagtcgacgtgmgcctccaggtccttcaggtccatctccagcttcttccgggcggccactgccatcgagcgctgcttcctctcgtcctccagctctgcctccatctcccgcacctgggggaaggaacatcaacaacttgggaagctggacccactgggagaccctgccctagctctgaactcaggagcctcaggccagttctgcaggatccatggggcctcgggaaaccagtggggattactgaccataagaactctaagaaagtgagtcactgaaccccgagacaggaggctagaaagaaggaatatggga

SEQ ID NO: 175979 - DNA, 601 bp, Human
ttgcttctgtgttttatgtacccagtcatacaccgtttcgcaagtttgctgttggactatcatgtttccactcacctctgagcctctgagtctctgtcagtgagatggggctggaagcacccaggaccttcccaggaggtgccaccctgccaggttcccgccctgggccgagccctggcaccttcatatgtagttggctcagtcgggtgccgcccaccctcacctgggccccgcccacccttacctgcagcttccgcagctgtttgatggcttcgtcccggttcttgttggccgagtcgaygtgagcctccaggtccttcaggtccatctccagcttcttccgggcggccactgccatcgagcgctgcttcctctcgtcctccagctctgcctccatctcccgcacctgggggaaggaacatcaacaacttgggaagctggacccactgggagaccctgccctagctctgaactcaggagcctcaggccagttctgcaggatccatggggcctcgggaaaccagtggggattactgaccataagaactctaagaaagtgagtcactgaaccccgagacaggaggctagaaagaaggaatat

SEQ ID NO: 175980 - DNA, 601 bp, Human
cccatgtctaggcttgtacttgtttgcttctgtgttttatgtacccagtcatacaccgtttcgcaagtttgctgttggactatcatgtttccactcacctctgagcctctgagtctctgtcagtgagatggggctggaagcacccaggaccttcccaggaggtgccaccctgccaggttcccgccctgggccgagccctggcaccttcatatgtagttggctcagtcgggtgccgcccaccctcacctgggccccgcccacccttacctgcagcttccgcagctgtttgatggcttcgtcycggttcttgttggccgagtcgacgtgagcctccaggtccttcaggtccatctccagcttcttccgggcggccactgccatcgagcgctgcttcctctcgtcctccagctctgcctccatctcccgcacctgggggaaggaacatcaacaacttgggaagctggacccactgggagaccctgccctagctctgaactcaggagcctcaggccagttctgcaggatccatggggcctcgggaaaccagtggggattactgaccataagaactctaagaaagtgagtcactgaaccccgagac

SEQ ID NO: 175981 - DNA, 601 bp, Human
acctttccttttgttattctcctgttacttcttttaacactaaagacctttgtcaaatagcctttttttccttttgcagataaatccgaaattgagattccccaaatcaaagagagtgactggctgtgtgcagcccgaccacaccagtaaaaaaatgccaccagcaatcagagcatctatgcccacaaccttgaccacaatgaagttttaaagtttttgtgggttttttttttacacttaacattttttttttggccgggcgcagtggctcatgcttgtaatcccagcactttgggaggcygaggcgggtggatcacaaggtcaggagattgagaccatcctggctaacatggtgaaaccccgtctctactaaaaatacaaaaattagccgggcgtggcggcgtgcgcctgtagtcccagctgctggggaggctgaggcaggagaatggcgtgaacccgggaggcggagcttgcagcaagccgagatcatgccactgcactccagcctgagcgacagagcgagactccgtctcaaacaaacaaacaaaaaaaaatttgttaaactaaggttattcttgttacatgatatggcgtatcagag

SEQ ID NO: 175982 - DNA, 601 bp, Human
gcaccctccagacctgggaaacacttcaggacgggctcaggtgcgacgggcagggcggccgaggggacgctcagaccccttctcaccaggcagcattcacagcaggaggtggtggtggccacaaagcctcatctcatgtgagggatgccagtttcacacacacacacactctgatcatacgagggagccccgctatgaaacggaaccctggagggaatccttatgtaacctgagagccatccccagccaattcctggagcccagtaggactccagccctgtcctcagctgaaagccccacrctgccacctgctggccgcagggcagcggtgccgctctccattgcagccccacccacctcctgcaactggatcatctcggcctccatgctcttcagcttcttctcgttctctttggcctgggccaggatctcctcacgagaggcgcgggtgtcatccagctcgcgcatgcagtccttcatctgggcctggggtggggacagaggcttggcaccccacccagctccttggccctccaccccaaccctcatgggtcacctcgccaacagggctcatggctggtgctccactcaatgctgtatt

SEQ ID NO: 175983 - DNA, 601 bp, Human
ggcattgctcatgaggctcacattcgttttgcagatatttaactgaggcacctaacatgtgccaggactgggccaggtggcctcaagcaacttccaattcaaaagacaatagacttttaggacagctgggaataaactacctagagtttactgtgtgttcaaaacactaagctaaagcctcaaaggcaaggagccagaaggggcagggattgctttgtgcagtcctttcttggtgacattcgtgccttgcttgtgggctctggttgaggaacaagctaccttttgagagaagtgccgaggmaaaggggcgggtgggcagggcggctcacctgagcttgttctttagggagctgacttcgcggttcatggcatcggccgtctcagtggcgtcctccagctcgcgctgcagtttccggcgggaggcgttggcccgctgggcctcctcttcggcctcctccagctgccgcttgagctgcttcaggcgggtagatgccttgtcggcctgcggagatggacgtgtggcccgtggccccggttaggggctctgggcgtgcagccagtcagccccactgccctgcctgtcaccccatctgctgcccag

SEQ ID NO: 175984 - DNA, 601 bp, Human
ttgagaccagcctgaccaacatggtaaaaccccgtctccactaaaaatacaaaaattagccgggcatagtggtgcatgcctgtaatcccagctactccaggggctgagggaggagaatcgcttgaacccgggaggcagaggttgcagcaagctgagattacaccattgcactccagtctgggcaacaagagcgaaactccgtctcaaaaaaaaaaaacaaaaaaaataaaaaaaacacgtaaacacataagaaaaaaacatgtaagaaatgagaatctcaaaaaacacaaaatgagagtctcaaaaaacccacaaaaaaacacgtaagaaatgagaatctcagagaataagatcctctgcttcaaacattcactacttcttgagtgttaacactccctgagaaacgcaaaggagcgtttttaacctctgtaggcattgctcatgaggctcacattcgttttgcagatatttaactgaggcacctaacatgtgccaggactgggccaggtggcctcaagcaacttccaattcaaaagacaatagacttttaggacagctgggaataaactacctagagtttactgtgtgttcaaaacactaa

SEQ ID NO: 175985 - DNA, 601 bp, Human
ctttctaccacatggcagaaaattcatatacaatactgactacttatgcttacaaaaagagccccatgaaggcctggcacggtggctcatccttgtaatctcagctctctgggaggccgaggcgggtggagcacctgaggtcaggagtttgagaccagcctgaccaacatggtaaaaccccgtctccactaaaaatacaaaaattagccgggcatagtggtgcatgcctgtaatcccagctactccaggggctgagggaggagaatcgcttgaacccgggaggcagaggttgcagcaagcygagattacaccattgcactccagtctgggcaacaagagcgaaactccgtctcaaaaaaaaaaaacaaaaaaaataaaaaaaacacgtaaacacataagaaaaaaacatgtaagaaatgagaatctcaaaaaacacaaaatgagagtctcaaaaaacccacaaaaaaacacgtaagaaatgagaatctcagagaataagatcctctgcttcaaacattcactacttcttgagtgttaacactccctgagaaacgcaaaggagcgtttttaacctctgtaggcattgctcatgaggctcaca

SEQ ID NO: 175986 - DNA, 601 bp, Human
cctcttcgtcggagccatccccggcgcctttccgggccattcggcggggcacgacaaacggcaggtccccgcgcctgggggcagaggtagaagcagagggtcagcgggcccggccaggccaggggcggccacagcacagcccacacatctcaaagtgaattcgagagggaaaccaggtgcctggctgctcccaccagaaagaagcaaagtggagtcttgggagccacagctgagctagacaggaccactctcaggaaagcaggcaaagcttcccgcaaaatgtttaggtgtcggacatctycacacacaacagtagcacaaaaacagctcaggcaaacaggaccaattacaacaggaaaggcacaaaagtaagtgtaaaatgccatcctctgttgcaactcctataaaaccggtgaaaccaagacaggtaaacaggtgtgcctgttcacacagagtacaaagacaggcaccctctttctaccacatggcagaaaattcatatacaatactgactacttatgcttacaaaaagagccccatgaaggcctggcacggtggctcatccttgtaatctcagctctctgggaggccgaggcgggtg

SEQ ID NO: 175987 - DNA, 601 bp, Human
catggacccaggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcrgggggggggcgggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtacc

SEQ ID NO: 175988 - DNA, 601 bp, Human
ggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcggggggggggsgggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataa

SEQ ID NO: 175989 - DNA, 601 bp, Human
gaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcggggggggggcgggagtgtggggagagcagggtccaggaggagaggagggctgggagaggaggttgaccagcagccccgacctgtcacctcccgctctgctccaagctgaccytggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggttcccatcccc

SEQ ID NO: 175990 - DNA, 601 bp, Human
aagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggtwcccatcccctctactggtcccctgttgattccaggtggaagccaccccgtccccccccagctgtgttagggcacccgccctgccctgcccatcacaagcacctgcttaccagggatgactgcctcaggcaggggctgagttcagtcatctaaaatacccccggtcaaagaaaaatctgaggcccaatagaattttaaagagttaattgagtaagaaaggattgctgaattgggaaacagcaaactggaggaggcttcgtgctatggtgaaaaagtgtcggagacaaggtttatcgggtga

SEQ ID NO: 175991 - DNA, 601 bp, Human
ttgcagtttcagggggttacagctgttctaaaggcctcgtaggtattgtctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgccayggcaaccaagtcagctctgctcaggagccgccctggacagcaaactgggctgtgctgagtcctgtccaagacgaggggagggcagggaagattagaagccgagagcactcagccgaccccggaatccttacgaagggctgggctgggggactgaggaaaaactctccccccaaaacaagatgatctgtggtttaataacaggcccagctgggtccagaggtgacagtggagagccgtgtaccctgagaccagcctgcagaggacagaggcaacatggaggtgcctcaaggatcagtgctg

SEQ ID NO: 175992 - DNA, 601 bp, Human
gaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcwtctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatc

SEQ ID NO: 175993 - DNA, 601 bp, Human
tatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcragacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttc

SEQ ID NO: 175994 - DNA, 601 bp, Human
gtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccmcaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaa

SEQ ID NO: 175995 - DNA, 601 bp, Human
tgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatcccccmaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaat

SEQ ID NO: 175996 - DNA, 601 bp, Human
atgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataa

SEQ ID NO: 175997 - DNA, 601 bp, Human
agtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcaygtggcagatggaagtgatcactgggatgtttccacttccttggcctggaaggctcacttcatgttggtgctgagctgaaaaggattcattcctctccaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctca

SEQ ID NO: 175998 - DNA, 601 bp, Human
ttccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcatgtggcagatggaagtgatcactgggatgtttccacttccttggcctggaaggctcacttcatgttggtgctgagctgaaaaggattcattcctctscaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaatt

SEQ ID NO: 175999 - DNA, 601 bp, Human
gcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaagsccagatctccaaatgtagtcacctgagtttaaagcttcagcgtatgaattttgggggcacacaattccctctatagcactaatgactccataaaacaagtcccacatcacagctgtccaggaaaattaacatgtagtcatctcttatgcaatggctgttatgcgctcccacactttcctccaaccttatcctttcttctttccaactagagagcagtatctttattgaggatgccattaagtatttcaaggaaaaagtgagcacacagaatctgctactcctgctgactgataatgaggc

SEQ ID NO: 176000 - DNA, 601 bp, Human
aatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcrtatgaattttgggggcacacaattccctctatagcactaatgactccataaaacaagtcccacatcacagctgtccaggaaaattaacatgtagtcatctcttatgcaatggctgttatgcgctcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagc

SEQ ID NO: 176001 - DNA, 601 bp, Human
tggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcgtatgaattttgggggcacacaattccctctatagcactaatgactccataaaacaagtcccacatcacagctgtccaggaaaattaacatgtagtcatctcttatgcaatggctgttatgcrctcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttc

SEQ ID NO: 176002 - DNA, 601 bp, Human
gtcttcttgtgtccctttctgttcttacaataggacactagccctctaatagaattagagccctacccttgtgatctcattcagtcttaattgcttccttaaaggccagatctccaaatgtagtcacctgagtttaaagcttcagcgtatgaattttgggggcacacaattccctctatagcactaatgactccataaaacaagtcccacatcacagctgtccaggaaaattaacatgtagtcatctcttatgcaatggctgttatgcgctcccacactttcctccaaccttatcctttcktctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttcttggcactccaggaagaatatttcctccatgt

SEQ ID NO: 176003 - DNA, 601 bp, Human
gcacacaattccctctatagcactaatgactccataaaacaagtcccacatcacagctgtccaggaaaattaacatgtagtcatctcttatgcaatggctgttatgcgctcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttaccyccattgggcactccggcgatgccacccagctctcccctgggctagttttccctgacaggcacacctcctccaggcagccccctctgctgggcttgaggatgaccttcttggcactccaggaagaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattgtgagaaaaatgagatcgtgc

SEQ ID NO: 176004 - DNA, 601 bp, Human
gacaagcagtatgtcttagtgaccattttcatagtagaattagttgctgccaatttgtgtaatttcagggatactgagcagactcacaacttcccaaccaaggaggaaaacacttcctctaccatcttgtccaaattcaggtcttttcagcattagcaatttatataggtggttctgaaagtgttttgaatcttctagaggttccataaaattgcaaatggccttggtgtgcacacaggtgaagctgtcactactaaggcatcagttaggctggtgacacctgcgagtgagacctggaagkttgggggtgcaggtggtaggtcaggaggcagtaaggtggctggagcgtccatgtggagccagaatgaatagccagatctcccactccagtcagctggggcagtggccagaaccagtagccttcagccaggtgaaagggcatgaggcattggaagggagcagatgccaggcaaagtgaactcctgtctctccggggttttgtttttgtttgaattcaaagtactcagagatagccagactgcaatgtctgagggcacccttacctttgacaccacctgcaaatttaaggggatttctaaat

SEQ ID NO: 176005 - DNA, 601 bp, Human
gaccgggattaccagcagtaccatagactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagrgttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaact

SEQ ID NO: 176006 - DNA, 601 bp, Human; identical to SEQ ID NO: 26101

SEQ ID NO: 176007 - DNA, 601 bp, Human; identical to SEQ ID NO: 26102

SEQ ID NO: 176008 - DNA, 601 bp, Human; identical to SEQ ID NO: 26103

SEQ ID NO: 176009 - DNA, 601 bp, Human; identical to SEQ ID NO: 26104

SEQ ID NO: 176010 - DNA, 601 bp, Human; identical to SEQ ID NO: 26105

SEQ ID NO: 176011 - DNA, 601 bp, Human; identical to SEQ ID NO: 26106

SEQ ID NO: 176012 - DNA, 601 bp, Human
ttagctaacaaatacatatataacatttactctgtgccagacactgttctaggcactttacatattaacacatctaacccttgtaatcaccctgtaagaattatcattctattcagttcagagatgagaaaacagaggctcagagtagttatcaaattacgcaaggtcacacagctcgaaagtggtagggctgggatttgaacccagatagcctggggcccagaggccaaacacctacacacagttttctctgagaccagcagaaaagcctattatgggagcaaatggcagcttagtatgytgcaaacactcattcaggcctggttctaaatccccactccaccgctatgtcctagctctttcaactaggctaagcaccttcaaagtccatttgcccacctgcaaaatggagataattccggagaaaatcataagctaagagagatggcaatgtgggtgtgctccatgaatgccacacagagccaaatggagaaaggagtggacggtgggccactggtctctcacctgtgctgacattgaagcctgcaaagcaaggcagggccaggtattccctgtctgaattccccactgatttctggtt

SEQ ID NO: 176013 - DNA, 601 bp, Human
gggacctagttttaaaaaaattagctaacaaatacatatataacatttactctgtgccagacactgttctaggcactttacatattaacacatctaacccttgtaatcaccctgtaagaattatcattctattcagttcagagatgagaaaacagaggctcagagtagttatcaaattacgcaaggtcacacagctcgaaagtggtagggctgggatttgaacccagatagcctggggcccagaggccaaacacctacacacagttttctctgagaccagcagaaaagcctattatgggarcaaatggcagcttagtatgctgcaaacactcattcaggcctggttctaaatccccactccaccgctatgtcctagctctttcaactaggctaagcaccttcaaagtccatttgcccacctgcaaaatggagataattccggagaaaatcataagctaagagagatggcaatgtgggtgtgctccatgaatgccacacagagccaaatggagaaaggagtggacggtgggccactggtctctcacctgtgctgacattgaagcctgcaaagcaaggcagggccaggtattccctgtctgaa

SEQ ID NO: 176014 - DNA, 601 bp, Human
agttttaagttttacatccacttatatgttggatgtaagtgggtagaacgtgaagattctagacagaaggtacccttgcgaagggacctagttttaaaaaaattagctaacaaatacatatataacatttactctgtgccagacactgttctaggcactttacatattaacacatctaacccttgtaatcaccctgtaagaattatcattctattcagttcagagatgagaaaacagaggctcagagtagttatcaaattacgcaaggtcacacagctcgaaagtggtagggctgggatttgaacccagatagcctggggcccagaggccaaacacctacacacagttttctctgagaccagcagaaaagcctattatgggagcaaatggcagcttagtatgctgcaaacactcattcaggcctggttctaaatccccactccaccgctatgtcctagctctttcaactaggctaagcaccttcaaagtccatttgcccacctgcaaaatggagataattccggagaaaatcataagctaagagagatggcaatgtgggtgtgctccatgaatgccacacagagccaaatggagaaaggag

SEQ ID NO: 176015 - DNA, 601 bp, Human
tggctagatactggggctagaaggatgaatgcaacccaatccctagttttaagttttacatccacttatatgttggatgtaagtgggtagaacgtgaagattctagacagaaggtacccttgcgaagggacctagttttaaaaaaattagctaacaaatacatatataacatttactctgtgccagacactgttctaggcactttacatattaacacatctaacccttgtaatcaccctgtaagaattatcattctattcagttcagagatgagaaaacagaggctcagagtagttatcamattacgcaaggtcacacagctcgaaagtggtagggctgggatttgaacccagatagcctggggcccagaggccaaacacctacacacagttttctctgagaccagcagaaaagcctattatgggagcaaatggcagcttagtatgctgcaaacactcattcaggcctggttctaaatccccactccaccgctatgtcctagctctttcaactaggctaagcaccttcaaagtccatttgcccacctgcaaaatggagataattccggagaaaatcataagctaagagagatggcaatgtg

SEQ ID NO: 176016 - DNA, 601 bp, Human
tgtgtggggtattggctagatactggggctagaaggatgaatgcaacccaatccctagttttaagttttacatccacttatatgttggatgtaagtgggtagaacgtgaagattctagacagaaggtacccttgcgaagggacctagttttaaaaaaattagctaacaaatacatatataacatttactctgtgccagacactgttctaggcactttacatattaacacatctaacccttgtaatcaccctgtaagaattatcattctattcagttcagagatgagaaaacagaggctcaragtagttatcaaattacgcaaggtcacacagctcgaaagtggtagggctgggatttgaacccagatagcctggggcccagaggccaaacacctacacacagttttctctgagaccagcagaaaagcctattatgggagcaaatggcagcttagtatgctgcaaacactcattcaggcctggttctaaatccccactccaccgctatgtcctagctctttcaactaggctaagcaccttcaaagtccatttgcccacctgcaaaatggagataattccggagaaaatcataagctaagaga

SEQ ID NO: 176017 - DNA, 601 bp, Human
tcatgcctgtaaccccagcactttgggaggctgaggtgggcggatgacttgaggtcaggagttcgagaccagcctggccaacatggtgaaacctcgtctctactaaaaatacaaaaattagctggggatggtggtgcgtgcctgtaatcccagctactcaggaggctgggggaggggggaattgcttaaacccaggaggcagaggttgcagagagctgagattacaccactgcactccagcctgggtgacagagagagactgtctctaaataaataaataaataaataaataaataaataaggcattgcagtggccatttattgagcatttgttatgtgctgggcactacaggccacatttccatgttataatgcctagtttacagatgaggaagctggggctcagggctaaggagtagctgctcaggggcacccagtcaggaaatgggcctgaattatttttacctcttccattgccgggcacagagttgctactcagtcaacatctgctggatctgttagaagagtttagttgatgccttaagatctgagtgtggcagggagggagggagggaggcagggaactgggccaggtttggct

SEQ ID NO: 176018 - DNA, 601 bp, Human
ctctgtcccctacagcctgtggcttagcctccaagtccgtacaaaatgcctgatgcctgcgcctctgcctctggctggcactatcgcttgtttgtgtatatgtgtagagctgcaagcaatttgcagacaataaaaatgacattgcatggccgggtgcagtggctcatgcctgtaaccccagcactttgggaggctgaggtgggcggatgacttgaggtcaggagttcgagaccagcctggccaacatggtgaaacctcgtctctactaaaaatacaaaaattagctggggatggtggtgcrtgcctgtaatcccagctactcaggaggctgggggaggggggaattgcttaaacccaggaggcagaggttgcagagagctgagattacaccactgcactccagcctgggtgacagagagagactgtctctaaataaataaataaataaataaataaataaataaggcattgcagtggccatttattgagcatttgttatgtgctgggcactacaggccacatttccatgttataatgcctagtttacagatgaggaagctggggctcagggctaaggagtagctgctcaggggcacccagt

SEQ ID NO: 176019 - DNA, 601 bp, Human
gaccccactccctctgtcccctacagcctgtggcttagcctccaagtccgtacaaaatgcctgatgcctgcgcctctgcctctggctggcactatcgcttgtttgtgtatatgtgtagagctgcaagcaatttgcagacaataaaaatgacattgcatggccgggtgcagtggctcatgcctgtaaccccagcactttgggaggctgaggtgggcggatgacttgaggtcaggagttcgagaccagcctggccaacatggtgaaacctcgtctctactaaaaatacaaaaattagctgggsatggtggtgcgtgcctgtaatcccagctactcaggaggctgggggaggggggaattgcttaaacccaggaggcagaggttgcagagagctgagattacaccactgcactccagcctgggtgacagagagagactgtctctaaataaataaataaataaataaataaataaataaggcattgcagtggccatttattgagcatttgttatgtgctgggcactacaggccacatttccatgttataatgcctagtttacagatgaggaagctggggctcagggctaaggagtagctgctcag

SEQ ID NO: 176020 - DNA, 601 bp, Human
cttgcctatgagctcaatggaggctgcacaggtgggcctggaccatgctgttgggtttgaatcctggccctgacacttgctggcattgtgaccttgcactcactccctgggctgccctttctacatctgcacttatgtcctctgttgtcccaaggtcaaatgaggtaaccaaacccagcactaggctggacacacatgacatgcccagctaataattctttcctcccattcttggcaaaacaatcttcttgcccctttctgaacatacccaaaagtttccagccttggctgatgccaataycttgcctggaccccactccctctgtcccctacagcctgtggcttagcctccaagtccgtacaaaatgcctgatgcctgcgcctctgcctctggctggcactatcgcttgtttgtgtatatgtgtagagctgcaagcaatttgcagacaataaaaatgacattgcatggccgggtgcagtggctcatgcctgtaaccccagcactttgggaggctgaggtgggcggatgacttgaggtcaggagttcgagaccagcctggccaacatggtgaaacctcgtctctactaaaaatacaaaaat

SEQ ID NO: 176021 - DNA, 601 bp, Human
gcctcagcctcttgagtagctgggattacaggtgtgtgccaccacgcctggctaatttttgtatttttagtagaggtggggtttcaccatgttggccaggctggtctcgaactcctgaccttgtgatctgcccgccttggactcccaaagtgctgggattacaggcatgagccactgcgcccggcatgccccatggttttaaagacaaggcactttatggtcagaggggctctgggacatgccccagatcccgccaggagttgaaggcatcttccagctataggtggggctcgggccttckggcctttagagagagtgacagcaaagcagagtatctgaaacagaacgtcctgggccccaaaaaggctctgcttcccatctcgctgcctattgggcatcattgcacccacccttcctgcgttagggggttgggagtgaggaagggggcatctgcatcttcccacctcaaaagcatgaagtgtggggccccagtgcctcagggtggtctgtgctcattgtctattttatgtcttgcctatgagctcaatggaggctgcacaggtgggcctggaccatgctgttgggtttgaatcctggccct

SEQ ID NO: 176022 - DNA, 601 bp, Human
gatcttggctcactgcaacctccgcctcctgggttcaagtgattctcctgcctcagcctcttgagtagctgggattacaggtgtgtgccaccacgcctggctaatttttgtatttttagtagaggtggggtttcaccatgttggccaggctggtctcgaactcctgaccttgtgatctgcccgccttggactcccaaagtgctgggattacaggcatgagccactgcgcccggcatgccccatggttttaaagacaaggcactttatggtcagaggggctctgggacatgccccagatccygccaggagttgaaggcatcttccagctataggtggggctcgggccttctggcctttagagagagtgacagcaaagcagagtatctgaaacagaacgtcctgggccccaaaaaggctctgcttcccatctcgctgcctattgggcatcattgcacccacccttcctgcgttagggggttgggagtgaggaagggggcatctgcatcttcccacctcaaaagcatgaagtgtggggccccagtgcctcagggtggtctgtgctcattgtctattttatgtcttgcctatgagctcaatggag

SEQ ID NO: 176023 - DNA, 601 bp, Human
ccccagtaattggctagtgatctgccccatgtcccatgttttttttttttttttttggtttttcgttttgttttgttttgtttttgagatggagtctagctctgctgtccaggctggagtgcagtggtgtgatcttggctcactgcaacctccgcctcctgggttcaagtgattctcctgcctcagcctcttgagtagctgggattacaggtgtgtgccaccacgcctggctaatttttgtatttttagtagaggtggggtttcaccatgttggccaggctggtctcgaactcctgacctygtgatctgcccgccttggactcccaaagtgctgggattacaggcatgagccactgcgcccggcatgccccatggttttaaagacaaggcactttatggtcagaggggctctgggacatgccccagatcccgccaggagttgaaggcatcttccagctataggtggggctcgggccttctggcctttagagagagtgacagcaaagcagagtatctgaaacagaacgtcctgggccccaaaaaggctctgcttcccatctcgctgcctattgggcatcattgcacccacccttcctgcgtt

SEQ ID NO: 176024 - DNA, 601 bp, Human
ctctgagcctcagtgtgctcatctataaaatgggaatcataatagtatacacttcagagatagctaggaagattaaatgagtgaaatgctaagcacggtgcctggcacatattgagcgctctatgaacttagatgctattgccatcatcactcaaggtcacgcagctgagccaaaatagtgaagtggtcttctgtgtagaggtttatccactgagacatctgtgaaatcccggggctggaacgcaccccagtaattggctagtgatctgccccatgtcccatgttttttttttttttttttggtttttcgttttgttttgttttgtttttgagatggagtctagctctgctgtccaggctggagtgcagtggtgtgatcttggctcactgcaacctccgcctcctgggttcaagtgattctcctgcctcagcctcttgagtagctgggattacaggtgtgtgccaccacgcctggctaatttttgtatttttagtagaggtggggtttcaccatgttggccaggctggtctcgaactcctgaccttgtgatctgcccgccttggactcccaaagtgctgggattacaggcatgagccactg

SEQ ID NO: 176025 - DNA, 601 bp, Human
acggctgatccccagcatttggctttctaatttctgcctgactcaggtgctccaccacagcccaaggccttacgctaccactccgcctctcacgcctctcacggtaaataggctacttaaggataaaagggaacagattttgccagagggaagcagaaaaggcaaattccttcaggcatgcgagtgagtggcaaggggtgggggggttgcaaggttaggcaataatgatgactacatgtttcagcaacagaagcaaaatgcaaaccccaaactcttgagttgagacacacttaaagcagarggcagtggatccatcgccgggaatgggtttcaggaagaatgtaactaggactgcgtgcaggcacgtgtgcacacggggcatgcggatcttctctgcagcaagatattaggagtcaaggtttgaagagggccctgaggcttcacagcaagtcgctctgcttccctgggcctcagattccttgtatgtatcagtaacaaaaatatcttgtagagctgttgggaggtttgaatgagttaaaagatgtaaggcctgtgtgctgtacttggcacacaggaagtggggatgaatgctaacctcgat

SEQ ID NO: 176026 - DNA, 601 bp, Human
attctcttcattcgagcaacagccctgtaaggtgtgtatttttctccccactttccaggtgtgggaatggatgtcctgagagaggaaaagatacagccattcccacggctgatccccagcatttggctttctaatttctgcctgactcaggtgctccaccacagcccaaggccttacgctaccactccgcctctcacgcctctcacggtaaataggctacttaaggataaaagggaacagattttgccagagggaagcagaaaaggcaaattccttcaggcatgcgagtgagtggcaaggsgtgggggggttgcaaggttaggcaataatgatgactacatgtttcagcaacagaagcaaaatgcaaaccccaaactcttgagttgagacacacttaaagcagagggcagtggatccatcgccgggaatgggtttcaggaagaatgtaactaggactgcgtgcaggcacgtgtgcacacggggcatgcggatcttctctgcagcaagatattaggagtcaaggtttgaagagggccctgaggcttcacagcaagtcgctctgcttccctgggcctcagattccttgtatgtatcagtaaca

SEQ ID NO: 176027 - DNA, 601 bp, Human
ctttttccaccaagcagctgctccctttcacaagaggccagttatgtaaggaaggctgcttcctctccccttgctaaatcttttctagtgcagcataaggccagagctagggaaagtccacacgggaataaaaagagcagattgctaagcacagaagccatttataactaaaacgtctcagctcagcttaggggagggagtggtggagtcaggagacccgggtcccgttgggccaaggacttctatgtgactttggcacttactgtctacggggcctcagttttcaagtctctcagtgggsatcacagtgtcccctaaacctcattgagctggtaccagggtgcaatgagatgggacaaagcatcgtgcaccttagggctctgccctcaaaaccctgggctagccttgatctgagcatcctgtcctacttagaaatcaaatccccatagaggccggagggctagaattacagggagaacggcaaattctccttctatctctctcacttttctcctgctttagactcaatttcctttctgttgaggattgagattccaccacttttaaaaggttttgggtggcttacgagcaaaacattccc

SEQ ID NO: 176028 - DNA, 601 bp, Human
ccaaagcgaaactgagccggccattgagtcagcggctggaaggctctttccctccctctgtcgtgatgaccgggatgaaggagccggcctcctggtttatcacctcacctctaaatagctcccgggctcggtttcttataaattggtatctcaaacagggatcaccttcccatcccggagaactgggaggcagagtcactccgggtcaagccagacagccacaaggaggccgcgtcaacagttctggggctcactctgtaccaggcaccgcacggtgtgttattccatttcatcctcgtcrgctctcttatcttcattttgtttacagagaaactgaggctgagtgtcactgtgtcactcagctaggaagattctaacaggcgtggctggggccagggtgcgtctcttcctcaaaggttggagttaaatggtcctggttctgactcaagctgcaacccccagaggcagaaggagagggatgcatggaggggaatgtctttttccaccaagcagctgctccctttcacaagaggccagttatgtaaggaaggctgcttcctctccccttgctaaatcttttctagtgcagcataaggccaga

SEQ ID NO: 176029 - DNA, 601 bp, Human
attctgttcttttctttcccttaggaaactgaaattagcctaattaggtctgtcccagtccaaggccgcggggattggacaaatttagaagctattgacaggtgagagcaacacacgctgatggcccaaagcgaaactgagccggccattgagtcagcggctggaaggctctttccctccctctgtcgtgatgaccgggatgaaggagccggcctcctggtttatcacctcacctctaaatagctcccgggctcggtttcttataaattggtatctcaaacagggatcaccttcccatccyggagaactgggaggcagagtcactccgggtcaagccagacagccacaaggaggccgcgtcaacagttctggggctcactctgtaccaggcaccgcacggtgtgttattccatttcatcctcgtcggctctcttatcttcattttgtttacagagaaactgaggctgagtgtcactgtgtcactcagctaggaagattctaacaggcgtggctggggccagggtgcgtctcttcctcaaaggttggagttaaatggtcctggttctgactcaagctgcaacccccagaggcagaaggagag

SEQ ID NO: 176030 - DNA, 601 bp, Human
aaggacagcagtacttttgcagtctaaatcctcgcccaagaccctctggggccagcttgcagatgtcatcattgtccaaccagaaagcgacaaaggaggtagatggtagggatgggggtgggaaggaggcagcagagggaggatcagaggactagaggattctgttcttttctttcccttaggaaactgaaattagcctaattaggtctgtcccagtccaaggccgcggggattggacaaatttagaagctattgacaggtgagagcaacacacgctgatggcccaaagcgaaactgagcyggccattgagtcagcggctggaaggctctttccctccctctgtcgtgatgaccgggatgaaggagccggcctcctggtttatcacctcacctctaaatagctcccgggctcggtttcttataaattggtatctcaaacagggatcaccttcccatcccggagaactgggaggcagagtcactccgggtcaagccagacagccacaaggaggccgcgtcaacagttctggggctcactctgtaccaggcaccgcacggtgtgttattccatttcatcctcgtcggctctcttatcttcatt

SEQ ID NO: 176031 - DNA, 601 bp, Human
ggcaacttagttcctgatcctcagtttcctcatctataaaatggggatactgggactatctccttatagggttatggtaagggctccataagataatggagaaggagtgcccagcacagtgcctggcacacagtgggaatgcgactaaatcaactcttaatgttgacaggtagaagagacagtcttcctttggaggtatccagaatggtcattctcttctaagacatgaaaggacagcagtacttttgcagtctaaatcctcgcccaagaccctctggggccagcttgcagatgtcatcaytgtccaaccagaaagcgacaaaggaggtagatggtagggatgggggtgggaaggaggcagcagagggaggatcagaggactagaggattctgttcttttctttcccttaggaaactgaaattagcctaattaggtctgtcccagtccaaggccgcggggattggacaaatttagaagctattgacaggtgagagcaacacacgctgatggcccaaagcgaaactgagccggccattgagtcagcggctggaaggctctttccctccctctgtcgtgatgaccgggatgaaggagccggcc

SEQ ID NO: 176032 - DNA, 601 bp, Human
aagtcctgaaactaagcaagacaaggaagatataaacagagggcacggaaagcctaaagagcagccagctgacctggtacaagtttccgacccatctatcccatcagagctagcatcccacctccggcacatccatccgtggcaacttagttcctgatcctcagtttcctcatctataaaatggggatactgggactatctccttatagggttatggtaagggctccataagataatggagaaggagtgcccagcacagtgcctggcacacagtgggaatgcgactaaatcaactcttaaygttgacaggtagaagagacagtcttcctttggaggtatccagaatggtcattctcttctaagacatgaaaggacagcagtacttttgcagtctaaatcctcgcccaagaccctctggggccagcttgcagatgtcatcattgtccaaccagaaagcgacaaaggaggtagatggtagggatgggggtgggaaggaggcagcagagggaggatcagaggactagaggattctgttcttttctttcccttaggaaactgaaattagcctaattaggtctgtcccagtccaaggccgcgggga

SEQ ID NO: 176033 - DNA, 601 bp, Human
tcctccctggtcttgcttttcttatgagtgagtgttgggtctagaagacgcctttccagctgtcacacggtgtttggagcaagcaagctgggggtaactcccagctcccatttcttgttcctgtgaccttcgactagatgcttcacctcacctgtcaaatggagctcatgatagtgcccacttccttaagttgttcagaggagccagcactaaagctctcggtcacaggcctgatgcatagcaagctctcggtatctggtggtgttgcaaccaaggtgtttctgtacttcaagccactttraaaccaagcctataaacgcctagttgctgcccggcagaagcaggaggctctaaatggtattgtaactggtatttgttagcatcatcgttgttcttgttgccattgtttgtctccatgatcccagcatttcctgcctccgccctggcacctacctacaatcatccagcaaccctggacctacatctgaatcttgttccatcactatctggctaggtggccatcagtcactactttagctctctgaggctcagctttctcatttgtaaagtgggtataataatgcctgtttggatggctatt

SEQ ID NO: 176034 - DNA, 601 bp, Human
tgggaggtactttggagctgtggggtttttgaaagcctcttaaatcagcccctctgcccaccctgcaatctgttctcaagcagccaggacatcacagtagccacatgcgctggccttcggcagagaacacggaattctaattttatcccctcagaaccttcaataggggactttgtagataaattgagggcaggagccaccccttccgtgcctttcctatctgcctcagggctgagctcttaggagccagccaattaacgaacaggtctcctagccaaacccttcctctaaaatgcccagktctctccttaaagaaaaacaaatgactggctgggtgcagtggctcatgcctgtaatcacagcactttgggaggctgaggtgggcagatcacaaggtcaggagttcgagaccagcctgatcaacatggtgaaacctcgtctctactaaaaatacaaaagtcagccgggagtggtggcgcgcgcctgtaatcccaggtactcagtaggctgaggcaggagactagcttgaacccgggaggtggagattgcagtgagctaagatcacaccactgcactccagcctgggtgacagagcaagact

SEQ ID NO: 176035 - DNA, 601 bp, Human
tgggtggatggagggatgaggaatggatggatagagggatggataaagggagagaaagatgaatggatggatgggtgggtgggtggatggatggatggatggatggatgggtgggtggttgggtgggtggatgggatagctcacgagtccttcttaggggtcaacaagttctgacttactttatataattcacatgacagtctgggaggattctaattttatagatggggaaatggaggctgggaaggtgaggtgtcagggtcatgtggaaaacaagaggcagagccaggacttggcctcyggcctcaggaacctgctacatgaatgtggagaggctactcctgagagggctagtgtcccagctcaggcagaagcatgaaccctctacagcttcaacctgtcatttcatccagcactggcattccctgtttgggggcactgagtttctctgtcctgggataaaggatgcatgagcctgtccatcaccgcctgctcatggagagattgtcaagaggggaagctggtcctctctgttttccagcctgccctgaccccttcatcctcactctggaaattatgggctctcaggctgctcatcggt

SEQ ID NO: 176036 - DNA, 601 bp, Human
ggtgcctcaccttcctgaggtttgacttaggaaatagacatcatcctttcctgtccccaggctgtcctaggataggaaaagtgggtgacctggatatgggggatgcagggtgggagagagtgagggtccaccagctggttttgaaatctccaggctctctggctgagtggtaacagcagtgccaaggatggagtctcaaataaataccaaaacaacaaatactcgtacagaatccctcccatagggcaggcgtcaaagtgcttgctttctcagccaggagcctgtgatcttccaggacctyggtggggcaggtggttattttgagatgtcttttattagcagtacttttattaattatagctagtaactaacatttatcgaatgccaatgtgggaagcattttgcatatattatctcattgaatcctcatgactactccatgggagagacacctttgtctgcattttacagatggggaaactgaggctcaaaaattaagtagcttgaccatgacatgattcaagctagaaatgctcttaggcttccttcttcatccctgtagtttccgacctactttgaccttggtatagagtgacacatg

SEQ ID NO: 176037 - DNA, 601 bp, Human
gatgaagggacacgtacctgggtgcctcaccttcctgaggtttgacttaggaaatagacatcatcctttcctgtccccaggctgtcctaggataggaaaagtgggtgacctggatatgggggatgcagggtgggagagagtgagggtccaccagctggttttgaaatctccaggctctctggctgagtggtaacagcagtgccaaggatggagtctcaaataaataccaaaacaacaaatactcgtacagaatccctcccatagggcaggcgtcaaagtgcttgctttctcagccaggagyctgtgatcttccaggacctcggtggggcaggtggttattttgagatgtcttttattagcagtacttttattaattatagctagtaactaacatttatcgaatgccaatgtgggaagcattttgcatatattatctcattgaatcctcatgactactccatgggagagacacctttgtctgcattttacagatggggaaactgaggctcaaaaattaagtagcttgaccatgacatgattcaagctagaaatgctcttaggcttccttcttcatccctgtagtttccgacctactttgacc

SEQ ID NO: 176038 - DNA, 601 bp, Human
agaggttgcagtgagccgagatcgtgccactgcactccagcctggtaacagagtgagactccatctcacacaaaaaaaaaaaaaaaaaaaaaaaagaaagaaacaacctggcactggccctggctagatgaagggacacgtacctgggtgcctcaccttcctgaggtttgacttaggaaatagacatcatcctttcctgtccccaggctgtcctaggataggaaaagtgggtgacctggatatgggggatgcagggtgggagagagtgagggtccaccagctggttttgaaatctccaggytctctggctgagtggtaacagcagtgccaaggatggagtctcaaataaataccaaaacaacaaatactcgtacagaatccctcccatagggcaggcgtcaaagtgcttgctttctcagccaggagcctgtgatcttccaggacctcggtggggcaggtggttattttgagatgtcttttattagcagtacttttattaattatagctagtaactaacatttatcgaatgccaatgtgggaagcattttgcatatattatctcattgaatcctcatgactactccatgggagagacacctt

SEQ ID NO: 176039 - DNA, 601 bp, Human
gctgaggtgggcggatcacgaggtcaagagatcgagactatcctggccaacacggtgaaaccctgtctctactaaaaatacaaaaattagctggacgtggtggcgcacacctgtagtcccagctacttgggaagcagaggcaggaggattgcttgaacacaggaggcagaggttgcagtgagccgagatcgtgccactgcactccagcctggtaacagagtgagactccatctcacacaaaaaaaaaaaaaaaaaaaaaaaagaaagaaacaacctggcactggccctggctagatgaagrgacacgtacctgggtgcctcaccttcctgaggtttgacttaggaaatagacatcatcctttcctgtccccaggctgtcctaggataggaaaagtgggtgacctggatatgggggatgcagggtgggagagagtgagggtccaccagctggttttgaaatctccaggctctctggctgagtggtaacagcagtgccaaggatggagtctcaaataaataccaaaacaacaaatactcgtacagaatccctcccatagggcaggcgtcaaagtgcttgctttctcagccaggagcctgtgat

SEQ ID NO: 176040 - DNA, 601 bp, Human
aaaaccccacctatccagtttcttagttttcatcattgtactgtggttatgtaaaatattaacatcgggggagctgggtgaagggtgtacaggactctctgtactatcattgcaattcttctgtatatctacaattatttcaaaataaaaaagtgaaaacacacacacacaaaagccaaaccaacacatgctgtattgtagaaataacctggcactgggctgggcacggtggctcactcctgtaatcccagcactttgggaggctgaggtgggcggatcacgaggtcaagagatcgagacyatcctggccaacacggtgaaaccctgtctctactaaaaatacaaaaattagctggacgtggtggcgcacacctgtagtcccagctacttgggaagcagaggcaggaggattgcttgaacacaggaggcagaggttgcagtgagccgagatcgtgccactgcactccagcctggtaacagagtgagactccatctcacacaaaaaaaaaaaaaaaaaaaaaaaagaaagaaacaacctggcactggccctggctagatgaagggacacgtacctgggtgcctcaccttcctgaggtttgac

SEQ ID NO: 176041 - DNA, 601 bp, Human
ttggcattgttcctgttctacagatgaagaaactgaggctcagggtcctgatttctggacttctctgctgtttttctccccaggagatgagagaggacaaggagtttgctgccacgtgccactacgtgtctctgagatgccatgtctcagcctgctggggagtgtagggtctcaggcaagtgcccatcgccctagaaaatgcagtgttgtcttggctgggcacagtggctcacgcgtgtaatcccagcactttgggaggctgaggcaggtgaatcacttgaggtcaggagtttgagaccarcctggccaacatggtaaaaccctgtatctactgaaaatgcaaaaattagctgggtgtggtggcggacgcctgtaatcccagctactccaaagtctgaggcaggagaattgcttgatcccagaaggcagaggttgcagtgagccaagatcgtgccaccgcactccagcttgggcaatagagtcagactctgtctcaaaacaaacaaaaaaaagaaaagaaaaaagaaaatggagtgttgtgatgtggggagagcacaggctggggattgaaagttagggcttccaggcttagtctggccct

SEQ ID NO: 176042 - DNA, 601 bp, Human
aacaatagcaataataataataatagttttctgaatgcttatcatatgccaggcactattcgaaacactttatatgcaatatcttatttgactctgacaataatcctgtctggtgcattttggcattgttcctgttctacagatgaagaaactgaggctcagggtcctgatttctggacttctctgctgtttttctccccaggagatgagagaggacaaggagtttgctgccacgtgccactacgtgtctctgagatgccatgtctcagcctgctggggagtgtagggtctcaggcaagtrcccatcgccctagaaaatgcagtgttgtcttggctgggcacagtggctcacgcgtgtaatcccagcactttgggaggctgaggcaggtgaatcacttgaggtcaggagtttgagaccagcctggccaacatggtaaaaccctgtatctactgaaaatgcaaaaattagctgggtgtggtggcggacgcctgtaatcccagctactccaaagtctgaggcaggagaattgcttgatcccagaaggcagaggttgcagtgagccaagatcgtgccaccgcactccagcttgggcaatagagt

SEQ ID NO: 176043 - DNA, 601 bp, Human
gcggggccctgggtggtgctctctctgggttcttgcttctgctgcagcagccccagagcgtaagtgtgaaaatgaatgaatgaataaatgaatgaatgagcagatgagtgaagtgaggtgggaaatgatgggcctaccacatcttttggttcatcatgccatgccacacccaaaatcattaataataactacactaataacaatagcaataataataataatagttttctgaatgcttatcatatgccaggcactattcgaaacactttatatgcaatatcttatttgactctgacaatartcctgtctggtgcattttggcattgttcctgttctacagatgaagaaactgaggctcagggtcctgatttctggacttctctgctgtttttctccccaggagatgagagaggacaaggagtttgctgccacgtgccactacgtgtctctgagatgccatgtctcagcctgctggggagtgtagggtctcaggcaagtgcccatcgccctagaaaatgcagtgttgtcttggctgggcacagtggctcacgcgtgtaatcccagcactttgggaggctgaggcaggtgaatcacttgaggt

SEQ ID NO: 176044 - DNA, 601 bp, Human
gcccccacctcctgcccagatgcatctggaaagccaatgcctgaccaggcctgggtcttcctgagcaagcagagtctgactggtacaacctttattgcttctccagcattttccagaagaatggtgtcattagagggccacaggggatgggggagtaaaaaataacataaacgaactgaacagaaatgcaggagggtggcaagaggggccgagattgggtgttcagggcagagaggtggaagaccaggggcagtcagtgcttcttagctttcagccaccagagtggagaattctgcagaamaaaatgacaaggaaagtgagtcagaggcggggatgcaagagagactgtccacacctgactgcggggccctgggtggtgctctctctgggttcttgcttctgctgcagcagccccagagcgtaagtgtgaaaatgaatgaatgaataaatgaatgaatgagcagatgagtgaagtgaggtgggaaatgatgggcctaccacatcttttggttcatcatgccatgccacacccaaaatcattaataataactacactaataacaatagcaataataataataatagttttctgaatgcttat

SEQ ID NO: 176045 - DNA, 601 bp, Human; identical to SEQ ID NO: 26107

SEQ ID NO: 176046 - DNA, 601 bp, Human; identical to SEQ ID NO: 24997

SEQ ID NO: 176047 - DNA, 601 bp, Human; identical to SEQ ID NO: 24998

SEQ ID NO: 176048 - DNA, 601 bp, Human; identical to SEQ ID NO: 24999

SEQ ID NO: 176049 - DNA, 601 bp, Human; identical to SEQ ID NO: 25000

SEQ ID NO: 176050 - DNA, 601 bp, Human; identical to SEQ ID NO: 25001

SEQ ID NO: 176051 - DNA, 601 bp, Human; identical to SEQ ID NO: 25002

SEQ ID NO: 176052 - DNA, 601 bp, Human; identical to SEQ ID NO: 25003

SEQ ID NO: 176053 - DNA, 601 bp, Human; identical to SEQ ID NO: 25004

SEQ ID NO: 176054 - DNA, 601 bp, Human; identical to SEQ ID NO: 25005

SEQ ID NO: 176055 - DNA, 601 bp, Human; identical to SEQ ID NO: 25006

SEQ ID NO: 176056 - DNA, 601 bp, Human; identical to SEQ ID NO: 25007

SEQ ID NO: 176057 - DNA, 601 bp, Human; identical to SEQ ID NO: 25008

SEQ ID NO: 176058 - DNA, 601 bp, Human; identical to SEQ ID NO: 25009

SEQ ID NO: 176059 - DNA, 601 bp, Human; identical to SEQ ID NO: 25010

SEQ ID NO: 176060 - DNA, 601 bp, Human
gtttctcttggtcacccaggctggccacagtggtgcataccggtaatcccagcactttgagaggccagggtggaaggattgcttgagccccagagtttgagaccagcctgggcaacagggtgaaaccctgtctctactaaaaatacaaaaattagccaggagtggtggcacatgcctgtagtcccagctacttgggaagatgagtcagtaggatcacctgaacccaggagacggaggttgcagtgagctaagatggtgccactgcactgtagcctgggtgtcagagtaaaaccctgtctcaaaaaaaaaaaaaaaaaagaaaaagaaaagaaaacaaaaggatacatgaattattaatgttattaatataagttgggacacaaatttcttgcttaaaaactcaaagctaaacaaaatggataactatgataaattcaatgttaaaatcatcttagaaaatagggagaccaaactcttttaattaaggaaaagaatttaagaattgaaaaaaatccataaagaatgctataaagatggggcctggcatggtggctcccgcctgtaatcctatcactttgggaggctgaggcgggggattgct

SEQ ID NO: 176061 - DNA, 601 bp, Human
tccttaaccaaaatctaacttaatttcttcctatttaaaactcacagatcatcactgtgaaggatttgctttcatagaaggttatgctttttgctcctgctcccaggttctgcatttatccatcttgactactctataaacttccctgtctcttctttatagtaaattatcttatttatagtaaatttagcttcattctccttttatttgcagatttttttttctttttttttgagatggagtctcactttgttacttaggctggagtgcagtggcacgatctcggctcactgcaagctcygcctcctgggttcacgccattctcctgcctcagcctcctgagtagctgggactacaggtgcgcgccaccacgcccagctaatttttttgtgtgtttagtaaagacgaggtttcaccatgttggccaggatggtctccatctcctgacctcgtgatccacccaccttggcctcccaaagtgctgggattacaggcgtgagccaccgtgcctggcctatttgcagcttttaaaatctgctttggactggcaagccaaacaattctcccctgagtgaacaattcttccttctagagaaaatga

SEQ ID NO: 176062 - DNA, 601 bp, Human
aatactcaattttcttaatgaacattgcatcaaaatcattttaagctttctataacattcacaggaagtataaagtaaggttttttttccacatggttgcaatatcatggaggaagaaaatctgattatctttactttccttttccagttataatagattgtttaatgtgtgggccttcatcagtaaggcaatggtatcttggatagaaagaacaccagacttgaggcctctggttctgcctctggctctgacgttaacatactaggtctcttgtcctcatctgtataatgaagataatayctgtgtcacctgccacacagggttcttatgcggcttaaaaaaagacagatattaacgttttatccaaatatagatattgttagactattcataaaagcgagtatctttatatggcaaaatgataaagaattcaactcaccatacagggactgaatgccacgtatgtcatcagcagagaggcgaaatgtgttgatgtcaacatatttgtaggtggggaacattacggcctttggatcactagaatggccaagacctaaggaatggccaatctcgtgaacagcagtgaggaacaagtttgtg

SEQ ID NO: 176063 - DNA, 601 bp, Human
aatcaagtctcttgcataggtactgttttacagtcttggtttcagacttcaccatttttatctatgattaaaatagtctggcttctgtttcttatcttctaaatccccatcccagattcctactgcaaatcgttttttacacaccagttttctagttaaaacacaaatgtaattacacctgtctcctgcttcaaaacctttaagatctcctcactgcctacagaatcgagtccaagttcctgcttacaagtttcatctacttcattttcaattattttccactgttttctgacaaaaaaaatttaaaggcagaaactttaatattggttagatatgaaaatgatcctacctgtctttgaagaaaaagatcttatttcccacggtagtgacagcatcaaaactcaaattggggtcacagagagctggttctgaattgtcaggatttggcaagcgttggttctcttttgggtctcctgaaaatacatttcgagaagcattagtaaacaaaatctgcattgtagttcagaggaggaacagttatgttttaaatactcaattttcttaatgaacattgcatcaaaatcattttaagctttctata

SEQ ID NO: 176064 - DNA, 601 bp, Human; identical to SEQ ID NO: 25011

SEQ ID NO: 176065 - DNA, 601 bp, Human; identical to SEQ ID NO: 25012

SEQ ID NO: 176066 - DNA, 601 bp, Human; identical to SEQ ID NO: 25013

SEQ ID NO: 176067 - DNA, 601 bp, Human; identical to SEQ ID NO: 25014

SEQ ID NO: 176068 - DNA, 601 bp, Human; identical to SEQ ID NO: 25015

SEQ ID NO: 176069 - DNA, 601 bp, Human; identical to SEQ ID NO: 25016

SEQ ID NO: 176070 - DNA, 601 bp, Human; identical to SEQ ID NO: 25017

SEQ ID NO: 176071 - DNA, 601 bp, Human; identical to SEQ ID NO: 21027

SEQ ID NO: 176072 - DNA, 601 bp, Human; identical to SEQ ID NO: 21028

SEQ ID NO: 176073 - DNA, 601 bp, Human; identical to SEQ ID NO: 21029

SEQ ID NO: 176074 - DNA, 601 bp, Human; identical to SEQ ID NO: 19902

SEQ ID NO: 176075 - DNA, 601 bp, Human; identical to SEQ ID NO: 19903

SEQ ID NO: 176076 - DNA, 601 bp, Human; identical to SEQ ID NO: 19904

SEQ ID NO: 176077 - DNA, 601 bp, Human; identical to SEQ ID NO: 19905

SEQ ID NO: 176078 - DNA, 601 bp, Human; identical to SEQ ID NO: 19906

SEQ ID NO: 176079 - DNA, 601 bp, Human; identical to SEQ ID NO: 19907

SEQ ID NO: 176080 - DNA, 601 bp, Human; identical to SEQ ID NO: 19908

SEQ ID NO: 176081 - DNA, 601 bp, Human; identical to SEQ ID NO: 19909

SEQ ID NO: 176082 - DNA, 601 bp, Human; identical to SEQ ID NO: 19910

SEQ ID NO: 176083 - DNA, 601 bp, Human; identical to SEQ ID NO: 19911

SEQ ID NO: 176084 - DNA, 601 bp, Human; identical to SEQ ID NO: 19912

SEQ ID NO: 176085 - DNA, 601 bp, Human; identical to SEQ ID NO: 19913

SEQ ID NO: 176086 - DNA, 601 bp, Human; identical to SEQ ID NO: 19914

SEQ ID NO: 176087 - DNA, 601 bp, Human; identical to SEQ ID NO: 19915

SEQ ID NO: 176088 - DNA, 601 bp, Human; identical to SEQ ID NO: 19916

SEQ ID NO: 176089 - DNA, 601 bp, Human; identical to SEQ ID NO: 19917

SEQ ID NO: 176090 - DNA, 601 bp, Human; identical to SEQ ID NO: 19918

SEQ ID NO: 176091 - DNA, 601 bp, Human; identical to SEQ ID NO: 19919

SEQ ID NO: 176092 - DNA, 601 bp, Human; identical to SEQ ID NO: 19920

SEQ ID NO: 176093 - DNA, 601 bp, Human; identical to SEQ ID NO: 19921

SEQ ID NO: 176094 - DNA, 601 bp, Human; identical to SEQ ID NO: 19922

SEQ ID NO: 176095 - DNA, 601 bp, Human; identical to SEQ ID NO: 19923

SEQ ID NO: 176096 - DNA, 601 bp, Human
tctccgagttcagcctccccaccgctacccccgatctcagtatccagaggtggcatcggtgggcgcggggagaagggggtaacccagatgcctcctgaggcagacagggaaggcctggtccttccttggtctgcgcagcccctaacttatcttgaacctccactgccacccctcgaaggacgtggacgatgccactctgtcccgcctggaactagagcgcaagattgagtctctgatggatgagattgagttcctcaagaagctgcacgaggaggtaagtgggcccggtatcaggggcggyttctgaggttgtggggtggtctcgctggagctggcgggtggagcggaggcatcgccctggggatcaggacgatgctgggtagacgcagcccctccaccctagtctacaggtggttagactcccacccttgcgccacctggcggcgggcagcggggctgtacctccgaaacctggcctctggtctcgcgcccgcgggggcgcagggctgtacgccctgccctccctggcgcccacttctgttcgttcaagcgtttcttctcttttctgtgcacgaactgcgtggcccgcgtggaatttgcg

SEQ ID NO: 176097 - DNA, 601 bp, Human
tcgaaggacgtggacgatgccactctgtcccgcctggaactagagcgcaagattgagtctctgatggatgagattgagttcctcaagaagctgcacgaggaggtaagtgggcccggtatcaggggcggtttctgaggttgtggggtggtctcgctggagctggcgggtggagcggaggcatcgccctggggatcaggacgatgctgggtagacgcagcccctccaccctagtctacaggtggttagactcccacccttgcgccacctggcggcgggcagcggggctgtacctccgaaaccyggcctctggtctcgcgcccgcgggggcgcagggctgtacgccctgccctccctggcgcccacttctgttcgttcaagcgtttcttctcttttctgtgcacgaactgcgtggcccgcgtggaatttgcgccgctgtccatcctctgcctgctcccggccgtaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctg

SEQ ID NO: 176098 - DNA, 601 bp, Human
gccgggcagggcggggcctgggcaggggcgctgacaacttgcttcgcctctaggatctccgtgcccgtccattcttttgcctccttaaatataaagacgactggtgagtctggcttacagcctgtacctctccttgtccacttctgccctcctcgggctcttgctctggctcacctcagggatctcttctccccacggaacttctgggtcctggcctgtacccacccctactcctcaaacccgcccctcccctgccctcagggatagcagtgggagcctaagaggagagattcccacgccytcccccttgaaccctttatcctgctttcttcagtgcctgaggtggagcctccccaggacagccacagccggaagacggttctgatcaagaccattgagacccggaatggggaggtgaggcaggtcccctaatgccaggaccccaccatttcccatattatttctgagccccagcctggctgtcgctaatcttacttagggtgggtaattcttggggagagacagagaaggagacagagaacgtggatagataaccaggagcctctgctggttaccccagggagtggggctctatgatcca

SEQ ID NO: 176099 - DNA, 601 bp, Human
gctattctgtcacagtcctctgttttcatattgatgacagcatttattatagtctacctttaaataacagctgttgctggcttgccctcaccatcactccagttaggctgaacattttcaaagcaggagttttctttcttttctttttttttggagacaggatctcactgtgtcactcagactggagtgcagtggcatgatctcagctcactccagcctccacctctttggatcaagcgatcctcccacctgagcctcccgagtagctgggactacaggcacacaccaccaccaccacgcmtgggtaatttttgtatttttgtttctgtcgagacaggctttcatcatgttgcccaggctgatgctgaactcctgagctcaagcaatccacttgccttggcctcccaaagtactggcattacaggcgtgagccaccacacctggctgagttttctttttcctctttttaacttctaccccagagcctaatccagtacataaagtgtaaaggctaaattagaaaatctatataaaaatgctttgtaaaccataatacatttacaagtaagtagaatatgacatgtcattttaaatttaatgg

SEQ ID NO: 176100 - DNA, 601 bp, Human
cagctattctgtcacagtcctctgttttcatattgatgacagcatttattatagtctacctttaaataacagctgttgctggcttgccctcaccatcactccagttaggctgaacattttcaaagcaggagttttctttcttttctttttttttggagacaggatctcactgtgtcactcagactggagtgcagtggcatgatctcagctcactccagcctccacctctttggatcaagcgatcctcccacctgagcctcccgagtagctgggactacaggcacacaccaccaccaccacccctgggtaatttttgtatttttgtttctgtcgagacaggctttcatcatgttgcccaggctgatgctgaactcctgagctcaagcaatccacttgccttggcctcccaaagtactggcattacaggcgtgagccaccacacctggctgagttttctttttcctctttttaacttctaccccagagcctaatccagtacataaagtgtaaaggctaaattagaaaatctatataaaaatgctttgtaaaccataatacatttacaagtaagtagaatatgacatgtcattttaaatttaat

SEQ ID NO: 176101 - DNA, 601 bp, Human
actgcctaatgaaacactaggtcctaaaagctaagactaaagatctgagcttagggctaacccctacaagattctcacagatctactttattaaaacatggaagccagagagacagcattgtcttccccaaacacagacactcactaggcatagttgtaggcactagaaccacagacactggttccaccattgtctagctccatggcagagagagagccacaactggggaggatcccagtagctgactgtcagccagtcaaaacctgaatgactgagaggtggataaggaacacgaatgtwctgaaactgggaacttgagtccactcagcacccttgtgagtcaaaggctgctatagccaggggatgctggttttccaagtttcccttcccaagatagtctgagattagagagtgctttgactagacaaaacttagaaccatttctgtgctccctcaagtgggaacatttggaaatgccattgttatttaggaacccagaagggatcacaacaattttcatctgctagcatcaacagtcttggctccattttctctgggtgatatctccaaaataaaaccatacttcatccccatagcttc

SEQ ID NO: 176102 - DNA, 601 bp, Human
ttctgtgattctcctgcctcagcctcccaagcagctgggattataggcgcccaccatcaagcccagctaattttttctacttagtagagatggggttccaccatgttgatcagactggtctgtaacttgtgacctcaggtgatccacctgccttggcctcccaatgtggtgggattacaggcgtgagccaccacacccagctgcctttagttttttgagacagagtcttgtgctgtcgcccaggctggggtgtagtggcacagtctcggctcactgcaacctctgcctcccaggttctaamaattctcctgcctcagcctcccgagtagctgggattacaggcatgcagctccacgcccagctaattttttatttttagtagagacaagatttcacgatgttggccaggctggtcttcaacttctgaccttaggtgatccacccaccttggcctcccaaagtgctgggaatacagtcatgaatcaccatgcccggcccagctgtcgccttcttttcatatgtagttcacttcactgcttggtccatgtaggcaatttgagtttctagtttctgccttggtgctaatgcaaatgtactcaga

SEQ ID NO: 176103 - DNA, 601 bp, Human
ttttgagacggagtttcacttttgttgcccaggctggagtacaatggcatgatctcggctcactgcaacaaaatctgcctcccaggttcaagcgattctgtgattctcctgcctcagcctcccaagcagctgggattataggcgcccaccatcaagcccagctaattttttctacttagtagagatggggttccaccatgttgatcagactggtctgtaacttgtgacctcaggtgatccacctgccttggcctcccaatgtggtgggattacaggcgtgagccaccacacccagctgcccttagttttttgagacagagtcttgtgctgtcgcccaggctggggtgtagtggcacagtctcggctcactgcaacctctgcctcccaggttctaaaaattctcctgcctcagcctcccgagtagctgggattacaggcatgcagctccacgcccagctaattttttatttttagtagagacaagatttcacgatgttggccaggctggtcttcaacttctgaccttaggtgatccacccaccttggcctcccaaagtgctgggaatacagtcatgaatcaccatgcccggcccagctgtcg

SEQ ID NO: 176104 - DNA, 601 bp, Human
atccaacccccaaatgcttcaccaactatttaaatctccttttaagaggttcaaaagcattagacagtctatcaaaatttaaactacccaaagaaatctccctggagccttctgacctgctcaaatctgggctggtttgtctggtgtgcactgctgtcatcctgggatctttcttcatcaccatcctgggtacccctttcacgtctgtcctctactggtgctcctatatcgcgtttttatcttttttgattactcccttattttggtggaacacatcttccagtagcttcctgagaaaggstgcatgggaggtatgtgtttttgagaccttgcagcctgtagatatctttattctaccctcatccttggatttataattcggctgaatagagaatctgcaggaaagcttggaatgtgttttcctgcagaatgttgaaggcattgctccattgcctgctagctgctggtgttgttgagagtccaaggcaattctgactttttgtatgtgacttttttttcctctctctgaaaactcataggatctctgtttccagtgttctgaaatctcaggatgactgtgctttgggtgggtcactttcat

SEQ ID NO: 176105 - DNA, 601 bp, Human
ctctgatttttttttcttccttcacaactttgttttacctggagttaatgtcttgtccttttgtttaattttctatgtataattcttataactaatccaacccccaaatgcttcaccaactatttaaatctccttttaagaggttcaaaagcattagacagtctatcaaaatttaaactacccaaagaaatctccctggagccttctgacctgctcaaatctgggctggtttgtctggtgtgcactgctgtcatcctgggatctttcttcatcaccatcctgggtacccctttcacgtctstcctctactggtgctcctatatcgcgtttttatcttttttgattactcccttattttggtggaacacatcttccagtagcttcctgagaaagggtgcatgggaggtatgtgtttttgagaccttgcagcctgtagatatctttattctaccctcatccttggatttataattcggctgaatagagaatctgcaggaaagcttggaatgtgttttcctgcagaatgttgaaggcattgctccattgcctgctagctgctggtgttgttgagagtccaaggcaattctgactttttgtatgt

SEQ ID NO: 176106 - DNA, 601 bp, Human
aagttgggccatttctcattaacaataagttggagcccagtgctcaatcaacctggctcaaaacaccctgatagtccattctgggatcaccctgtaaatcagaaatcatcccacctactctagacaaatgggagatcctggctagtttacctttttctattcctgtgattttaattgcttgctctaaactagggaagtaatctcccaaaataatagcttgaatgtgctacatactatactacgtgcacttaaaaatattacattgaggctgggcgtggtggctcatgcctgtaatcccagmactttgggaggccaaggtgggaggatcacctgaggtcgggagttcaagaccagcctgaccaacatggataaaccctgtctctattaaaaatacaaaattagccgggcatggtggcgcatgcctgtaatcccagctactcgggaggctgaggcaggagaattgcttgaacccgggaggcagaggttgcgatgagccgagatcgcaacattgcactccagcctgggcaacaagagtgaaactccgtgtcaaaaaaataaataaataaataaataaattacattggctgggcgtggtggctca

SEQ ID NO: 176107 - DNA, 601 bp, Human; identical to SEQ ID NO: 18503

SEQ ID NO: 176108 - DNA, 601 bp, Human; identical to SEQ ID NO: 18504

SEQ ID NO: 176109 - DNA, 601 bp, Human; identical to SEQ ID NO: 18505

SEQ ID NO: 176110 - DNA, 601 bp, Human; identical to SEQ ID NO: 18506

SEQ ID NO: 176111 - DNA, 601 bp, Human; identical to SEQ ID NO: 18507

SEQ ID NO: 176112 - DNA, 601 bp, Human; identical to SEQ ID NO: 18508

SEQ ID NO: 176113 - DNA, 601 bp, Human; identical to SEQ ID NO: 18509

SEQ ID NO: 176114 - DNA, 601 bp, Human; identical to SEQ ID NO: 18510

SEQ ID NO: 176115 - DNA, 601 bp, Human; identical to SEQ ID NO: 18511

SEQ ID NO: 176116 - DNA, 601 bp, Human; identical to SEQ ID NO: 18512

SEQ ID NO: 176117 - DNA, 601 bp, Human; identical to SEQ ID NO: 18513

SEQ ID NO: 176118 - DNA, 601 bp, Human; identical to SEQ ID NO: 18514

SEQ ID NO: 176119 - DNA, 601 bp, Human; identical to SEQ ID NO: 18515

SEQ ID NO: 176120 - DNA, 601 bp, Human; identical to SEQ ID NO: 18516

SEQ ID NO: 176121 - DNA, 601 bp, Human; identical to SEQ ID NO: 18517

SEQ ID NO: 176122 - DNA, 601 bp, Human; identical to SEQ ID NO: 18518

SEQ ID NO: 176123 - DNA, 601 bp, Human
tgagaggccaaggtgggaggattgcttgagtccaggagttcgagatcagcctgggcaacatagtgagactctgtctctacaaaaataaaaaaaattacaaaaaatatataaaatgtttgcagatgttccagccattctcgtgattgttatggaggtggaggtgataagcccagggaggctgctgtagcagctggtgattgtgttgaactcttttgacttagaggagaggaaggtaggcatgaacacttctgtggacacagagctttttcagggacaaaaggaagtgttttttttttttttyccaaaggaattgtagaaactagatgtggcagaatgcctcccaagtgtcacatggggtcagtatggctgacttttcctcaatactctcagcttcccagacatagtggaaactgaccaactaggagccaggatactcaagttcactactggctttcacatggttcaaatcatggaacattgggtaacttccctcagcctccagtttactcaactttaacataggtacactcttatctattctaatgactcccccatggttgtggtgaggatacgcagaggtgaatctgaaagctgtttatgg

SEQ ID NO: 176124 - DNA, 601 bp, Human
ggaggattgcttgagtccaggagttcgagatcagcctgggcaacatagtgagactctgtctctacaaaaataaaaaaaattacaaaaaatatataaaatgtttgcagatgttccagccattctcgtgattgttatggaggtggaggtgataagcccagggaggctgctgtagcagctggtgattgtgttgaactcttttgacttagaggagaggaaggtaggcatgaacacttctgtggacacagagctttttcagggacaaaaggaagtgtttttttttttttttccaaaggaattgtaraaactagatgtggcagaatgcctcccaagtgtcacatggggtcagtatggctgacttttcctcaatactctcagcttcccagacatagtggaaactgaccaactaggagccaggatactcaagttcactactggctttcacatggttcaaatcatggaacattgggtaacttccctcagcctccagtttactcaactttaacataggtacactcttatctattctaatgactcccccatggttgtggtgaggatacgcagaggtgaatctgaaagctgtttatggactctaggattaaaa

SEQ ID NO: 176125 - DNA, 601 bp, Human
accgacagcatcactgaatgattgaattggaatggcccttgagggagcccaacctttctgttttacagatgaggatcggagagggtgaccagaagtcattcagatgaatcagtcccagagctgggacaagaatcaaggtcttatgatgccaaagccaatgctctttccactattctacctttcccactccccaagacacttgcctttctgggaatactccctccatggtccttactatcattgcattgttgtgacagtgtcctggtggtgctgaattcctttgctctttttttttttttttaagttggtgcttttctttagatcatttgacaaaatcaccttgactagttgtcaacagccttcacctgaacacttccagtagaaactctcccaagtggctttatttcaatctctggacagctctgacagagaggatattccttttggctctgggctcagacgcgatgtcctggaacttctctcattttgtctggttgtgtcctatgtgggccacaccaagcatcatgtctgtcccactttacatttcagaagacaacaggccacacttgaggcttctctcctccaggcccaacatcctcag

SEQ ID NO: 176126 - DNA, 601 bp, Human
caatctctggacagctctgacagagaggatattccttttggctctgggctcagacgcgatgtcctggaacttctctcattttgtctggttgtgtcctatgtgggccacaccaagcatcatgtctgtcccactttacatttcagaagacaacaggccacacttgaggcttctctcctccaggcccaacatcctcagtttcttaagttgttcctcatctggacagaggcctaaagttcttcctttctgctcaatgatatttgtattccatggagatagaacccaagtaaaccccaaaccaaarcattgtgggtcagtaattgtccttcttttaccccagcagcttggagttgggagttcattctcttgtagttgtagagtggacaggtgaatgtaacactgttgtttacaaagtggtgtctggaactttaaagttttcctttgagcctcttgtgctcacagaacaatgattttctgtgcacaaggcattatgcccaaagcattatgtgaaattaaaaatttgtaatatggtaacacaaagtaaaaaaaaattgtaatggctgtgaacaaggcataagtgaagtcatctgggtgttcacagact

SEQ ID NO: 176127 - DNA, 601 bp, Human
gcgggcagatcacctgagatcaggagttcaagatcagcctggacaacatggcaaaaccctgtctctacaaaaattagccaggcgtggtggtgtgtgcctgtactcccatctactcgggaggctgaggcatgagaattgcttgaacctaggaggcagaggttgcagtgagctgagactgcactactgcactccagcctgggcaacagaatgagactccatgtaaaaaaaaaaaaaaaaaaaaggtgccacctctgacagggttaagtcactatcagctactaacattattagcaagtgttcrctgagagaagccaataacacagaagaagagggaagatggccaggggccaggaacagaggcactgaccccattttctgctggaggactggccctgggcttgagctggaccagaaataatccgaaggcttagaggcaacatcccaagggatctgtgggaggagctggtcatcgtatattgaagattcatgtcatttttctcctcatgaaccctcagtggctccctactgcctatgcaataaagcctgcactttttagcctggcatttgtgagtgggtgttctgccccacttctcaccactct

SEQ ID NO: 176128 - DNA, 601 bp, Human
tgtgcacctgtagtcctagctacttggaaggctgaggtgggaggatcgcttgatctgggaaggtgaaggctacagtgagccatgattgcattactgccttccagcctgggggacagagtgagaccctgtttcaaacaacaacaacaacaacaaaaaccccaaaaaacaaaaacaacaacaacaaaaatcccaaacccaacaacaacaaaacaacaacaaaatagttgacaaactttttctgtaaagggccagattctaaatatttctagctttgctgctatgcaatctctgtcacaactaytccactctgctgttgtaacacaaaaacatccaaggaaaatggatgaatgaatggatgtggctgactttatttgcaaaaataggtggagggccagatttcttgttttgaggacacacacagacagtctcagaacagagcctggcacacattaaaccctcaggtttagctcttgttcttctttgcaactgaaacctattgaaggactgtcatatcacttatctgattgaatcctcaatgatctagtgaggtaagtagagtgaagatgatgattaaccccatgggttgcccacgtttacacaa

SEQ ID NO: 176129 - DNA, 601 bp, Human
ggactacaggtgcgtgccaccacgcctggctaatttttgatttttagtagaggtgaggtctcgctatgttgcgcagcctggtctcgaactcccgagctcaagcagtcttccccctttggcctcccaaagtgctgggacgataggtgtgagctaccatgcctgaccagtctgtgttttaagtcctccaggtgattctgattagggttgccagatttcacaaataaaaatacaggatgcccagttaaatctgaatttcaggcaaacaatacataccttcctgtctttttttttttttttttttagcataagtatgtcccatgcaatattcgggacatacttatgctacaaatgtataatgaatatattatctgtgaatctgcatattcaagataggcagacttaactgtatatctcgtgttctgattatgttaaagtttaaggaccactattggaggatatcccaagggaggagtccagcacagcctagagaaggcatggagaagacgccctgggatctcccgatatcccttaaagagaaggacaaaagcagggagcaggaagccatctccagaattctggacactctgggtcttagatggtt

SEQ ID NO: 176130 - DNA, 601 bp, Human
ggccccacccttatgagctcatttaaccttattatctccctaaaagccctatctccaaataccatcaccttgggggttggggctttaacataggaattttgcagagaggacacaattctgtctataacagtatccattgtagcttttgctaagtgtctttgagggtgaagtaattatcctcttgggaggagaaaggagggaagggacactgattgagaatcagctgtgtcagtcacaactggttcattatttcatttgactcctgcaccaaccctgccatgagagaagacggaggcttgcrgatgttctaatcacccagagagtaagaggtcaagaaaacattcaaacttgagttgtaaagctcatgctgtctctgcacttgagggaactttaccttgaaaccttgctatattcctaagacagtttttaggcctgtagctgtcaggaagaccacctgacaggcccttttgggtgtccaggaaagtctctgaataggtcagtgttatgatcagagttgtgctttagggaggttgcttggccatgtgggtgggtggggaggtgactgatggaaaggagagaatagagatcctctagcagcccg

SEQ ID NO: 176131 - DNA, 601 bp, Human
gtactgggattagaagcatgagccaccacacccagcctaaatgactctattttaaaatgttaagatcacaaatcattatcatatatcaaccttctttttgcttctcaactgtgcatacctgtgtcagggggtctttgcttaggtggaatgctattcctgtggtctctgaatgattaacttttttgtcatttagatctcagcttaaaggtctgaattataatagtaattctttaatattagagaaagtccatagagtcaccttctcagactcttcaatctaatcactctgtcataccctctrttctcttcatagcacttaccactctcggatcattgtttttgttgtttatttatttatgtttacagtatttgaatataagcttcttgagagtagggattttgtctgtgttattcacagctgttattagtgcttaacacgtgtagtagatgctaagttaatatttgttgagcaaatgtattaatgcacctgcaccaaccactgtctcctcattgtcattctgagaacttcttctggctaagccttcagaaatctccctctcccctgacttaatatttggcactaagcaccagctgccttata

SEQ ID NO: 176132 - DNA, 601 bp, Human
ccacgcccctcctcatttgaccaaatgactaaggtccagaggcttcctttgaaatgatttctctcaagaaaattgtcagtgtttactgagagcctgtattgggcaagaccctaagccaccaggcatgctgggggatatggagatcaagggctcatgctcctaggcacacagccttgaaggagatttttagggaggcctggtggctgtgggacttcccatatcttcttcaggattggacacggggcccacaaaagactcacagatgatctggttttgggatacatcccactgctccttctcyaatcctctccttttcatctttactgttttccaagtttccacatctgccttctgaaccagctgtccctgatgattccagcacagttttctcccagcccacctctgctctttcttgtccttctcttggctgacatgtctcctctctctttgacccactctgagtgtcctgggagagcacagagccctcacctgactttcttttgcgtttccagattggagcctccctctttgctagtaacattggaagtggccactttgtggggctggccgggactggggcagcttcaggcatcgccattgg

SEQ ID NO: 176133 - DNA, 601 bp, Human
ccatggtgcactggggctggaaggagccttagcagtcaaccagttcaatctatgctcagaggagctgaagatgttagggaacccttcagggtcaccccagggtgcagacagaggaggggcatgacttcaggagcctcagggccctgctccctttccaccagagtagcatgagaaaaccactggtatgacagcaatagtattttttctgttttctcttcatgttaaaaagccaaggcccttctagccatgtttgaggtttggaaatgcttaccaccagatttccattattattattattatattttttaaaaaaatttttattattttatttttagagacaaggtcttgctccactgctcaggctggagtgcagtggtgcaatcatagcctactgcagcctcaaactcctgggctcaagcgatgttcccacctcactctcccaagtagctgggactacaggcatgtgccaccatgcttggcgaattttttaattttttgtagaagcagggcctcactatattgcccaggcttgtcttgaactcctggcctctaataataatagtagtcgtcataataaatgtaattattaattattattatt

SEQ ID NO: 176134 - DNA, 601 bp, Human
gcactggggctggaaggagccttagcagtcaaccagttcaatctatgctcagaggagctgaagatgttagggaacccttcagggtcaccccagggtgcagacagaggaggggcatgacttcaggagcctcagggccctgctccctttccaccagagtagcatgagaaaaccactggtatgacagcaatagtattttttctgttttctcttcatgttaaaaagccaaggcccttctagccatgtttgaggtttggaaatgcttaccaccagatttccattattattattattattttttttwaaaaaatttttattattttatttttagagacaaggtcttgctccactgctcaggctggagtgcagtggtgcaatcatagcctactgcagcctcaaactcctgggctcaagcgatgttcccacctcactctcccaagtagctgggactacaggcatgtgccaccatgcttggcgaattttttaattttttgtagaagcagggcctcactatattgcccaggcttgtcttgaactcctggcctctaataataatagtagtcgtcataataaatgtaattattaattattattattgttatta

SEQ ID NO: 176135 - DNA, 601 bp, Human
gggctggaaggagccttagcagtcaaccagttcaatctatgctcagaggagctgaagatgttagggaacccttcagggtcaccccagggtgcagacagaggaggggcatgacttcaggagcctcagggccctgctccctttccaccagagtagcatgagaaaaccactggtatgacagcaatagtattttttctgttttctcttcatgttaaaaagccaaggcccttctagccatgtttgaggtttggaaatgcttaccaccagatttccattattattattattattttttttaaaaaaatttttattattttatttttagagacaaggtcttgctccactgctcaggctggagtgcagtggtgcaatcatagcctactgcagcctcaaactcctgggctcaagcgatgttcccacctcactctcccaagtagctgggactacaggcatgtgccaccatgcttggcgaattttttaattttttgtagaagcagggcctcactatattgcccaggcttgtcttgaactcctggcctctaataataatagtagtcgtcataataaatgtaattattaattattattattgttattattaaag

SEQ ID NO: 176136 - DNA, 601 bp, Human
ttaccaccagatttccattattattattattattttttttaaaaaaatttttattattttatttttagagacaaggtcttgctccactgctcaggctggagtgcagtggtgcaatcatagcctactgcagcctcaaactcctgggctcaagcgatgttcccacctcactctcccaagtagctgggactacaggcatgtgccaccatgcttggcgaattttttaattttttgtagaagcagggcctcactatattgcccaggcttgtcttgaactcctggcctctaataataatagtagtcrtcataataaatgtaattattaattattattattgttattattaaagctctctaaatggcattttactctgtgtaaaccagggaagaggtgaaggagaacccagtgctctagctgtggcccactgctgtgatgttgatgagcagcctcctgggctcctctctgctgttttctagctgctatttccatgggtcagttaggcagcaaaggcctcctgcagtctctaacggctccttaggggagaacatgctgggtaatttttctgcagcagctgaggggcccttcaggtggcagggatgggct

SEQ ID NO: 176137 - DNA, 601 bp, Human
atttatctgaaaacacaaagtgttcttgaaatgtaagatataatgataacgaggctgggtgcggtggctcatgcctgtaatcccagcactttgggaggctgaggcatgaggattgcgtgagaccaggagtttaagatcagcctggacaacatggcaagaccctatatctacaaaaaataaaaaatattagccaggcatggtggtgtgcacctgttgtcacagttactcaggaggctgaggcgggaggatcacttgatcccaggaattcaaggttgtgagctatgattgcaccactgcactscagcctgggtgacatagtgagatcctgtcactaaataaataaataaatgaatgaagatataatgataacgaacatggttaactgagagccttcagcactctctgcaagaagctctctgggttgcagtagggcagagagagaggtggtgttttctgagaccacatagggagtagctccagcttttccccttagccagcagttgcaaagtgctcattgctctatcaaaatggtgatctcgttgcctatgatcagtttttctctctcttgttgttctcccctatccagcaccaaaggcgagat

SEQ ID NO: 176138 - DNA, 601 bp, Human
ccctatatctacaaaaaataaaaaatattagccaggcatggtggtgtgcacctgttgtcacagttactcaggaggctgaggcgggaggatcacttgatcccaggaattcaaggttgtgagctatgattgcaccactgcactccagcctgggtgacatagtgagatcctgtcactaaataaataaataaatgaatgaagatataatgataacgaacatggttaactgagagccttcagcactctctgcaagaagctctctgggttgcagtagggcagagagagaggtggtgttttctgagaycacatagggagtagctccagcttttccccttagccagcagttgcaaagtgctcattgctctatcaaaatggtgatctcgttgcctatgatcagtttttctctctcttgttgttctcccctatccagcaccaaaggcgagattggtccaatctcagtatcttgcaaaagatctgccctgggtgagatgtgagttggattggatctgaattgagccatctactctagctaggtagggttctgaaaatacagttgctagtgtttctattttcctgattacttaaagttgagacaacagcaaca

SEQ ID NO: 176139 - DNA, 601 bp, Human
gatcacttgatcccaggaattcaaggttgtgagctatgattgcaccactgcactccagcctgggtgacatagtgagatcctgtcactaaataaataaataaatgaatgaagatataatgataacgaacatggttaactgagagccttcagcactctctgcaagaagctctctgggttgcagtagggcagagagagaggtggtgttttctgagaccacatagggagtagctccagcttttccccttagccagcagttgcaaagtgctcattgctctatcaaaatggtgatctcgttgcctaygatcagtttttctctctcttgttgttctcccctatccagcaccaaaggcgagattggtccaatctcagtatcttgcaaaagatctgccctgggtgagatgtgagttggattggatctgaattgagccatctactctagctaggtagggttctgaaaatacagttgctagtgtttctattttcctgattacttaaagttgagacaacagcaacattaaataacatttgcattttttttattacggaaaatttcaaacatatataagcaaagatagaataggataacaagcactcacggacc

SEQ ID NO: 176140 - DNA, 601 bp, Human
ttggtgtacagattattttgtcacccaggtaataagcataatacctgatagttttttgttcctcacccttctcccatcctccaccctcaagtacgccccagtgtctattgttcccttccttgtgtccatgtgtactcagtgtttaggtctcacttataagtgagaaaacatgcagtatttggttttctgttcctgcattaattcaattaggataatggcttccagctccatccatggtgctgcaaaggatgtaatctcattcttttttatggctgcatagtattacggtgtatatgtgccrcattttctttattcagtccaccactgatgggcatttaggttgatttcatatctttactactgtgaataacgctcagcagtattttaaatcaaatctcagatcccatgtgatttcactgtaaattcttcagaatgtacctttgacttttaaaaaatataaccattgtgctattatcatatctaacaaaatttacagtaatttcttaatttaggtagtttaatacctggcccatatcaagattttcctaataaactcaaaaatgttttcttacagttagtttgtttgaatcaggatctgaac

SEQ ID NO: 176141 - DNA, 601 bp, Human
gtacagggcattgtaggtgcagagcccagatgtggcccaggccattggcagctgtgatgtggagcgttggctatggctaccatcttttggtcacgtatttttgggctctgagactcagaactgattgtccttccatgagctcctgaattttattggctccctcgagcacctgccttatcaagctctgagaagcattccattctgtaaaatttcccggcatgtgcatcttatgcaaatgtgcacaatccctggagataaagcctcagattttatgacttacatgtgatgactgaatgttcaygtccccatttgtgtttcctagggctgttatcacagatcacagctacagtaaatgtttacagcaattctgctgtccattttggatccttgggtgaaaagaagagcttttgcttttgcttaagatttgaatgctcattcccagggccactcactttcacaagtggaaagagaaatttgagtaatggggcttcaccatctgaaactgcgaggctaggcaggatttatcgaatgctcaaatacatcttggttacgaccagaatggacagcaaacacacacatataaaatcactggatctcaaaa

SEQ ID NO: 176142 - DNA, 601 bp, Human
aatttgagtaatggggcttcaccatctgaaactgcgaggctaggcaggatttatcgaatgctcaaatacatcttggttacgaccagaatggacagcaaacacacacatataaaatcactggatctcaaaacatcagagccaaggcgaagcaacatgcccaagctcccaatcagagactcagttacttgcagatgctttccaacgggggtctgtatttttattccccatgaattccatggacatcgttcagccaaattttcaacgtgatgggaacaacacccctgggctaaatccaacacamgatctatttttgtaagtaaagttttactggagcccagccaagcccattgtttgtgttgtctgtggctgcttttatgctttaacaacagagtgtgacagagacagtaaatgcaaagcataaaacatttactcccgggccctttacagagaaagtttgcaaattcttgatctagaggaccataattttttatttcacttcaagttggttttgcttagcagcattggagaaattttcttctttcccttctgcctcccctttccctctttccttccttctttccttccttccttccctccctcc

SEQ ID NO: 176143 - DNA, 601 bp, Human
cagccaaattttcaacgtgatgggaacaacacccctgggctaaatccaacacacgatctatttttgtaagtaaagttttactggagcccagccaagcccattgtttgtgttgtctgtggctgcttttatgctttaacaacagagtgtgacagagacagtaaatgcaaagcataaaacatttactcccgggccctttacagagaaagtttgcaaattcttgatctagaggaccataattttttatttcacttcaagttggttttgcttagcagcattggagaaattttcttctttcccttcygcctcccctttccctctttccttccttctttccttccttccttccctccctcccttccttcactccctccttctctcctttctttctctctccctctgttaccttccctttctttccttccttccctcccccttcctctctcccccttttttcactttcttcctttccccttcttccttcctttcgttctctctttccttctctcccttccctttcctttccctccctccatccttccccctactctcttttaagggctaacattaatttagggaaagagcaatctgggataagctgtga

SEQ ID NO: 176144 - DNA, 601 bp, Human
tatgcgcatcattttgttgtcttctccccacccctaccatcaaattgtaaatgttccagtttcagttttcataattattatttttaggggctgcagaacataactgttgacatataatttttagaaagccatttaaaaatcctctggtggacaaaaatctcttgacagtggtcacttctgggctacttttacttttcagtgtgtaacttctgcggttatttatttattcaatttttatttgtttttctttttttttgagcaaaactctatcacccaggctggagtacagtggcacaatctyggctcactgcaacctctgcctcccaggttcaagcaattctcctgcctcggcctcccagttagctgagattacaggcatgcgccaccacacctggctaatttttgtatttttagtagagacagggttttaccatgttggccaggctggtgtctcaaactcctgacctcaagtgatctgcttgcctcagcctcccaaagtgctgggattacaggcataagccactgtgcctggcctgtggtgtttattttaaccccccacacatacattattttatttgagattttattttaaaagtaaatt

SEQ ID NO: 176145 - DNA, 601 bp, Human
agggacaggcaggtatggtgggaaacttaaacactggagggccctcaggagcagcaatgggatggggactgggaaacggaactagagaggagatgcaagatataagaggagatgtgagaagtaagagtccaaccctgctggcccatccccaaggctccgtctgggtgctgtttgcgtgccgtgaaatgttagggtttgtgcagtgaaaacagttcgtgcattcattccatctagggaagtccagtttcgtccacacctggagatttgaaaacaaaagactcagctgggcgcagtggctcasgcctgtaatcccagcactttgggagtccaaggcaggcagatcacgaggtcaggagttcgagaccagcctgaccaacatggtgaaatcctgtctctactaaaaatacaaaaattagctgggtgtggtggtgcacacatgtaatcccagctactcaggaggctgaggcaggagaatcgcttgaacccaggaggcagaggttgcagtgagttgagatcgcaccactgcactctagcccgggcgacagagtgagactctgtcaaaaaataaataaataaaaaagactcaccatgatcatccctt

SEQ ID NO: 176146 - DNA, 601 bp, Human
caggcaggtatggtgggaaacttaaacactggagggccctcaggagcagcaatgggatggggactgggaaacggaactagagaggagatgcaagatataagaggagatgtgagaagtaagagtccaaccctgctggcccatccccaaggctccgtctgggtgctgtttgcgtgccgtgaaatgttagggtttgtgcagtgaaaacagttcgtgcattcattccatctagggaagtccagtttcgtccacacctggagatttgaaaacaaaagactcagctgggcgcagtggctcacgcctrtaatcccagcactttgggagtccaaggcaggcagatcacgaggtcaggagttcgagaccagcctgaccaacatggtgaaatcctgtctctactaaaaatacaaaaattagctgggtgtggtggtgcacacatgtaatcccagctactcaggaggctgaggcaggagaatcgcttgaacccaggaggcagaggttgcagtgagttgagatcgcaccactgcactctagcccgggcgacagagtgagactctgtcaaaaaataaataaataaaaaagactcaccatgatcatcccttaatac

SEQ ID NO: 176147 - DNA, 601 bp, Human
tgttcatcatggtgatgccaggaatgatcagccgcattctgtacacaggtaataacttctgctggacccacaaaccactctccctttttctgtctccaagtcacttctaaagctctatagcttcccgcttcctcctctttttttttgagaccaggtctcactctgtcacccaggctggagtgcagtggtgtgatcattgctcactgcagtctccaactctaactcctgggccctagtgaccttcctgcttcagcctcctgagcagctgggactacaggtatgtaccaccatgcctgcctaatttttaatttttttttttgtagcgatgggattttgctatgttgctcaggctggtcttgaactcctggcctcaagtgatcctcctgccttggccttccaaagtgctgggattataggcataagccaccacgcctggccctcttctttatttgttatggtcatatccaagcattattgctcctgtgctagacagtgagcaacttgagggaacttttggagttgtcttccctggtttcttatgtcgacaattgtttcctccttttttttttttttttttttcaaatcttctaaagttatgaca

SEQ ID NO: 176148 - DNA, 601 bp, Human
aattatgtcatttatgacaacataaatgaacctggagaacattatgtttagtgaaatactttagactcaaacaaataccacatattgtcacttacatgtagagccttaaaaagtcaaatttgtagaagcagagagtagaatggtggttactaggggttggggtggggatctgggaagatgttggtcaatggatacaaaatttcagttaagaggaataagttcaagagatctattgtacaacatagtgactatagttaatagcaacgtattgtatacttgaaaattgccaagagtagatttyaactgttctcaccacaaaaaatgttaagtatttaaggtaatgcatatatttgctaattagctcaattgagctaatgtatagatatttcaagacatcatattatataccctcaatatacataacttttacttgccaattaaaaaatatttttaaaaagctctccaacagatgttaaaatgaaggcttgaactaggtccaaggggttttacctggagaatgaattgacttttatgctcttccaaggaaacacatggggaaagaggcaagatttcagctctagaatgagaaagtctgaggcag

SEQ ID NO: 176149 - DNA, 601 bp, Human
aactagcctactgagctgggctgcttattcataaggttacaattagcaggagtcacagtgactcttctagaaaagttctggcatggattgcattggcctctgtggagtgtttatgttattcctttaggtgggcagaccctcctagtgaggactaaacattatgcgggagtggactgtgcacaacagaaagatgtgtggcatgcagaataaaatgccgtgcttccctgtgccattgctagtccctcctcttggctgtaatctggcttcagtaaatactgcattcctttttttttttttttttgagatggagtcttgctcttatcacccatgctggagtgcaatggcgtgatctcagctcactgcaacctccacctccccagttcaagcaattctcctgccttagcctctgtagtagctgggattacaggcacctgccaccacgcccagctaatttttttgtatttttagtacagacggggtttcaccacattggccacgctggtctcaaactcctgacctcaggtgatccactcgcctcagcctcccaaagtgctgggattacaggtgtgagtcaccatgcccagcctactgtattccttaa

SEQ ID NO: 176150 - DNA, 601 bp, Human
agtgtctattcagatcctttggcattttaaattgggttgtcattttattattgaattttaggagttctttatatgttcttatattagacccttatcagatacatgatttgcacgtattttctcccagtctgtggatggcttactttcttgagagccccatcttttgaataatagtttaaatctctttctgttatatcataaatatttcaggtgagagaccttataaaaatcccctcagatggaaacacacatacacaaacacacacacacacacacacacacacacacacacacacacaccccccaccaccttcatcatcgtccagttgcaaagtattcacctcaagtatgttgtgtctctggctctttgtggctgctgtgggcttataatgggctaataaatttaaagccataggactacttcttaaagcttctagtctttttggagacagaaattggataacatggcatggtttcagaaggcaaacaaatcttgagtcctcatatatttttcaagtacaaaagagctgaaggtgctgttatgtgccactcaaaaatccttctcttccaggactgcgaggcctgatgctatcagtcatgc

SEQ ID NO: 176151 - DNA, 601 bp, Human
tggtctgttcagggtatctaattcttcctgatttaagctaggagggttgtatctctccaggaatttatccatctcctctaggttttctggtttatgcacataaaggtgttcatagtagccttgaattatcttttgtatttctgtggtgtcagttgtaatatcttctgtttcatttctaattgtgcttatttggattttctctcatcttttcttggttaatcttgctaatggtctatcaattttatttatcttttcaaagaaccaactttttgtttcatttatcttttgtattttttttttkgtttcactttcttttagttctgccctgatcttggttatttcctttcttctgctgggcttgggtttggtttgttcttgttcctctagttccttgaggtgtgaccttagattgtctattgtgctctttcagactttttgatgtaggcatttagggctatgaactttcctcttaacaccacctttgctgtatcccagaggttttgataggttgtgtcactattatctttcagttcaaaaaattttaaaatttccatcttgatttcattgttgacccaatgatcattcaggagcaggttattta

SEQ ID NO: 176152 - DNA, 601 bp, Human
aaagttaacccaaggtcatatttattcctagaaaacagaaggattttgttaatcctttactttactcatgcatgcacagactatggaatccctaagagaccttcaacttcattgccaaatttttaagagctgtgacaaacctaacgtcaaacaaagactgcttttatggcagcagaactgaatcacatctatttgctggacctgtcacaggctttctttgtgttgtatcaactgcttcctcatgtctcaagtctttgaaagtattacaacccaaacacatttctagttgatgccctagacygagttcatgctctagatcaagtatttggttcatgctcttgactatgtcaatagaaactgtgccttcagctctaccatattctattatggctcatgattctagcttcttatccacataatgtgacatagtgcaaaaatctgaacttacactcctaacctggacaaatggttgtcttgttgcttcctactgccagtgctaaaaggaacaaattatttatcacacacacacgtaaaagagttcattcaacaaacatttccatatgaggcaatcttttagctctgaatatgcatatatcataga

SEQ ID NO: 176153 - DNA, 601 bp, Human
cactcctaacctggacaaatggttgtcttgttgcttcctactgccagtgctaaaaggaacaaattatttatcacacacacacgtaaaagagttcattcaacaaacatttccatatgaggcaatcttttagctctgaatatgcatatatcatagaggctagtatatacatgtatattacttttatctaagttaccaatgtttttagagataatgttatggatgagaatcgttgtgtatgttcttcctggtactgagatgccacattcccttcccttccttgatgcatatctctttgcccccmcaacttcttgtcccaagatgctatttggatctttctgttgacctgttctgccttctctgcagctctaccgtctgtgttggagcctgcgcaacagcaaagaggagcgtattgacctggatgcggaagaggagaacatccaagaaggccctaaggagaccattgaaataggtgacttatgacccagagcagatcctaaaccataaaagttactcctacaacaacaagactttactgaagttcttccctaaataattttatcagagctcagatgtctcccctccagggcagtgaggagtaggg

SEQ ID NO: 176154 - DNA, 601 bp, Human
ttcttattttattttattttattttattttattttattttattttatgagagggattcttgctgttgcccaggctggagtgcagtggtgcaatctcggctcactgcaatctctgcctgctgggttcaagtgatttttctgccttagcttcctgagtagctgagatgacaggcacctgccaccatgcgcagctaatttttgtattttagtggagacgggggtttcaacatgttggtcaggctggtcttgaactcctgacctcaaatgatgcacccacctcgacctcccaaagtgctggaatyacaggcgtgaaccactgtgcccagccaagagttgtttttagtgtggttggcagagccagctcttcctcaccacaggttgcctccctaggttcctactttttgttactagctttattatagctacattattattattattgttattattattgagacagagtctcgctctgtcgcccaggctggtgtacagtgatgtgatcttggctcactgcaacctctgccccccgagttcaagcaattctcctgcttcagcccccctagtaggtgggactccaggcacctgccaccacgcccagctaa

SEQ ID NO: 176155 - DNA, 601 bp, Human
ccttagcttcctgagtagctgagatgacaggcacctgccaccatgcgcagctaatttttgtattttagtggagacgggggtttcaacatgttggtcaggctggtcttgaactcctgacctcaaatgatgcacccacctcgacctcccaaagtgctggaattacaggcgtgaaccactgtgcccagccaagagttgtttttagtgtggttggcagagccagctcttcctcaccacaggttgcctccctaggttcctactttttgttactagctttattatagctacattattattattattrttattattattgagacagagtctcgctctgtcgcccaggctggtgtacagtgatgtgatcttggctcactgcaacctctgccccccgagttcaagcaattctcctgcttcagcccccctagtaggtgggactccaggcacctgccaccacgcccagctaatttttgtatttttagtagaggcggggtttcaccttgttggccaggctggtctcaaactcctgacctcaggtgatccgcctgcctcggcctcccaaaatgttgggattacaggcatgagccaccgcgccctgcctatagct

SEQ ID NO: 176156 - DNA, 601 bp, Human
acaacgtaaaatagttgaaatttgttggtggaaagaagagcagtccactccagaggctggatgggcatgcctggcccccaaggtctgaagtggtagggctgtgcctatatcctgagaatgagatagactaggcaggcaccttgtgctgtagattccagctcctgcacatagctcttgttgtaaaacatccctgtgcttataccaagtaattgagttgacctttaaacacttgcctcttccctgggaaccatataggggattggcctggagacgtctggcctctggaagagttggaaagcarccatcattattatcctttcctttcagctataactcagagctctcaagtcttttctgtggatcttattgccttggttcttgccccttttactcccagggaagttgattctgtcttttctgttccatttagtatgacaggagcagagaatgtcagagctgtaagggaccttatagttaaagcctttggctggtcctttcattttatagctgggactaataagtaacgtcaaaacccaatgagttcacagattgggtctcgccttggcatgtaacccatatgttcatattcttgctgttttcc

SEQ ID NO: 176157 - DNA, 601 bp, Human
cctgtaatcctagcactctgggaggccgaggcagaaggatcgcttgagcccatgagcccaggagtttgagaccagcctggccaacatggcaaaactccacctctacaaaaaatacaaaaatattagccaggcgtgatggcacacacctgtagtcccagctacttgggaagctgaggagcgatgattacctgagcccagggatatcaaggctgtagtgagctgtgatcatgccactgtactccatccagctgggggacagagtgaaacccctgtctcaaaacaaaacaaatgaaaaaaaaaacccttaataatcagtaactgtcactttatattatgttgtgagtgtgtgtctatatacacctatatgtatacatttctcttattacacattcattggtgatctgatgtggagccccagggattaagggcaactttgaactaccctgacacaatcaagccaaatatcattcccgtggaggaagtagagtatctaggttctgtctcctagttgcagctttaccttgaggacagagactctaatccagctgtgctgaaggagcacatctcctgacttctgagctttcccctggtaaattcaaac

SEQ ID NO: 176158 - DNA, 601 bp, Human
cacattcattggtgatctgatgtggagccccagggattaagggcaactttgaactaccctgacacaatcaagccaaatatcattcccgtggaggaagtagagtatctaggttctgtctcctagttgcagctttaccttgaggacagagactctaatccagctgtgctgaaggagcacatctcctgacttctgagctttcccctggtaaattcaaactggatgtcacggcgccctcagatagagcctggtaatttgccctggggagagtgactgtcttttggatctaatttgacttttgccscagttggaggaaaatcttcagggctaggaaggattgtatttgtctgaccccagagataacctgggttttgaggaacatggggcatcaacctgaatggtcttgtaagatctctcccacgccagcttgccagtgtttctctgatgaatttagagtacctgagtagtgcaggcctgctgggaggaggactctccctctgtgctactcagagaaattcattcttcaaggcccccttccagccttgctcttacccagctgggctacagttacaataaaggaaatgacttttcttctccccttccc

SEQ ID NO: 176159 - DNA, 601 bp, Human
gccaggcgcggtggctcacacctatcatctcagcactttgggaggccgaggcaggcagatcatgaagtcaagagattgagaccatcctggccaacatggtgaaaccccatctctactaaaaatacaaaaattagctggtcgtggtggcgtgtgcctgtagtcccagctacttgggaggctgaggcaggagaatcacttgaacctgggaggcagaggttgcagtgagcccagatcacgccactgcactccagcctggtgacagagtaagactccatctcaaaaaaaaaaaaaaaaaaaaaaattccttaatttggcctacagtagagccctccgtaatgtggcctctctccacatctccacaacctcctgctccctgcacttcagcctcacctctcttctggacaggccctccttctgacaagggctttgttcattctgctccctctgcctagaatgcccccttactctgttcacttaactcctgcttatcgtttagatctttacctggatggctcagagaaatatagaagtaattcctcaccctgaaaaataggttaggtccctgttttatgttttcatagacctttcctttgaggctttt

SEQ ID NO: 176160 - DNA, 601 bp, Human
acttgggaggctgaggcaggagaatcacttgaacctgggaggcagaggttgcagtgagcccagatcacgccactgcactccagcctggtgacagagtaagactccatctcaaaaaaaaaaaaaaaaaaaaaaattccttaatttggcctacagtagagccctccgtaatgtggcctctctccacatctccacaacctcctgctccctgcacttcagcctcacctctcttctggacaggccctccttctgacaagggctttgttcattctgctccctctgcctagaatgcccccttactctkttcacttaactcctgcttatcgtttagatctttacctggatggctcagagaaatatagaagtaattcctcaccctgaaaaataggttaggtccctgttttatgttttcatagacctttcctttgaggctttttttaaaaaagtagttttaatctcacatttattcatgtgatcatctccttaatgatatcttaagacctctaatagaacaatttggtcatggactgtggggtttttgcccctcattgtgtcagcactgagcatattgttggcataggagggatatttgttgaatgaattg

SEQ ID NO: 176161 - DNA, 601 bp, Human
atttatgatggggagtggggtggataggttggcagttcccccaagaagttggaaatgaagtttgtcctctgtgagttgaactaattagatccacaagtaatgaaagcagtattgtgttgtagttaagagcacactctagaaccagattgcttagtttcaaatcctggttctgccttttattatctgtgtactttgggcaagttacttgccctttgtgtgcttcatttttctcatctagaaaatggagaggccaggcgtagtggctcatgcctataatcccagcactttgggaggccgaggygggcagatcacctgaggtgagaagttcaagaccagcctggccaacatggtgaaaccctgtctctacaaaaatacaaaaattagccaggcatgatggcgggtgcctgtaatcccagctacccaggagcctgaggcgggagaaacacttgaacctggaaggcagaggttgtagtgagccaggattgcaccactgcactccagcctgggtgacaagagctagactcagtctaaaaaaaaaaaaaaaaaacaaactggagatacaggctgggtgcagggcttacacttataatatcagcacttt

SEQ ID NO: 176162 - DNA, 601 bp, Human
aaaccccatctcaactgaaaatacaaaaattagccaggcatggtggcatgctcctgtagtcccagctactcacttggaggctgaggcacgagaatcgcttgaacccaggaggcggaggttgcagtgggccaacatcatgtcactgcactccagcctgggagacagagcgagactctgtctcaataaataaataaacataaaataaaataaaataaaataaaataaaataaaaaaatatggaggccagcaggcacggtggctcacgcatgtaatcccagcactttgggaggccgaggggggyggatcacaaggtcaggagatcgagaccatcctggctaacacagtgaaaccgcgtctctactaaaaatacacaaaattagccaggcatggtggcaggcacctgtagtccctgctactcaggaggctgaggcaggagaatggcgtgaacccgggaggcggagcttgcagtgagctgagatcgcgccactgcagtccagcctgggcgacagagcaagactctgtctcaaaaaaaaaaaaaaaaatggaggttgggcgcggtggctcgcgcctgtaatcccagcactttgggaggtcgaggcgg

SEQ ID NO: 176163 - DNA, 601 bp, Human
cagtggctcacacctgtaatcccagcactttgggaggccgaggtgggcagatcatttgaggtcaggagttcgagactagcctggccaacatggtgaaaccctgtctctgctaaaaaaaaaaaaaagtacaaaaattagccaggcatgatggcaggtccctgtaatcccagctacttgggaggccgaggcaggagaattgcttgaacccaggaggtggaggttgtagtgagccgagtttgtgccactgcacttcagcctgggtgacagagggagacactgtctcaaaaaaaaaaaaaaaaaaccaaaaccaatataataaataagtggccagcaatgaaacagaaagtgaaaagttagtgaagcaaaactagtactgtattcagataaagatgctgaatctagatttggtcaccagaatagggtcctttgtggcaacctgggctagtttggctgactcaccactgccaggatgaaatttctttcagtggctactcatttccctttattttaagtccatgctcacagagcaaccttctgatgcctaattcagcttcctgggatacttaataacaggaagggtctggaagtagtacctgtatag

SEQ ID NO: 176164 - DNA, 601 bp, Human
tgccatcagtagcactgactcttgcagaagcaccgtttctgaagttggctaatgtcatccctcacgtttgtttgtttgaaatttgttttagttccagagatagcactttcatggaatgacgctatcttctagaatcactttttttttttttttgagttggagtctcgctgtgtcgccaggctggagtgcagtggcacaatctcagctcactgcaatctccaccttccgggttcaagtgattcccctgcctcagcctcccgaggagctgttactacaggcgcacacccccactcctggctaattttatgtgttttagtagagacggggtttcaccgtgttggccaggatggtctcgatctcctgactttgtgatctgcctgcttcagcctcccaaagtgctgggattacaggtgtgagtcaccgcgcctggcctagaatcacctttttataccataacgtgagcaccactgccgcgtcaccaaggaaagagagaggcagctactgtggggttacaaatgggtaagagtggcaccaggaaggtgaaagtctctacttagccaaggcttaacaaaatgtcaatcaccaaacatttatttattaa

SEQ ID NO: 176165 - DNA, 601 bp, Human
gacccccatgatgagcaactatagcactagaacagtgataataactaatgtttataatgcatcttcagtttacagagggcttttgtactcatcatctagtttagttcctgcaacaacctcttgaggaatatagcacaagcaggacaagggaagcccagagatgttaaataatttatccaagtttatgctgctgggaagggcagcactgaaattaaaagaaaagttttctgagctcaaatcccatgccctttcctcaatgtgagctctagcaaggtattcaggaatcctgcctctacagttyagagcctcaaattgctgggtatgttgagttcttgtatctgatttttctagatttcctgcccacattcttactgtctggatatcaggaaagagtttatcaaatgcctgtggaaatccaagataaggtctcatgatgagtaacccagtgaaaacatgaagtcaagtctaactagtcactactatttcactactgctgactcctgatgatcagctccttttctaagtgcttactgtccacttattccatcatctgcctagaatttatgtgaaggaatcaaagcaaaaggatcataaggcttcc

SEQ ID NO: 176166 - DNA, 601 bp, Human
ggacccttgttttagaaggatgactgctgctataatgtagaaagtgatttggaagaggggaggagtggggcacgaaagatggttagtagatgggggtggtaatgcttacctttcagtatttggaggcttcggagtcctcaaaaattctcttccttgattggagtcctcccagccaatagagggcttcacacaaacagtttcttgggttttgaattgtttgaccagagctttcttccgacaaaaggttggggtgattcattcacttaccacaccttgcctgaacattcacttggggctgcckgttatgaaggctattgttctccagcctgtcacagacgctttgaagacctgtgcctcagctggttctaaggagtcagtttgttcagctccgtgccaggtttccaacttatgaaatgtgctggagattaacacctctcctgccattttatccctactataattgccagtcaaaggattcctgcagttgcctctggcagccataactgatgaatgttctgccagctgctctgaggacctagaagagcagttttctatccaggaccagtttccaagggtgggagggtgaaatatatcctccagt

SEQ ID NO: 176167 - DNA, 601 bp, Human
atgacacaattgagtggccacgacagtctgtatggcctgcagagcctaagatatttgctctctggccctttacagaaaaagtgccttgacctgtgctctagagccatatgtaccaggtttgaaactcagcctcacagctgggtgtgatggcacgcatctgtagtcccagctactctggaggctgaggtgagaggatcacttgagtccagaaggtcgaggtcaagattgtagtgagccatgatggcatcaccgcactccagcctgagtgacagagagagaccctgactcaaaaaaaaaaaamcaaaaaaaaaaaacaccctcaccacttatcagctatttgtcttgagaatagtgacataacccctcagaacctatttcctaatctgttaaatgaggctgatgacgtttcctccttttactggcaatttaaacatgatggataataaatgctaagcacttaacacagggcctagaagatattaactgctcaataaatggtagcttcttaacagtattcaaacccatgtgctcttatcacatgcattgttgtccctgtgtccagttggtggaatgggaaaaggctcccttgtaaccccatcta

SEQ ID NO: 176168 - DNA, 601 bp, Human
ctactctggaggctgaggtgagaggatcacttgagtccagaaggtcgaggtcaagattgtagtgagccatgatggcatcaccgcactccagcctgagtgacagagagagaccctgactcaaaaaaaaaaaaacaaaaaaaaaaaacaccctcaccacttatcagctatttgtcttgagaatagtgacataacccctcagaacctatttcctaatctgttaaatgaggctgatgacgtttcctccttttactggcaatttaaacatgatggataataaatgctaagcacttaacacagggcctagaagatattaactgctcaataaatggtagcttcttaacagtattcaaacccatgtgctcttatcacatgcattgttgtccctgtgtccagttggtggaatgggaaaaggctcccttgtaaccccatctaccatctttatcagactttcctgccatggttcacagtaagagatagaagctgcacggtgacttctggctctttacaatggtgagcggtgtgtgcctggtaagggagagctgatgtcactgccccaaatccagtagtgagatctgagtgttctggtttcctccagcagcct

SEQ ID NO: 176169 - DNA, 601 bp, Human; identical to SEQ ID NO: 38417

SEQ ID NO: 176170 - DNA, 601 bp, Human; identical to SEQ ID NO: 38418

SEQ ID NO: 176171 - DNA, 601 bp, Human; identical to SEQ ID NO: 38419

SEQ ID NO: 176172 - DNA, 601 bp, Human; identical to SEQ ID NO: 38420

SEQ ID NO: 176173 - DNA, 601 bp, Human; identical to SEQ ID NO: 38421

SEQ ID NO: 176174 - DNA, 601 bp, Human; identical to SEQ ID NO: 38422

SEQ ID NO: 176175 - DNA, 601 bp, Human; identical to SEQ ID NO: 38423

SEQ ID NO: 176176 - DNA, 601 bp, Human; identical to SEQ ID NO: 38424

SEQ ID NO: 176177 - DNA, 601 bp, Human; identical to SEQ ID NO: 38425

SEQ ID NO: 176178 - DNA, 601 bp, Human; identical to SEQ ID NO: 38426

SEQ ID NO: 176179 - DNA, 601 bp, Human; identical to SEQ ID NO: 32594

SEQ ID NO: 176180 - DNA, 601 bp, Human; identical to SEQ ID NO: 32595

SEQ ID NO: 176181 - DNA, 601 bp, Human; identical to SEQ ID NO: 32596

SEQ ID NO: 176182 - DNA, 601 bp, Human; identical to SEQ ID NO: 32597

SEQ ID NO: 176183 - DNA, 601 bp, Human; identical to SEQ ID NO: 32598

SEQ ID NO: 176184 - DNA, 601 bp, Human; identical to SEQ ID NO: 32599

SEQ ID NO: 176185 - DNA, 601 bp, Human; identical to SEQ ID NO: 32600

SEQ ID NO: 176186 - DNA, 601 bp, Human; identical to SEQ ID NO: 32601

SEQ ID NO: 176187 - DNA, 601 bp, Human; identical to SEQ ID NO: 32602

SEQ ID NO: 176188 - DNA, 601 bp, Human; identical to SEQ ID NO: 32603

SEQ ID NO: 176189 - DNA, 601 bp, Human; identical to SEQ ID NO: 32604

SEQ ID NO: 176190 - DNA, 601 bp, Human; identical to SEQ ID NO: 32605

SEQ ID NO: 176191 - DNA, 601 bp, Human; identical to SEQ ID NO: 32606

SEQ ID NO: 176192 - DNA, 601 bp, Human; identical to SEQ ID NO: 32607

SEQ ID NO: 176193 - DNA, 601 bp, Human; identical to SEQ ID NO: 32608

SEQ ID NO: 176194 - DNA, 601 bp, Human; identical to SEQ ID NO: 32609

SEQ ID NO: 176195 - DNA, 601 bp, Human; identical to SEQ ID NO: 32610

SEQ ID NO: 176196 - DNA, 601 bp, Human; identical to SEQ ID NO: 32611

SEQ ID NO: 176197 - DNA, 601 bp, Human; identical to SEQ ID NO: 32612

SEQ ID NO: 176198 - DNA, 601 bp, Human; identical to SEQ ID NO: 32613

SEQ ID NO: 176199 - DNA, 601 bp, Human; identical to SEQ ID NO: 32614

SEQ ID NO: 176200 - DNA, 601 bp, Human; identical to SEQ ID NO: 32615

SEQ ID NO: 176201 - DNA, 601 bp, Human; identical to SEQ ID NO: 32616

SEQ ID NO: 176202 - DNA, 601 bp, Human; identical to SEQ ID NO: 32617

SEQ ID NO: 176203 - DNA, 601 bp, Human; identical to SEQ ID NO: 32618

SEQ ID NO: 176204 - DNA, 601 bp, Human; identical to SEQ ID NO: 32619

SEQ ID NO: 176205 - DNA, 601 bp, Human; identical to SEQ ID NO: 32620

SEQ ID NO: 176206 - DNA, 601 bp, Human; identical to SEQ ID NO: 32621

SEQ ID NO: 176207 - DNA, 601 bp, Human; identical to SEQ ID NO: 176154

SEQ ID NO: 176208 - DNA, 601 bp, Human; identical to SEQ ID NO: 176155

SEQ ID NO: 176209 - DNA, 601 bp, Human; identical to SEQ ID NO: 176156

SEQ ID NO: 176210 - DNA, 601 bp, Human; identical to SEQ ID NO: 176157

SEQ ID NO: 176211 - DNA, 601 bp, Human; identical to SEQ ID NO: 176158

SEQ ID NO: 176212 - DNA, 601 bp, Human; identical to SEQ ID NO: 176159

SEQ ID NO: 176213 - DNA, 601 bp, Human; identical to SEQ ID NO: 176160

SEQ ID NO: 176214 - DNA, 601 bp, Human; identical to SEQ ID NO: 176161

SEQ ID NO: 176215 - DNA, 601 bp, Human; identical to SEQ ID NO: 176162

SEQ ID NO: 176216 - DNA, 601 bp, Human; identical to SEQ ID NO: 176163

SEQ ID NO: 176217 - DNA, 601 bp, Human; identical to SEQ ID NO: 176164

SEQ ID NO: 176218 - DNA, 601 bp, Human; identical to SEQ ID NO: 176165

SEQ ID NO: 176219 - DNA, 601 bp, Human; identical to SEQ ID NO: 176166

SEQ ID NO: 176220 - DNA, 601 bp, Human; identical to SEQ ID NO: 176167

SEQ ID NO: 176221 - DNA, 601 bp, Human; identical to SEQ ID NO: 176168

SEQ ID NO: 176222 - DNA, 601 bp, Human; identical to SEQ ID NO: 38417

SEQ ID NO: 176223 - DNA, 601 bp, Human; identical to SEQ ID NO: 38418

SEQ ID NO: 176224 - DNA, 601 bp, Human; identical to SEQ ID NO: 38419

SEQ ID NO: 176225 - DNA, 601 bp, Human; identical to SEQ ID NO: 38420

SEQ ID NO: 176226 - DNA, 601 bp, Human; identical to SEQ ID NO: 38421

SEQ ID NO: 176227 - DNA, 601 bp, Human; identical to SEQ ID NO: 38422

SEQ ID NO: 176228 - DNA, 601 bp, Human; identical to SEQ ID NO: 38423

SEQ ID NO: 176229 - DNA, 601 bp, Human; identical to SEQ ID NO: 38424

SEQ ID NO: 176230 - DNA, 601 bp, Human; identical to SEQ ID NO: 38425

SEQ ID NO: 176231 - DNA, 601 bp, Human; identical to SEQ ID NO: 38426

SEQ ID NO: 176232 - DNA, 601 bp, Human; identical to SEQ ID NO: 32594

SEQ ID NO: 176233 - DNA, 601 bp, Human; identical to SEQ ID NO: 32595

SEQ ID NO: 176234 - DNA, 601 bp, Human; identical to SEQ ID NO: 32596

SEQ ID NO: 176235 - DNA, 601 bp, Human; identical to SEQ ID NO: 32597

SEQ ID NO: 176236 - DNA, 601 bp, Human; identical to SEQ ID NO: 32598

SEQ ID NO: 176237 - DNA, 601 bp, Human; identical to SEQ ID NO: 32599

SEQ ID NO: 176238 - DNA, 601 bp, Human; identical to SEQ ID NO: 32600

SEQ ID NO: 176239 - DNA, 601 bp, Human; identical to SEQ ID NO: 32601

SEQ ID NO: 176240 - DNA, 601 bp, Human; identical to SEQ ID NO: 32602

SEQ ID NO: 176241 - DNA, 601 bp, Human; identical to SEQ ID NO: 32603

SEQ ID NO: 176242 - DNA, 601 bp, Human; identical to SEQ ID NO: 32604

SEQ ID NO: 176243 - DNA, 601 bp, Human; identical to SEQ ID NO: 32605

SEQ ID NO: 176244 - DNA, 601 bp, Human; identical to SEQ ID NO: 32606

SEQ ID NO: 176245 - DNA, 601 bp, Human; identical to SEQ ID NO: 32607

SEQ ID NO: 176246 - DNA, 601 bp, Human; identical to SEQ ID NO: 32608

SEQ ID NO: 176247 - DNA, 601 bp, Human; identical to SEQ ID NO: 32609

SEQ ID NO: 176248 - DNA, 601 bp, Human; identical to SEQ ID NO: 32610

SEQ ID NO: 176249 - DNA, 601 bp, Human; identical to SEQ ID NO: 32611

SEQ ID NO: 176250 - DNA, 601 bp, Human; identical to SEQ ID NO: 32612

SEQ ID NO: 176251 - DNA, 601 bp, Human; identical to SEQ ID NO: 32613

SEQ ID NO: 176252 - DNA, 601 bp, Human; identical to SEQ ID NO: 32614

SEQ ID NO: 176253 - DNA, 601 bp, Human; identical to SEQ ID NO: 32615

SEQ ID NO: 176254 - DNA, 601 bp, Human; identical to SEQ ID NO: 32616

SEQ ID NO: 176255 - DNA, 601 bp, Human; identical to SEQ ID NO: 32617

SEQ ID NO: 176256 - DNA, 601 bp, Human; identical to SEQ ID NO: 32618

SEQ ID NO: 176257 - DNA, 601 bp, Human; identical to SEQ ID NO: 32619

SEQ ID NO: 176258 - DNA, 601 bp, Human; identical to SEQ ID NO: 32620

SEQ ID NO: 176259 - DNA, 601 bp, Human; identical to SEQ ID NO: 32621

SEQ ID NO: 176260 - DNA, 601 bp, Human; identical to SEQ ID NO: 38417

SEQ ID NO: 176261 - DNA, 601 bp, Human; identical to SEQ ID NO: 38418

SEQ ID NO: 176262 - DNA, 601 bp, Human; identical to SEQ ID NO: 38419

SEQ ID NO: 176263 - DNA, 601 bp, Human; identical to SEQ ID NO: 38420

SEQ ID NO: 176264 - DNA, 601 bp, Human; identical to SEQ ID NO: 38421

SEQ ID NO: 176265 - DNA, 601 bp, Human; identical to SEQ ID NO: 38422

SEQ ID NO: 176266 - DNA, 601 bp, Human; identical to SEQ ID NO: 38423

SEQ ID NO: 176267 - DNA, 601 bp, Human; identical to SEQ ID NO: 38424

SEQ ID NO: 176268 - DNA, 601 bp, Human; identical to SEQ ID NO: 38425

SEQ ID NO: 176269 - DNA, 601 bp, Human; identical to SEQ ID NO: 38426

SEQ ID NO: 176270 - DNA, 601 bp, Human; identical to SEQ ID NO: 32594

SEQ ID NO: 176271 - DNA, 601 bp, Human; identical to SEQ ID NO: 32595

SEQ ID NO: 176272 - DNA, 601 bp, Human; identical to SEQ ID NO: 32596

SEQ ID NO: 176273 - DNA, 601 bp, Human; identical to SEQ ID NO: 32597

SEQ ID NO: 176274 - DNA, 601 bp, Human; identical to SEQ ID NO: 32598

SEQ ID NO: 176275 - DNA, 601 bp, Human; identical to SEQ ID NO: 32599

SEQ ID NO: 176276 - DNA, 601 bp, Human; identical to SEQ ID NO: 32600

SEQ ID NO: 176277 - DNA, 601 bp, Human; identical to SEQ ID NO: 32601

SEQ ID NO: 176278 - DNA, 601 bp, Human; identical to SEQ ID NO: 32602

SEQ ID NO: 176279 - DNA, 601 bp, Human; identical to SEQ ID NO: 32603

SEQ ID NO: 176280 - DNA, 601 bp, Human; identical to SEQ ID NO: 32604

SEQ ID NO: 176281 - DNA, 601 bp, Human; identical to SEQ ID NO: 32605

SEQ ID NO: 176282 - DNA, 601 bp, Human; identical to SEQ ID NO: 32606

SEQ ID NO: 176283 - DNA, 601 bp, Human; identical to SEQ ID NO: 32607

SEQ ID NO: 176284 - DNA, 601 bp, Human; identical to SEQ ID NO: 32608

SEQ ID NO: 176285 - DNA, 601 bp, Human; identical to SEQ ID NO: 32609

SEQ ID NO: 176286 - DNA, 601 bp, Human; identical to SEQ ID NO: 32610

SEQ ID NO: 176287 - DNA, 601 bp, Human; identical to SEQ ID NO: 32611

SEQ ID NO: 176288 - DNA, 601 bp, Human; identical to SEQ ID NO: 32612

SEQ ID NO: 176289 - DNA, 601 bp, Human; identical to SEQ ID NO: 32613

SEQ ID NO: 176290 - DNA, 601 bp, Human; identical to SEQ ID NO: 32614

SEQ ID NO: 176291 - DNA, 601 bp, Human; identical to SEQ ID NO: 32615

SEQ ID NO: 176292 - DNA, 601 bp, Human; identical to SEQ ID NO: 32616

SEQ ID NO: 176293 - DNA, 601 bp, Human; identical to SEQ ID NO: 32617

SEQ ID NO: 176294 - DNA, 601 bp, Human; identical to SEQ ID NO: 32618

SEQ ID NO: 176295 - DNA, 601 bp, Human; identical to SEQ ID NO: 32619

SEQ ID NO: 176296 - DNA, 601 bp, Human; identical to SEQ ID NO: 32620

SEQ ID NO: 176297 - DNA, 601 bp, Human; identical to SEQ ID NO: 32621

SEQ ID NO: 176298 - DNA, 601 bp, Human; identical to SEQ ID NO: 38417

SEQ ID NO: 176299 - DNA, 601 bp, Human; identical to SEQ ID NO: 38418

SEQ ID NO: 176300 - DNA, 601 bp, Human; identical to SEQ ID NO: 38419

SEQ ID NO: 176301 - DNA, 601 bp, Human; identical to SEQ ID NO: 38420

SEQ ID NO: 176302 - DNA, 601 bp, Human; identical to SEQ ID NO: 38421

SEQ ID NO: 176303 - DNA, 601 bp, Human; identical to SEQ ID NO: 38422

SEQ ID NO: 176304 - DNA, 601 bp, Human; identical to SEQ ID NO: 38423

SEQ ID NO: 176305 - DNA, 601 bp, Human; identical to SEQ ID NO: 38424

SEQ ID NO: 176306 - DNA, 601 bp, Human; identical to SEQ ID NO: 38425

SEQ ID NO: 176307 - DNA, 601 bp, Human; identical to SEQ ID NO: 38426

SEQ ID NO: 176308 - DNA, 601 bp, Human; identical to SEQ ID NO: 32594

SEQ ID NO: 176309 - DNA, 601 bp, Human; identical to SEQ ID NO: 32595

SEQ ID NO: 176310 - DNA, 601 bp, Human; identical to SEQ ID NO: 32596

SEQ ID NO: 176311 - DNA, 601 bp, Human; identical to SEQ ID NO: 32597

SEQ ID NO: 176312 - DNA, 601 bp, Human; identical to SEQ ID NO: 32598

SEQ ID NO: 176313 - DNA, 601 bp, Human; identical to SEQ ID NO: 32599

SEQ ID NO: 176314 - DNA, 601 bp, Human; identical to SEQ ID NO: 32600

SEQ ID NO: 176315 - DNA, 601 bp, Human; identical to SEQ ID NO: 32601

SEQ ID NO: 176316 - DNA, 601 bp, Human; identical to SEQ ID NO: 32602

SEQ ID NO: 176317 - DNA, 601 bp, Human; identical to SEQ ID NO: 32603

SEQ ID NO: 176318 - DNA, 601 bp, Human; identical to SEQ ID NO: 32604

SEQ ID NO: 176319 - DNA, 601 bp, Human; identical to SEQ ID NO: 32605

SEQ ID NO: 176320 - DNA, 601 bp, Human; identical to SEQ ID NO: 32606

SEQ ID NO: 176321 - DNA, 601 bp, Human; identical to SEQ ID NO: 32607

SEQ ID NO: 176322 - DNA, 601 bp, Human; identical to SEQ ID NO: 32608

SEQ ID NO: 176323 - DNA, 601 bp, Human; identical to SEQ ID NO: 32609

SEQ ID NO: 176324 - DNA, 601 bp, Human; identical to SEQ ID NO: 32610

SEQ ID NO: 176325 - DNA, 601 bp, Human; identical to SEQ ID NO: 32611

SEQ ID NO: 176326 - DNA, 601 bp, Human; identical to SEQ ID NO: 32612

SEQ ID NO: 176327 - DNA, 601 bp, Human; identical to SEQ ID NO: 32613

SEQ ID NO: 176328 - DNA, 601 bp, Human; identical to SEQ ID NO: 32614

SEQ ID NO: 176329 - DNA, 601 bp, Human; identical to SEQ ID NO: 32615

SEQ ID NO: 176330 - DNA, 601 bp, Human; identical to SEQ ID NO: 32616

SEQ ID NO: 176331 - DNA, 601 bp, Human; identical to SEQ ID NO: 32617

SEQ ID NO: 176332 - DNA, 601 bp, Human; identical to SEQ ID NO: 32618

SEQ ID NO: 176333 - DNA, 601 bp, Human; identical to SEQ ID NO: 32619

SEQ ID NO: 176334 - DNA, 601 bp, Human; identical to SEQ ID NO: 32620

SEQ ID NO: 176335 - DNA, 601 bp, Human; identical to SEQ ID NO: 32621

SEQ ID NO: 176336 - DNA, 601 bp, Human
gttggccttccttgggcggccccggcctcgcttgccagtcaggggaggggcactggatgccacactggggaatggggaagtcagcagttggggggataggggtccagccaccatgggcaagcggtccaccccaggtaacacaggcaaagaggcttggcctgcaatggctgcaccagccgcccgagctgcctcctcctctggctgcatgctgccggcgatgccattgctgttggctgccaaggctgccccgttggtcatgtccaaagggaagcccaagtccgaggtcccaggggggcgaaaragcattatatcggcgcgggcagggggtaccaggatctgtacgttggactgtttgatgacttcctggcagatctcgataaccgacctcatcagcaggaacttggcggccgtcatgagttcgggaaagctctccaagcgcaccacgatgcgggaagtgtaggcgaagtccagaatgtccccaaataccttggagctgatagtgtgcatctccagctcccggctgcccccggccccgccgcctggtgctgccgtcgcgccccctacatcagccggacccccgtccgcagctccgccgtcgccc

SEQ ID NO: 176337 - DNA, 601 bp, Human
gccctccgaggcaagctgtgtgatcaccctccaagacagcgtggctttggaaagctgtggtgtgagctgagcaccaactcacagccaggcccccggggttggatgagtcaggagctgaaggtcagaaccagcaccctggaaggaggactcaggttggcaggcacttcctgtacctgagcacctgacttagtaccagtgatcagtctcctcacaacatcccttcctcagctggagcttacaaaggcattccagctgtgggggtcatagaatattgggaaagccctgagaagagctgaatccrttggctttcaagctattttggttccagggaggtgtttcatgggttctagtcaattttgactcatttcttttgtgtgtgtgtgtgtttactgttttagaactgtaagagaaagcaacattcacctttgtgtcacagatcaaatggtaacccactgaagaccaccccattaccttgtgctagaacggaactgcctctgccatctctctttaacagaagcacatcctgagaacctgagagctcaaggtaagtggctgaacactgtcaacacatacagacatctaactgtctccttactgtaca

SEQ ID NO: 176338 - DNA, 601 bp, Human
attacatttacatgaatttacagatgagttattggcatataaaccagccttcctgttctgtatccctgggtttcccctagttttatacaaagaattatatttgttcattttattcaaaagtgacattagtcttggccagggaaatggaaaggaaaggcaggacaaagtgcagagataattattcgtaatattttcacgagtttgaattgaaaaagcagcccattaaatgatagtggcaattctgacgacatgagaattagcagacagcaagggccagaggcttcaaaagtgtctgtgggcygggtgcggtggctcatgcttgtaatcccagcgctttgggaggccgagatgggtggatcacctgaggtcaggagttcaagaccagcctggccaacatggtgaaaccccatctctattaaaaatataaaaaattagccgggtgtggtggcagactcccgtaatcccagctacttgggaggctgaggcaggagaatcacttgaacctgggaggtagaggttgcagtgagccaagatcgtgtcactgcactccagcctgggcaacaagtcaagacttcctctcaaaaaaaaaaaaaaaaaaaaa

SEQ ID NO: 176339 - DNA, 601 bp, Human
atccttagacattaagaattgactttaggtgcattagctataatgcacagaattacatttacatgaatttacagatgagttattggcatataaaccagccttcctgttctgtatccctgggtttcccctagttttatacaaagaattatatttgttcattttattcaaaagtgacattagtcttggccagggaaatggaaaggaaaggcaggacaaagtgcagagataattattcgtaatattttcacgagtttgaattgaaaaagcagcccattaaatgatagtggcaattctgacgacrtgagaattagcagacagcaagggccagaggcttcaaaagtgtctgtgggccgggtgcggtggctcatgcttgtaatcccagcgctttgggaggccgagatgggtggatcacctgaggtcaggagttcaagaccagcctggccaacatggtgaaaccccatctctattaaaaatataaaaaattagccgggtgtggtggcagactcccgtaatcccagctacttgggaggctgaggcaggagaatcacttgaacctgggaggtagaggttgcagtgagccaagatcgtgtcactgcactcc

SEQ ID NO: 176340 - DNA, 601 bp, Human
ggcctcccatacacgctcaggcccatcctctggaagtgaggaaacagtgggcagattacctcggttacagatactgcagaagttgctgggcccctcgctgtgcttcttcaggtggtctgccatgtatgctgcccgcaagtacttcccacacacctggcagggcaccttgtcttcatgacaggccaggtgggagcgcagacggtctcgggtggcaaaagaagcattgcaggtctgaaggcagaaaagaaaatgggatgatgtgaaacccagcaccccacacctgactccccaccaagtgcaycatgaagcaaaggcaatttctggccatcacatgacctccctttataaagacagctttagagtttggctcaggctccctacccagaatgccaagaggctgctcttatttcccatggtacctccttacgggacacttgagtgggaatcactggtactaactaaatgactactggaaatgtacccaggacatggcaagctaagctctatacccctctacacaatgaagagttacacatttgctcatccttagacattaagaattgactttaggtgcattagctataatgcacagaattacatt

SEQ ID NO: 176341 - DNA, 601 bp, Human
gtcatgtagcttatggctgttgcccaagttctctttactagcccttggaaaataaatcctgatgtacaatagttgttggctttgccacatcagctgcttccttactgggccaactttcccactgtccctgctgctctcagtttttctctcctcctgagctgggcttcaagggctgtagccctgggtctcctgtccagtttctgccctactccaccatctggtctgggctttctgagttttatcatgagcacccttctccactcagcagttttcaacctctggtctctgaccccagttctcrgactgggaacttccatattgaaaacttgacaaaatgcctgctaacagcttgttacagcaggttttgagttatccgggggagctgtcaggaagccaggttaggatgaagcaagacaagaaacgatattatttctagggctggggcagccccagtcaagacagtcagccacagcctgataactctccctgcatgcgcaagcccaccgcttgcaacctggaggaagctcctgtcagcaatgggctctaatgacatgtcagaaaacagaacagacagcttaagagaccttcactactacttccc

SEQ ID NO: 176342 - DNA, 601 bp, Human
ggtcatgtagcttatggctgttgcccaagttctctttactagcccttggaaaataaatcctgatgtacaatagttgttggctttgccacatcagctgcttccttactgggccaactttcccactgtccctgctgctctcagtttttctctcctcctgagctgggcttcaagggctgtagccctgggtctcctgtccagtttctgccctactccaccatctggtctgggctttctgagttttatcatgagcacccttctccactcagcagttttcaacctctggtctctgaccccagttctyagactgggaacttccatattgaaaacttgacaaaatgcctgctaacagcttgttacagcaggttttgagttatccgggggagctgtcaggaagccaggttaggatgaagcaagacaagaaacgatattatttctagggctggggcagccccagtcaagacagtcagccacagcctgataactctccctgcatgcgcaagcccaccgcttgcaacctggaggaagctcctgtcagcaatgggctctaatgacatgtcagaaaacagaacagacagcttaagagaccttcactactacttcc

SEQ ID NO: 176343 - DNA, 601 bp, Human
gaagttcacctgattcaatcttaactgttctgacattcagcctttgtttgaacacatgcagagataagaacattcgtttattcgtgcaacccctcctgtaggtacaggcttggtggcagcagggcaaaggaggacacagagctctctgcattttgattccaatgtctcaatgtttttggtgctcagaaagaactttatcctcttcctttttttttttttttttttttgtctcttcctatttctgcccaaggaatgagtccaggagtagaatcctgctccttctcttctgataaaaactgcmattgttttctcttctttctgagtacccagcatgggttggaccagcaccttctttagtcttcttgcaggaaagggacttcccgctctggctctggaacccagagatgtttggcctgtgatccagacccagtcttggcttttctgagaaaaagtagactctggtttactcttctggattctccattccggtcatgtagcttatggctgttgcccaagttctctttactagcccttggaaaataaatcctgatgtacaatagttgttggctttgccacatcagctgcttccttactgggccaa

SEQ ID NO: 176344 - DNA, 601 bp, Human
tttaggaagtgctgatggcacaccagggcccagcacaccgcatgcactattctatagaatttgcccaacaccctttgtgctacagattactattatacccattttacagataaagaaataagaggctttgtgaggttagggaggctgaggtgggcagatcacgaggtcaggagatcgagaccatcctggctaacacagtgaaaccccgtctctactaaaaatataaaaaattagctgggcgtggtagcaggcacctgtaagctgagatcatgccactgcgctccagcctgggcaacagagygagactccgtctcaaaaaaaaaagaggcttggtgaggttaagtaacctggtcacacgtacagctactgagtggcagagcctggactccaaccccaggatcatgtgccaccagaacttggcccttagctactgggcagatgctttaacccacttatgcctcatgttccattattgggacgctaaccttttaggaattatttgtatcctactgctcaagatcatcattaaagtctgatttttcacaaaaaagtttgtaacctccagcataaatgggttaattggttcctgtgtcttagccct

SEQ ID NO: 176345 - DNA, 601 bp, Human; identical to SEQ ID NO: 176336

SEQ ID NO: 176346 - DNA, 601 bp, Human; identical to SEQ ID NO: 176337

SEQ ID NO: 176347 - DNA, 601 bp, Human; identical to SEQ ID NO: 176338

SEQ ID NO: 176348 - DNA, 601 bp, Human; identical to SEQ ID NO: 176339

SEQ ID NO: 176349 - DNA, 601 bp, Human; identical to SEQ ID NO: 176340

SEQ ID NO: 176350 - DNA, 601 bp, Human; identical to SEQ ID NO: 176341

SEQ ID NO: 176351 - DNA, 601 bp, Human; identical to SEQ ID NO: 176342

SEQ ID NO: 176352 - DNA, 601 bp, Human; identical to SEQ ID NO: 176343

SEQ ID NO: 176353 - DNA, 601 bp, Human; identical to SEQ ID NO: 176344

SEQ ID NO: 176354 - DNA, 601 bp, Human; identical to SEQ ID NO: 176336

SEQ ID NO: 176355 - DNA, 601 bp, Human; identical to SEQ ID NO: 176337

SEQ ID NO: 176356 - DNA, 601 bp, Human; identical to SEQ ID NO: 176338

SEQ ID NO: 176357 - DNA, 601 bp, Human; identical to SEQ ID NO: 176339

SEQ ID NO: 176358 - DNA, 601 bp, Human; identical to SEQ ID NO: 176340

SEQ ID NO: 176359 - DNA, 601 bp, Human; identical to SEQ ID NO: 176341

SEQ ID NO: 176360 - DNA, 601 bp, Human; identical to SEQ ID NO: 176342

SEQ ID NO: 176361 - DNA, 601 bp, Human; identical to SEQ ID NO: 176343

SEQ ID NO: 176362 - DNA, 601 bp, Human; identical to SEQ ID NO: 176344

SEQ ID NO: 176363 - DNA, 601 bp, Human; identical to SEQ ID NO: 176336

SEQ ID NO: 176364 - DNA, 601 bp, Human; identical to SEQ ID NO: 176337

SEQ ID NO: 176365 - DNA, 601 bp, Human; identical to SEQ ID NO: 176338

SEQ ID NO: 176366 - DNA, 601 bp, Human; identical to SEQ ID NO: 176339

SEQ ID NO: 176367 - DNA, 601 bp, Human; identical to SEQ ID NO: 176340

SEQ ID NO: 176368 - DNA, 601 bp, Human; identical to SEQ ID NO: 176341

SEQ ID NO: 176369 - DNA, 601 bp, Human; identical to SEQ ID NO: 176342

SEQ ID NO: 176370 - DNA, 601 bp, Human; identical to SEQ ID NO: 176343

SEQ ID NO: 176371 - DNA, 601 bp, Human; identical to SEQ ID NO: 176344

SEQ ID NO: 176372 - DNA, 601 bp, Human
acccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcstctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggacta

SEQ ID NO: 176373 - DNA, 601 bp, Human
gggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtatttygttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgc

SEQ ID NO: 176374 - DNA, 601 bp, Human
gaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacytcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagcca

SEQ ID NO: 176375 - DNA, 601 bp, Human
aggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtkcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggag

SEQ ID NO: 176376 - DNA, 601 bp, Human
tgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtyggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggc

SEQ ID NO: 176377 - DNA, 601 bp, Human
cgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtgrccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagac

SEQ ID NO: 176378 - DNA, 601 bp, Human
atttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcytccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcac

SEQ ID NO: 176379 - DNA, 601 bp, Human
taggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattrtggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccag

SEQ ID NO: 176380 - DNA, 601 bp, Human
tgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttrtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgttt

SEQ ID NO: 176381 - DNA, 601 bp, Human
tgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggytcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtgga

SEQ ID NO: 176382 - DNA, 601 bp, Human
gaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccarggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcg

SEQ ID NO: 176383 - DNA, 601 bp, Human
agactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccaccyccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgc

SEQ ID NO: 176384 - DNA, 601 bp, Human
tcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcaygtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctttatgttgctataatatctattgaataatgacataattacctagggatacgtagaggcttagaccctcagaatggtctagaact

SEQ ID NO: 176385 - DNA, 601 bp, Human
gaacttccacacattggtcctagctgtggctcctgggctgagggtgtttgcctaagtgcaggattaaggcagaaggactgaggtcaaatcactggggaattactgaaagccaagtcttcacttctgtgacaggaaatacaagagaagtgaaacgcagggttccaggcaggcagccgcctagtgtctagttggagaaataagaaaactgtgagaccgctggggacatgtgggtaaagtggtggctgttgtgggtcacgcagttccaaggaggtgctaaaggaggtctgagaaggaggaggtsggggctgggccttggggaaggttttctgggaggaggttaatctgagctgggctttgaagagtggtggatgtggaagaacttccaggcgggaggggatggcaggagcaggtgaagaccccggcctgggcaaggtactgagtggctggagggccgagtgggagtctaggggatgaggggccaggtggtgtaagaggccttgagtgccgagatggggagctcctgcttacacctgagggcagcaggggccactgagggttttcaggtttgtttcagccctctggctgcagtgaattgattcag

SEQ ID NO: 176386 - DNA, 601 bp, Human
tctgaggcccatgatagttgggggagtcaactgccagcccaccaatctggtgactggatgtcacatgcgatgccctcatggattctcaccttgtccatctacccttcgtcccccaggctccctgatggacttactcgccgaggagacatcaacctgctgatgctaggggaccctgggacagccaagtcccagcttctgaagtttgtggagaagtgttctcccattggggtgagtggcctgggatacctttgccaccttggcttgcagggaggaaggctgcagggcagggcctctgggtccycaggacacctgtggtgggctggctcacccggaatctcttcctcctttctcttggctgcggtcaggatggccgaggagatgggaggaagaagggagccaacaggtgtatgtaggtttggggcagggggcgagtacactgtactgagagtcaggatggggtttgggtctcaccctggccagaaattggctgtgggctttgagtaagtcacccaatctccctgagcgtcagtttatccatttgctaaataatgatattgttatcattaatagctaaaatctggctgggcatggtggttcatcc

SEQ ID NO: 176387 - DNA, 601 bp, Human
ctttggatagataggaagtgtgccaaatttgccacactggcactgtccagtagaaatagtgaactgcacatgcgacccatgtatgtcttctcagattgtctaacagccacattaaaaagtagctgggtgcggttgtgtgcatacctgtagtcccagctacttgggaggctgaggtgggaggatcacttgagcccaggagtttgagaccagcttgggcaacatagcaagaccccgtttcaatttaaaaggaagaaggggaaagaaaaaaggaaaaacaggtgaagttacttctgtttaactygctatatctaaaatctcatttcaacatgttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcct

SEQ ID NO: 176388 - DNA, 601 bp, Human
gttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcctcacaagactgtgtcacagggctgtggtsaggcttaggtgagccatggatgtgatgccctcagcggggagaacatctgggcacaccgaggcccagggcagcatccccttccagagggagacgcactgagttggagccttgagtcctattctgtaccctgcagccagctttgatgtgtgaccttgggcaaatcacaacctcagtgggtctttttgtcttatgggggtcaaagcatggagttgttattgggccctgacaccaccccactgccccaggtatacacgtctgggaaaggcagcagcgcagctggactgacagcctcggtgatga

SEQ ID NO: 176389 - DNA, 601 bp, Human
tagtactggctggttgcagtggctcacgctgtaatcccagcactttgggaggcggaggcaggtggatcacttgaggtcaggagtgcgagaccagcctggccaacgtggcgaaaccccatgtctactaaaaatacaaaaattagccgggtgtggtggtgcacacctatagtcccagctactcaggaggctgaggcaggagaattgcttgaacccaggaggcagagattgcagtgagctgagatcgtgccattgcacttcagcctgggcaacagagtgagactctgtctcaaaaaaaaaaaawatatatatatgtgtacacacacacacacacacacacactcactcttacacactactttctttgtgccaggcattctgaattactattcagtattttctatatgaataaattataaccctcccccaaaacctaccaggtaaggtgtgctattattcccttccctttatggatggggaagctgaggcaaaggaagttaagtaacttgcccaaggtcacatgccagaggtagtggagccaggatgtgaacccagctgcttgcctccagaggctgtgctcttaaccacagtgcttcgattcttg

SEQ ID NO: 176390 - DNA, 601 bp, Human
ctgggatgtgttttagtggatcgctgtgtgccagactaaaaactggggttccaagctaggtgcagtggcctacattgtgatcctagcactttgggaggctgaggcaggaggattacttgaggccaggagtttgagaccagcctgggcaacatagcaagactcccatttctacaaaaaataaaaaattagccaggcattgtggtgcatgcctgtagacccagctcctcaggtggctgaggtggaaggatcactggagcccaggagttcgaggctgcagtgagctatgatcatgccactacaytccagcctggtccacagagcgagactttgtctcaaaaaaaaaaaaaaaaaaaaaaaattgcagttctatgactaagatcaaaagggagatggattatggggacacctagcagtctccaccacagtcttaccactttgggcaagcacctccctggtaacgggctggctggggaggaagggaatagcggaccgaggctaccctgagcacgctgttgcccccacaggcagctggaggccattgtgcgcatcgcggaagccctcagcaagatgaagctgcagcccttcgccacagaggcagatg

SEQ ID NO: 176391 - DNA, 601 bp, Human
tgttgcccccacaggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggtgagcagatgcaggggccatggtctcaattgatctgggttccctggctcggagctctgtgggcagggctctggcctgctgggggcctgcagtgtgtgtcttgcttctctgagtttgctgagcttctctgagtttctttttgcmataagacccctctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgccc

SEQ ID NO: 176392 - DNA, 601 bp, Human
ctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgcccaagatcacagtygcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttctcattctcgttctagttggggagagatagacagtagagaaacaaatgcag

SEQ ID NO: 176393 - DNA, 601 bp, Human
gagacagctgacactcgaaggggcctttccctggtgcccaagatcacagtcgcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttstcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcgctaagtgtcagtttccccaggagggagcaggtttggtgcatttgaatggggaggcacttgg

SEQ ID NO: 176394 - DNA, 601 bp, Human
actgttctaggtgctgggagtataagagcaatcaatcacagggtcccggccctcctgggttctcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcrctaagtgtcagtttccccaggagggagcaggtttggtgcatttgaatggggaggcacttgggtgaggaatggggtgggtggggcctgttcctcctgtcccccttggtgaagactcagcctctaccctggagacacttgctgtcacatgagacattgcaggtggaggcctctgggatgctgcaggcacagagggcaggggtgatatggagtggtgataatttgagttgggtcttatgggctatgtaggagtttgcctcacagactcccctctcaatgacttcttgaccatgagcccaccat

SEQ ID NO: 176395 - DNA, 601 bp, Human
gaaggggcagagccatgagagtgagctttctggctcactgaggagggtactgttggccccatagagagaagatgggatttcccagatgctctggaaaacctgtcacctttaaaatctcaggattaatcctagtttctggtctccgctccttgtacatcatctcattttgattcagggcagtttaatgggtggtatcgtgtctattctataggtgcgcagactgaggcttagagaaaggtttagagcttcggttctagagtcagatgggacttaagtcccagctctacctcttaattgctgygaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcc

SEQ ID NO: 176396 - DNA, 601 bp, Human
cacaccccaggcctttgccacctcctagagaggtaagggcaggacccaggcagtgatcaccaaagggaagggggcttggtcatggtcatagtgatggtgatggcactagctgacacttatcagaagctatgggcctggccctgttcttagagcttggcatgtagttttttttgaaacagagtctcgctctgtcacccaggctggagtgcagtggcgcgatctcggctcactgcaacctctgcctcccgggttcaagcgattctcctgcctcagtcccccaagtagctgggactacaggcaygtgccaccatgcccggctaattttttgtatttttactagagacgggatttcaccatgttagccaggatggtctcgatctcctgacctcgtgatctgcctacctcagcctcccaaagtgctgagattacaggcgtcagccaccgcggccagccagcatgtagttatttaaccctcacagtaaatagttattcattccctttttacaggtggggaaactgaagcccagagaggttaagtaactcactccagtggtagcacagctcgtaaaggcagtctgcttttgtgctttcagacaaagcc

SEQ ID NO: 176397 - DNA, 601 bp, Human
cagagtctcgctctgtcacccaggctggagtgcagtggcgcgatctcggctcactgcaacctctgcctcccgggttcaagcgattctcctgcctcagtcccccaagtagctgggactacaggcacgtgccaccatgcccggctaattttttgtatttttactagagacgggatttcaccatgttagccaggatggtctcgatctcctgacctcgtgatctgcctacctcagcctcccaaagtgctgagattacaggcgtcagccaccgcggccagccagcatgtagttatttaaccctcayagtaaatagttattcattccctttttacaggtggggaaactgaagcccagagaggttaagtaactcactccagtggtagcacagctcgtaaaggcagtctgcttttgtgctttcagacaaagccataccacagcctctcagccctgctgggaagggtgaggagggacagggaggttggggggaagaaggggtgagtggagctgaggggctgtgcccttgtttacactgcattagcatggtagctaagaggacaagcccgggacccagcacctgggtgtgagccctggttccgctgcttcc

SEQ ID NO: 176398 - DNA, 601 bp, Human
tgcagtggcgcgatctcggctcactgcaacctctgcctcccgggttcaagcgattctcctgcctcagtcccccaagtagctgggactacaggcacgtgccaccatgcccggctaattttttgtatttttactagagacgggatttcaccatgttagccaggatggtctcgatctcctgacctcgtgatctgcctacctcagcctcccaaagtgctgagattacaggcgtcagccaccgcggccagccagcatgtagttatttaaccctcacagtaaatagttattcattccctttttacargtggggaaactgaagcccagagaggttaagtaactcactccagtggtagcacagctcgtaaaggcagtctgcttttgtgctttcagacaaagccataccacagcctctcagccctgctgggaagggtgaggagggacagggaggttggggggaagaaggggtgagtggagctgaggggctgtgcccttgtttacactgcattagcatggtagctaagaggacaagcccgggacccagcacctgggtgtgagccctggttccgctgcttcctggctttgtacctcgaggcaagggatttta

SEQ ID NO: 176399 - DNA, 601 bp, Human
tcgtaaaggcagtctgcttttgtgctttcagacaaagccataccacagcctctcagccctgctgggaagggtgaggagggacagggaggttggggggaagaaggggtgagtggagctgaggggctgtgcccttgtttacactgcattagcatggtagctaagaggacaagcccgggacccagcacctgggtgtgagccctggttccgctgcttcctggctttgtacctcgaggcaagggattttatctccttgtgtctcagcactctcatctgtaagactgcaccacatcaacactcatcytaaagggactgtgagacttaaatgaatgaatatatgtaaggcgcttggtgagcagatagtaaatgcacaataaatccccaagtcttctgttgagtcagcatttgcaagtgggcctgctacgggttacacgatcatttcccaagtcacgcccctgaagttgctgagcagggataagggaaggagtgagcaggcaactctctaggcatcattcagataaccccccaactgaggtacttctatacagagaaacccatgccactcccagccctgctgccgccttgaggccaagactgaggctgc

SEQ ID NO: 176400 - DNA, 601 bp, Human
tgcactccagcctgggccacagagaaagactccatctcaaaaaaaaaaaaaaaaaaaaaaaagtttaagcaaaagtgaggaaggtgcttattaaaagctggaaatcaggatggaggtaccagtccagacagcctccccaccaccccaccgtctccacagcagcccctgtttcagattcacaagcctgccttgagtgatgcagtgagttatcctggaggcagtgtgggccttggaggccagcactcactttttcatcctatgatttatttgagaagcagagagcacctaccgggtgccaggmacgagctaggtgagaacagaatcaggtagaaatctcagcctagccacacggaagctgtgtgatcttgggcaggctgcataccctttctgagcctcagtttgctcacctgtaatgcaaaggtaacaaaatcttgacagaggcatagtgaggaatcaagagaacaacgggcctggagcatacacccagtgcttagcccccagtaggccctcactctcatcattactgacacctgaggtcactgagcatgtgccactgtccattcattatcttgcataactcccaaaatcatcctgcaaggta

SEQ ID NO: 176401 - DNA, 601 bp, Human
atcccttcgctcaaccagcagagaaataagacccagaggtggagagacttgtccaaggtcacacggcaaatctgtggcccaggagttgatgtcaatttgtgtgtgtgtgttggtcgggggagcactttgtgcaatccaacagggcctgttgcagccagatgacagggacaggagaagaaagacataaacacaccacgatgccattacagtcaacagaaaactcaactcttcttcctcaagtgtttctagcacggatcaccaacggctcaaattttagataacggagcttccaggaccagcmatgctcccgaggcagacagaagctggaaatgggtaaagcccaagggagacccaaaggacgacggagtggaagaggaaaattggctctggctcacaaataaggagaaattaatctgcaaattaaagtgccaaagacaatccattcacttgtggcaaccccggcgcccacttccttcctcccgttggcagaaacgttgattcttaacctattagacttctgagggaaccagctcagaatggtgagggaaggggccaagagaagagtgtatcacctttgggatagaaggcaacgaggagatga

SEQ ID NO: 176402 - DNA, 601 bp, Human
ttcacaaccaggatgctgagctcctcaacctgaaaatgagttcatggcttttttgttttttgtttttcttttttgagatggaatctggctctgttgcccaggctggagtgcagtggtgcaatctctgctcaccgcaacctccacctcctgggtttgagcaattctcagaattctccatgttaggcaggatggtctcgatctcctgaccttgtgatccgcctgcctcagcctcccaaagtgctgggattacaggcgcccagccatattaactgattttaaaatcctgatggggtagacgccmttttgcagaggaagaaacagaggcaccgaaagactaactagctggggatttaacccaggcagtctggcttcatgtctatactcttgatgactattcggactttgttattgttacacagagatatttacaggcaaactgatacctacatggacatgtatcaacacctcacacgtgtacatgcatgcaggctctcacagatgtgtgtgcacactcacatatgggcctgcacactcacacagaggtacacataaatatatcccagcacacgccatactcacctgcacacacacacagagacac

SEQ ID NO: 176403 - DNA, 601 bp, Human
ttctccagagtctctgggtgacccttaaagagcctgtgggcacagggaaggctggagtcggcatgggaggtgcggtgtgaggtctgggggcagccagactagagttcaagtttagctccctgtcttcccagctgtgtgaccttgggccattcacttcacctctctgtgcctcagcttcctcatataagggatggggataacttgtccctacttgaaggattaagtgagatagtgtgtgctatgtaccaacagggtgtctggcacatagtgagtgtcatataattcccattttacagatgtrgaaaccgaggttctgaggcgtaaagtcaccagctcactattgcaggggtgctgtccagagaagccaggctggaatgaggtctgagtgaccaaaacagcagttctagtccacgctgcgaccatctctgcagcttcctgcccagggattgtccttcagctgcttaaatacctctagctacaggaggctcactcctacctgtgagggccattccactccagagcaatcctcacactcagaaacctcttgcttgttttgagcccaagctgtgactctctgaacctcccagtcccctcactgtgc

SEQ ID NO: 176404 - DNA, 601 bp, Human
gcagtcccctttacaaatgagaaacctggggcacagagaagagtggcataggtcatcccacaagttagtggctgagcttggactcgaacccagatcccattgccccacccgaggccttccccgcatcctcccacctgcccaggctctgcctcctacctccaggtacttcacggggatcttgtgcttggtggcatgcgactgtgccaggggcttaatctctgcctcatgatgccccttcttcttaaggatgccacccagggcggtgagcacagtggcaccatgcttctttaagtcctcagaygccttcatctcgtcctctgacttcaggtgcttgaacttgtcaaacttctccagagtctctgggtgacccttaaagagcctgtgggcacagggaaggctggagtcggcatgggaggtgcggtgtgaggtctgggggcagccagactagagttcaagtttagctccctgtcttcccagctgtgtgaccttgggccattcacttcacctctctgtgcctcagcttcctcatataagggatggggataacttgtccctacttgaaggattaagtgagatagtgtgtgctatgtaccaacagggt

SEQ ID NO: 176405 - DNA, 601 bp, Human
aacaatcccaggaggaaggcaaagtgggtggcagtcccctttacaaatgagaaacctggggcacagagaagagtggcataggtcatcccacaagttagtggctgagcttggactcgaacccagatcccattgccccacccgaggccttccccgcatcctcccacctgcccaggctctgcctcctacctccaggtacttcacggggatcttgtgcttggtggcatgcgactgtgccaggggcttaatctctgcctcatgatgccccttcttcttaaggatgccacccagggcggtgagcacrgtggcaccatgcttctttaagtcctcagacgccttcatctcgtcctctgacttcaggtgcttgaacttgtcaaacttctccagagtctctgggtgacccttaaagagcctgtgggcacagggaaggctggagtcggcatgggaggtgcggtgtgaggtctgggggcagccagactagagttcaagtttagctccctgtcttcccagctgtgtgaccttgggccattcacttcacctctctgtgcctcagcttcctcatataagggatggggataacttgtccctacttgaaggattaagt

SEQ ID NO: 176406 - DNA, 601 bp, Human
ttgctgagctcctgccacataagtcctgcatgtaccagactcccagtggcacagcagttaggggctggggttctgtagtaatagagacctgcgtttgaatcttggctctgccattatccacctcctgtgaccgtggacaagctgcttaacctctgtgagcctcagtttccccatctatcaagtggatatgataatggtacctacccatggagaggatgcaaattttgcacccaatatcccctctccctttcctctttggtaataagatgtgaatttggcatactaaattaaaaatgctaartgtgttcattctcaacaatcccaggaggaaggcaaagtgggtggcagtcccctttacaaatgagaaacctggggcacagagaagagtggcataggtcatcccacaagttagtggctgagcttggactcgaacccagatcccattgccccacccgaggccttccccgcatcctcccacctgcccaggctctgcctcctacctccaggtacttcacggggatcttgtgcttggtggcatgcgactgtgccaggggcttaatctctgcctcatgatgccccttcttcttaaggatgccaccca

SEQ ID NO: 176407 - DNA, 601 bp, Human
tactgggagcttagggcaggggctccggagctctcgcacgcagctctgggctcaggcccctccgaccacactccatgctgtcaaatggtgggacagtccaggccaccctctgagaagagtgtcacagaaggcgctcctgtggcctcctagcactggggacaccagttgctcaccatgagaagcccacctcctcagcgaagccctctgcaactcagccggagggatctgcccccatttggagtccacacccacaaacaagccacagctgacttttttggcatctctgagtggcctgtgtgggtgggcagagctgaacacatttccaaaagctaaggtagagggtcccctccttggtccaggaacccaggaagggtggtacagtccctcctggctcccccaaggtgtcccaggatgccccccagcacacacatgaagggcgaggctgccagtggggcagggaggattctcaggggcgactcggggcactgctcctcagatgaggataacaaggcctttgaagtgtggcagcagctgccggtctctggctcccagctggtctgtggggccctgcaatagccgaaaagtccccctccctcactgt

SEQ ID NO: 176408 - DNA, 601 bp, Human
tctccagaccatttataaacagaaacgtctacctgaaaagcaatagaccttgttgaaaagagggtatagccaccacacagaatgattacagaattacttgccatcagggaccatgtacttaagtagttgttgaagtggcttctcttccatctgccactgctctgactctgggtgtgaattggagaaagacaacagaggccaggtgctccagaaaacagggatgccctcaggtccgcgtgcccttgctttggtggacttcctgctgctcccgtccagtggaagggggcagttatctctttgsatgactgtttacaaactccccattttctcttctttctcctgcccaatggctgtgcttcggcacacatttaggtcatgtgcagagcgtatctcacctccagtgggagggaagtgtacaggaaagtctgcggagtgtgagaaactccaggtgtgctctccccatgctctccgctccgtgcagcctctcactccactttcttttattttctctttcccccttttttttttttgagataagagtcttgctctatcgccaggctggagtgcagtggtgctatctcggctcactgcaacctctgcc

SEQ ID NO: 176409 - DNA, 601 bp, Human
cattgacggcatgtcgaggagtgatccttccagatggctaggctgctgcaggacgggctcctgacttgacagccactgtctcctgagcgtgagccaggactgtattgtgtgtgcctatgtcactatctgtgcaatggctctgcaaggaaggtatgatcatccactctacgaataaggacatcgacgctcagagagaggaaaggccacacagttgttgaaggattcaaacccagttcctcctgacaccaggctcgtgtctacccatagggtgggtacccatgtgggtaccatgtctcgggtygtagctcttcgtcacccagccactcatcacgtgcttccagagcgtttgctatgcttggagagcccggggtgaatgaaaccaactctactcttgctcccctggtgtttggattctagaggggagagagaatctgctgtgtttaggcaggaggcggtggtggtcaggaccagcctctcccagggagaggcatttgaactgaggcctggaggcctggagggtgaggaagagccagctacccgaggaactttcaggctgtgggaagagcacctgcaaaggcccttcctgggacaggaaagaaaa

SEQ ID NO: 176410 - DNA, 601 bp, Human
tcctgacaccaggctcgtgtctacccatagggtgggtacccatgtgggtaccatgtctcgggtcgtagctcttcgtcacccagccactcatcacgtgcttccagagcgtttgctatgcttggagagcccggggtgaatgaaaccaactctactcttgctcccctggtgtttggattctagaggggagagagaatctgctgtgtttaggcaggaggcggtggtggtcaggaccagcctctcccagggagaggcatttgaactgaggcctggaggcctggagggtgaggaagagccagctacycgaggaactttcaggctgtgggaagagcacctgcaaaggcccttcctgggacaggaaagaaaacgggtctgaggaataaaaggccaccatggctgcagaaagcaagcaagggggagaggggtaccaggtgaggctggagagacccgaagggcgagcacctgcagagctttgacggtcataaagaggagtgacgctctcatctccctgtctgtaaggaccctcacactcactattcttggggaagtggctggtggggagaaattaggtatccccagaacaacccaagcaggaattacagta

SEQ ID NO: 176411 - DNA, 601 bp, Human
tggtcaggaccagcctctcccagggagaggcatttgaactgaggcctggaggcctggagggtgaggaagagccagctacccgaggaactttcaggctgtgggaagagcacctgcaaaggcccttcctgggacaggaaagaaaacgggtctgaggaataaaaggccaccatggctgcagaaagcaagcaagggggagaggggtaccaggtgaggctggagagacccgaagggcgagcacctgcagagctttgacggtcataaagaggagtgacgctctcatctccctgtctgtaaggacccycacactcactattcttggggaagtggctggtggggagaaattaggtatccccagaacaacccaagcaggaattacagtagagttaactttgaccgagcacatgctataggccaggtggtgtcctagcactgtgcctgaatggactactttacttcggacaccacggtacagagaagttcaacaatttgtccaaggtcaccaagaaatacagttaacccttgaataccacagggattaggaatgctgccccgccatgcagtagaaaatctgcatataatttttgactccccaaaagcttaa

SEQ ID NO: 176412 - DNA, 601 bp, Human
tgctatatgtattagatagtatatttttcttttttttttagacggagtctcactctgtcgcccaggctggagtgtggtggcgtgatctaggctcattgcaacctccgcctcccaggttcaagcaattctcctgcctcaacctcctgagtagctgggattatgggcgcccaccaccacgcccagataatttttgtatttttagtagagacgaggtgtcaccatcttggccaggctggtcttgaactcctgacctcatgatccacctgccttggcctcccaaagtgctgggattacagtcgtragtcaccacgcccggactttttttttttttttttggagacggagtctccgtcacccaggctggagtgcaatggtgtggcctcggctcactgcaacctctgcctccagggttcaagcgattctcccgtctcagtctcccgagtagctgagactacaggcgcatgctaccacacccggctaatttttgtatttttagtacagacagggtttcactatgttgtccaggctggtctggaactccagacctcatgatctgcctgtctcagcctcccaaagagctgggattgcaggcatgagccac

SEQ ID NO: 176413 - DNA, 601 bp, Human
tagtatatttttcttttttttttagacggagtctcactctgtcgcccaggctggagtgtggtggcgtgatctaggctcattgcaacctccgcctcccaggttcaagcaattctcctgcctcaacctcctgagtagctgggattatgggcgcccaccaccacgcccagataatttttgtatttttagtagagacgaggtgtcaccatcttggccaggctggtcttgaactcctgacctcatgatccacctgccttggcctcccaaagtgctgggattacagtcgtaagtcaccacgcccggmctttttttttttttttttggagacggagtctccgtcacccaggctggagtgcaatggtgtggcctcggctcactgcaacctctgcctccagggttcaagcgattctcccgtctcagtctcccgagtagctgagactacaggcgcatgctaccacacccggctaatttttgtatttttagtacagacagggtttcactatgttgtccaggctggtctggaactccagacctcatgatctgcctgtctcagcctcccaaagagctgggattgcaggcatgagccaccgcgcccagcctatat

SEQ ID NO: 176414 - DNA, 601 bp, Human
tttttagacggagtctcactctgtcgcccaggctggagtgtggtggcgtgatctaggctcattgcaacctccgcctcccaggttcaagcaattctcctgcctcaacctcctgagtagctgggattatgggcgcccaccaccacgcccagataatttttgtatttttagtagagacgaggtgtcaccatcttggccaggctggtcttgaactcctgacctcatgatccacctgccttggcctcccaaagtgctgggattacagtcgtaagtcaccacgcccggactttttttttttttttttggagacggagtctccgtcacccaggctggagtgcaatggtgtggcctcggctcactgcaacctctgcctccagggttcaagcgattctcccgtctcagtctcccgagtagctgagactacaggcgcatgctaccacacccggctaatttttgtatttttagtacagacagggtttcactatgttgtccaggctggtctggaactccagacctcatgatctgcctgtctcagcctcccaaagagctgggattgcaggcatgagccaccgcgcccagcctatatactgtattcttacaacaa

SEQ ID NO: 176415 - DNA, 601 bp, Human
tatattttaagagaggaggtggttctcccacaaaacgtggcatcggtacctggtgtcaaggaggtttttgttttctaggtaaaagaagggagagttctagaaaggaaaagaatttcacatctgtttgggactgtggagattctctagcccaacctcttaattttatggccgaggaaacaagctccagtgaagcaaccggactttcccaaggtcataagctagtaagtgggagggcggaaacatgtactcgggccctggctcaggtcagagcttcaggaatgctccctccacgctagtgttkatctggatgcgtgggcaacccgacaccccgctctagggcggccaagcctgctcaggccatccctacgacttggcaggtcgcggtccccggccctgccctcaggcgacctctgggtcgcgtgggagcagaagtgcgggctaagctcagcgtccctgccccgcgaccctgggcagagtccccagaacaaaaagacccgtccctcccttcccctcccgccccgccacagccccgcacgtgcggcgcctcgtgcaccgccccgggccccgcccccgccctccattggctgttcccgcgccttcc

SEQ ID NO: 176416 - DNA, 601 bp, Human
ccctacgacttggcaggtcgcggtccccggccctgccctcaggcgacctctgggtcgcgtgggagcagaagtgcgggctaagctcagcgtccctgccccgcgaccctgggcagagtccccagaacaaaaagacccgtccctcccttcccctcccgccccgccacagccccgcacgtgcggcgcctcgtgcaccgccccgggccccgcccccgccctccattggctgttcccgcgccttcctcctctgccccctccccccgcgaccagactcggctgcggctccacgtgacccgcggggggyggacacgccgcgcgagcaggagctcggataggtcgctttggccggcctggccgctccgagctccgcccctcttcggtggcgcgtcgggaaggttgcaagtcggggacaagagggagaggctgcggtggttggggagggcgggggttatgaagagggcggtgaagggggaacactggtaggagggaagggaccgcgccgaggaaggcccaccacaaagactccagcaggcgccaatcaggggacacaggggcggcggggcggggcctccgcgagggtcctcacctggccccgcacgtgtct

SEQ ID NO: 176417 - DNA, 601 bp, Human
tctgctgagcgggtggggggggtgtgggcgagtagtgtgaggcgccttgggaggggagttttgggccaagcagagaaacgatgagggtcagatgagtccactgaggcccttcgcctggttggttggggctgacccttagattctggggccacggcggcaggactgagcttcatctttttgcctaggccaggaacgtcactggggcgtatacggaaagcaggtctggccttgtttttcgccctgggagatggggtgcagggagcagcaggagggccgcctgtggtggggttgtgggtgcacwgaggtatactttgagtgtgagacctttgcatttccaagagccatcagttattcagggtttgggaaagggataggccttcgagagttgtctggcctggggaatggattttcctttttaaaatgccatttctcttcctttcctgggtgtatgctgaggctcccatccctgtggctgtcactgttgagttataaatagcttcagcacatcaggtgaggccagcctctctcctcctgctttgggacctcatgtgcacaaacccttttgtttgtttttgagacggtgctttgttccaaatctggg

SEQ ID NO: 176418 - DNA, 601 bp, Human
tgagtgatggactagtcctttatctcttacaatttaaaattccaccttacaaaaacactgatttaaagtatcctttattgcttaggccaggcaaaacctggaacttattgttgcctgtctttcactatggctgcttttctatctcctgccttctcctgcctcctttgatcccaaatgaccccacccgacatgggtcacagtcatttctgaacagagtgaggagtccagatctcaagggaggagagcaggaaggccatctggcccacccagcccaccaaggcttgactttcttacttctcakttggttttaaaccaaagcctggtatagaaagcagttgcaggaattcagattaatttgtattagaaagccatgaccaagttgtttgtcaaaacctccaccttcttaactcactgggtgtgttcatttttattggaccaacaagctgctatttggtctgggagtccatgtgtggctggtttatttccaacttaatcatatttgatttctccttttcacttataaatccagagttcaaaattgtctccctcaattttgaaaacccatcatgagcttgtcatgattttatctcccacttccctg

SEQ ID NO: 176419 - DNA, 601 bp, Human
aaaaaaaaagaaagcattcccaccacctggccaggacaaacatcatcttcagagtctgtccttattcctcctccttttacattttatctctgggggtttgttttcatgctccttggacacgaacctaccaaaggagacatggctcctgttgcaggggttctgcaaagctttctgcagtctctgaggcatacaggctgatagctcctgccagtcggtatgtcaccccaggaatccacacccaataagttctcatactctatttttttttctttttattgtggaaattttttcaaacaaaatwcaaaagtaagagacgactataatgaacctctatgtaaccgtcacccagcttcaacaattctcaactcagaagcagttattttcaatcaaattataagtatttcaatatgtatctaaaatataagggttcttttaaaaaaaacataacgaaaatactagttttacatctaaagttgacaataaatccatcaacattcagatttccaaagttgtctcataaatggtattttacaggccgggcgcagtggctcacgtctgtaatcccagcactttgggaggccgaggtgggtggatcacgagg

SEQ ID NO: 176420 - DNA, 601 bp, Human
gagtcttgcttttgtcgcccaggctggagtgcagtggcggggtctcagctcactgcaacctccgcctcctgggtttaagcgattctcctgcctcagcctcccaggtagctggtattacaggtgtgcgccaccactcctggcttatttttgtagagatggggttttgccatgttggccaggttggtctcaaactcctgacctcaggtgatccacctgcctcaccttccaaagttctgggattacaagtgtgagccactgtgcctggcccatctacatgttttttggtaaatatatatatgcrtttcttttgggcatttgcttaggaagagaatggctaggtcattggacatgcatatgttcagtttgtgtagaccctgccaaatagcgtacaaagttgttatatccatttgtactcacaccagcagggcattggagttccattgtcagcctttgattttgacatcttttgtaatggtggacctatgagagaattatatttcaggcaagttaccaacagatctattccctttccctcttcttccagcaaagtcattttaaggtctcattgtcatctttttttttttttttttttttttttgag

SEQ ID NO: 176421 - DNA, 601 bp, Human
tggccaggtgcagtggctcacacctgtaatcccagcactttcagaggctgaagcaggaagatcacttgagcctaggagtttgagaccagccctggcaacataatgaaaccctgtctctaaaaaataaaaaaaaattagccaggcgtgttggtgtgcatccgcggtcccagctactcaggaggctgaggcaagaggatcactccagcccagaaggtcgagggtgcagtgagccatgatcataccactatactccagcctaggtgacagagcaagaccctgtctcaaaaaaaaaaaaaaaaaattggaacccatttccattcttcagtctgtgtctgcctggagagacacagctgtttctcattactggagatcttgaaatcacaggaagttaagggaatataaaaatttaatgttttaggctgggcgcagtggctcatgcctgtaatcccagcactttgggaggccaaggcaggcggatcacaaggtcaggagatcaagaccatcctggctaacacagtaaaacctcatctctactaaaaatacaaaaaaattagccaggcttggtggcgggcacctgcggtggcaggcgcctgtagtccca

SEQ ID NO: 176422 - DNA, 601 bp, Human
ctcacctcaagtgatccacctgcctcagcctcccaaaatgctgggattacaggtgtgagccaccatgcctggcctgttatttctcagtgtaaagataagggacctgtgatattgaggggttaaagtacttgcacagtttcactgctagtaatcttggagagccaagatctgaactcggggatctaggcccttacccacaaccaacatgcctaagtaaggcaagggtgtggacagtgcaatgctttgtgctggagcagcaggtaccaggcctccaggagatgagtctccttctcttcaccaygtaacgtaccaaataacttttgtttctcgtcctgcccccgaggaaagggcagtgccctcaatgtgccctggtttgtgctgctccctccctggtatccctgctttagctctggccacaccagatgagttaggggaatccaggtggtgggagtggaaaaattgggttctctcgtggggaaagacgagagactcacagagggcacttccccacaggatgaaaagtactggacaagacgcaagaagaacaacgtggcagctaaacggtcacgggatgcccggcgcctgaaagagaatcagatca

SEQ ID NO: 176423 - DNA, 601 bp, Human
gggtgtaatggttcactcctgcaatcccagcatttccggaggctgaggtgggcggatcgattgagcacaggagttagaaaccagcctgggcagtatgccgaaaccctgtctccactaaaaatacaaaaactagctgggtgtggtggcaggtgcctgcagtcccagctacctgggatgtaaggtgggaggatcacttgagccccgtaggtggaggctacagtgagctgagatcttgctgctgtacttctggagaccctgtttcaaaaaataaattaaccagaaaccagcccagtgcaataaytcacacctgtaattccaacattttgggaggctaggcgggaagatcactttagaccagggttcgagacaagcctgggcaacagaatgagaccctgtctccacagaaaaatttaaaaattagccaggtgtgatggcatctgtagtccccatgacttgggaggttgaggtgggaggatcgcttgagcccaggaagccgacgctgcagttcagcggtgatcgttccactacactccagcctgggtgacagaaggagaccgtctctaaaaagataaaaaaatttaaagaaaaaccaacaaaaaaa

SEQ ID NO: 176424 - DNA, 601 bp, Human
accctagagataaatcactggaagaaaggaaaacagcatcagagaaggaacagttctagaaggtgcaggaggtagtaaaagaacagaaaaatcatgtcttagcctataagaagctaccatctcattacaagtcctcctctgctaaactgccgcagctggacacccagcaacaccatgtgagctgcccatttcctgggccccttcagtgaatggcagtcaagtcccaaaccaaaggctgcagagtctggcccaagcacacacctgcttgagcatcttggctgttctctgtttgagggtcccrttcctcaaacaggacacagatggctatgggatccagatcattcatcccagagaatgccccaccacccacgctggcatgactctggggtggggcacaggggtcagccccactgcacgtctggtttcaaccgtggccgggagactgggcaggccacaatggcccctcaggggtttctagatcagagatcgccacatcacaacagctaccatcataataggacagggacagggctgctacctatgaagccctactatactcaagtctaccagaagatttgggtagaaatggggttgataagcc

SEQ ID NO: 176425 - DNA, 601 bp, Human
tctgccagcttggcaatgtcttccgaggccatgttgactaggctggtgggctcccctggagatctgcagactgaggaggccaaagttgcagtaagaaaaaggagtctcctggggcccctggttgggggcagggtaggacatcagccatctcaggagtctgaccctacctcccctgctatggagaccctagagataaatcactggaagaaaggaaaacagcatcagagaaggaacagttctagaaggtgcaggaggtagtaaaagaacagaaaaatcatgtcttagcctataagaagctacyatctcattacaagtcctcctctgctaaactgccgcagctggacacccagcaacaccatgtgagctgcccatttcctgggccccttcagtgaatggcagtcaagtcccaaaccaaaggctgcagagtctggcccaagcacacacctgcttgagcatcttggctgttctctgtttgagggtcccattcctcaaacaggacacagatggctatgggatccagatcattcatcccagagaatgccccaccacccacgctggcatgactctggggtggggcacaggggtcagccccactgcacgt

SEQ ID NO: 176426 - DNA, 601 bp, Human
gtgcacaacttccagaaactcaccatcttctgcagtgttgagtttgaggctcttgcctttgaaactcagctgtcccccggccacctgagtcttggcaagtgtctctgccagcttggcaatgtcttccgaggccatgttgactaggctggtgggctcccctggagatctgcagactgaggaggccaaagttgcagtaagaaaaaggagtctcctggggcccctggttgggggcagggtaggacatcagccatctcaggagtctgaccctacctcccctgctatggagaccctagagataaaycactggaagaaaggaaaacagcatcagagaaggaacagttctagaaggtgcaggaggtagtaaaagaacagaaaaatcatgtcttagcctataagaagctaccatctcattacaagtcctcctctgctaaactgccgcagctggacacccagcaacaccatgtgagctgcccatttcctgggccccttcagtgaatggcagtcaagtcccaaaccaaaggctgcagagtctggcccaagcacacacctgcttgagcatcttggctgttctctgtttgagggtcccattcctcaaacagga

SEQ ID NO: 176427 - DNA, 601 bp, Human
tccagaccagttcccctggttgggccagaatcccaggaggcctcacttgatgcaggtgccttcacttgcaggtgccaggtgattcagggttggtcagtggcagccaagccttgacaagggatgaaaagacagggtctgctctctggttcctagttttctgtggttgcaatacctgtatacacacagacagccatccctctcccaggtacatctggttgcatgaaccagcatctcccaagagggcccaggttgttttaatgcagctccaccagagcctcagctctggggaaagctgcagctgttcccaggcctgcctgggatcatgggggttaagggcaagggtggggacaacaccggatattaagtcagagtcagaggctgtatcttgggactggcactaactgtggcccctcattacctatcatcccctcctgagaaagaaagggcagggcacaaagggatgcccaatacaaacatggaaagtgcaggggagcttgctcctgggcaaatgatctctgagcctcattgttagaataggcccaatgatacctcacagagctgctgggacaaataatggagacaatgtagcagaaagagcctg

SEQ ID NO: 176428 - DNA, 601 bp, Human
cagatcacctgagatgaggagttcgagagcatcctgaccaatatggcaaaaccctatctctactaaaaatacaaaaattagccgggtgtggtggtgggcgcctgtaatcccagctactcaggaggctgaggcaggagaactgctcgaacccgtgaggcagaggtttgcagtgagctgagatcgtgccactgcactctagcctgggtgacagagactccatctcaaaaaaaaaaagtgataaatgcacagggaggaagtctataaacgttagaccttatggagatgttaggaacatgcatcrgcacgctcccagctacccaaggactcaagcagcctccgacctggagaggagaacaaggctgcctacacaacatgacaaccaggcatgtccagaccagttcccctggttgggccagaatcccaggaggcctcacttgatgcaggtgccttcacttgcaggtgccaggtgattcagggttggtcagtggcagccaagccttgacaagggatgaaaagacagggtctgctctctggttcctagttttctgtggttgcaatacctgtatacacacagacagccatccctctcccaggtacatct

SEQ ID NO: 176429 - DNA, 601 bp, Human
cagcctggccaacatggcaaaaccccgtctctactaaaaatacaaaaataaggggccgggcacggtggctcacgcctgtaatcccaacactttgggaggccgaggtgagaggatcatgaggtcaggagatcgagaccatcttggctaactaacacggtgaaaccccgtctctactaaaaatacaaaaaaattagccgggcgtggtggcgggcgcctgtagtcccagctactcaggaggatgaggtgggagaatgacatgaacccaggaggcggagcctgcagtgagccaacatcatgccartgcactccagcctgggtaacagagcgagactccgtctcaaaaaaaataataataataaaaatacaaacacaaaaataggctgaaggccagacacagtggctcacgcctgttatcccagtactttgggggctgaggcgggcgaatcacctgaggtcaggagttctagaccagcctgtccaacatggtaaaaccccatccctactaaaatacaaaaaattagcggagcatggtggtgggtgcttatagtcctagctactcaggaggctgaggcaggagaatggcgtgaaccagggaggcaga

SEQ ID NO: 176430 - DNA, 601 bp, Human
tggcaagggatgaaaagacttcctgggtgctcttaaagtaaaagtgagacctctccctgccttacttcccagagccttttcacttgttttcatagagtatattcacattttgccttcacttagttacctgggtatatcattcctattccagatttgctgcttcttaggagctgggtaagctgggcacccctggggacttacaaaatgggagacaccacattcagcctgtgctgggagagtaaagaagttaactggatggatttcagagccagccaaacttgagttttttttttttttttttgagatagtctcgttctgtcaccgaggctggagtacagtggtgccatctcggctcactgcaacctccgcctcccgggttcaagcgattctcctgcctcagcctccggagagtagctgggattacaggtgtccaccaccacgcccggctaatttttgtatttgtagtaaagacagggtttctccatgttggccaggctggtctggaattcctgacctcaggtgatctgcccacctcggcctcccaaagtgctgggattacaggcgtgagccaccgcacctggcccaaacttgagttctaatc

SEQ ID NO: 176431 - DNA, 601 bp, Human
ggtgcagtgagccgagatcgtgtcactgcactccagcctgggagacacagcaagactccatcttaaaaaaaagtcaggcatggtggcatacgcctgtaatcccagcattttgggaggccaaggcaggcggatcacaaggtcaggagttcaagaccagcctgaccaatatagtgaaaccccatcttcactaaaaatacaaaaattagctgggcgtgatggcacatgcctgtaatcccagctactcaggaagctgaggcaggagaatcacctgaacctgggaggcggaagttgtagtgagccragatcacaccactacactctagcctgggcgacacagtgagactctgtctcaagaaaaaaaaaaaaaaattaggctggtgtggtggcgtgcacctgtagtctcagctacttgggaggctgagctgggaggatcagctgagcctgagaagttgaggctgcaatgagccatgatcatgccatagcactccagccagggggacagagcaagaccctgccttctcaaaacaaaacaaacaaaaaaagagagacaggaagacagagaggaggacagaggttcactgtggcacgttacacaaatagt

SEQ ID NO: 176432 - DNA, 601 bp, Human
tggtgagtgcacataatcctagctacttggcaggctgaggcagaagaatcacttgaacctgggaggtggaggttgcagcaagccaagatcgcaccactgcacaccagcccgggtgacagtgtgagactccatctcaaaaaaaaaaaaaaaaaaaaaaaaaaaggccgggagcagtggctcatgcctgtaatcccagcactttgggaggccgaggcgggcagatcacaaggtcaggaattcgagaccatcctggctaacacagtgaaaccccatctctactaaaaatacaaaaaaaaattasccgggagtggtggtgggagcctgtaatcccagctactcaggaggctgaggcaggagaatcgcttgaacccaggaggcggagattgcagtgagctgagattgcgccactgaactccagcctggacgacagagtgagactccgtctcaaaaaacaaaaaaagagaacttgcctctgctgcgaggagtgtagggagctggcagtctccagctacagcaccttcctattgctgcggcatttgagctgaggcctggccacttctgcccaacatgagattcctttaaatgggcaatctttgctctg

SEQ ID NO: 176433 - DNA, 601 bp, Human
gcagaggctcacgcctgtaatcccagcactttgggaggccgaggcgggcggatcacaaggtcaggagattgagaccatcctggctaacatggtgaaacccgtctctactaaaaatacaaaaaattagccggcatggtggcaggcacccgtagtcccagccacttgggaggctgaggcaggagaatggcatgaacccgggaggcggagcttgcagtgagctgagatcacgccactgcactccagcctggggacagagcgagactccgtctcaaaaaaaaaaaaaaaagagcttgggctgacrcctggactccacctcagcctactcctagttgtgtgactctgggctacacttctctcgcccgtcaagacctcactcctcacttgcacactgctgcagcagcagagagaacccctctggcatcagcactacgcccggaacactgggccatcaagggcagatcccaccctgcccctgccctgggctgcttcctgcacagaggagggcctaggaggtggtgtgcagtgattcactcgagccactgcatctgtagcaggcgggaaggtgcatgcagcactcctaccggccaggctctcccaggac

SEQ ID NO: 176434 - DNA, 601 bp, Human
atcaagaggcctccaagagttattgggggctcacaagtgtcaggaaaatccctgacttgtacaaccctctaggtggacgtgtgacgtggttatggatgacagagaaacatgaacataaacaacacagaattctacgttgagggccagtggctcacgcctgtaatcccagcactttgggaggccgaggcgggcagatcacttgaggtcaggagttccagaccagtctggccaacatggtaaaaccccttctctacaaaaaatacaaaaattagcatagtgacggggactttttaacaaaggragagcaagcctcaggctcagagccattaaacagcaacagcatcaaataataattcagtaacactattttatttcctttattgtaaggaatgtcagctttccattcatagaagtgctttgaaattacatgaaagtttgctgttttcttcgttttttttaagagataggttctcactctgtcgcctaggctggagtgcagtggcagaatcatagctcactgtaaccttgacctcctggcctcaagtgatcctcccaccttagcctccacagtacctgctattacaggcatgtgacaccactc

SEQ ID NO: 176435 - DNA, 601 bp, Human
gaactaccagagcatcacaagacttttttcttttttttgagacggagtttcgctcttgttgcccaggctggagtgcagtggcgcgatctcagctgatcacaatctccacctcccgggttcaagcaattctcctgcctaagcctccggagtagctgggattacagacgtccaccactatgcctggcaaattttgtatttttagtagagacagggtttctccattttggtcaggctggacttgaactcccgacctcaggtgatctgcccaccttggcctcccaaagtgctgggattacaggcrtgagccaccgcacctggcccccaagacttaacttgagctttgtttgtaaaaagctggacccattctggctgtagttggtgggacctggaggccagtcctcaaatcaagaggcctccaagagttattgggggctcacaagtgtcaggaaaatccctgacttgtacaaccctctaggtggacgtgtgacgtggttatggatgacagagaaacatgaacataaacaacacagaattctacgttgagggccagtggctcacgcctgtaatcccagcactttgggaggccgaggcgggcagatca

SEQ ID NO: 176436 - DNA, 601 bp, Human
ctggtggctgggtgcggtggctcacgcctgtaatcccagcactttgggaggccaaggcgggcggatcacgaggtcgggagatcgagaccatcctggctaacacagtgaaaccccatctctactaaaaatacaaaaaattagccgggcatggtggcgggcgcctgtagtcccagctacttgggaggctgaggcaggagaatggcatgaacccgggaggcggagcttgcagtgagccgagatcgtgccactgcactccagcctgggaaacagagtgagactccgcctcaaaaaaaaaaaaaaagcctagcccctggcgatctggcctcaactgacctctagccctgaagcaaccacagctgctcaaacaccctgtgcctactccaccacatgccatcttctaaccccaaattctcttatccccctcttaagatttattctcacgattgggaacatagagataagaatactttctcttccccattcctacagagtcaagtaaaagaaaacaaaaaccaaaagaataccttctgaaagctcagggaaatgaaatgctaaaatttaggcaaaacttgcacagtgagaattccacagtgagtatgca

SEQ ID NO: 176437 - DNA, 601 bp, Human
acagaggaagctcgtgtcagtttcatagacacccagcttctgtgctgggtgctgcttctgtgccaggcccagctctgccttccaaggacaccccggctggtgcagaaccagcacagacacaaaccatttcagtattcttaagactggaaaccctgcaaagggctcctaacagctggagagtgggggatgcgtatgcctggagtggcccgggaaggctccttgtaagaggtggcatttggacttagtctggatgagaatcagctagtcaacatgaaaagactccaggcagctgaaaaaacakgagcagagagacataagcatgaagcagcaggctgtgagcctggaggaaagctgtgggtaggctccagaagaagccgtggcatgggctttgggtggaagggaagtgaggggtcagatcaggcaagagccttgaatgccaggccaaggactgtgagcctcagcctgagagcagtgggctttgaggtggctgagggatatggaattaatatccccagacctgaggtgagcagatgcacagaaaggggggctggagtgcccacccaggagtgtgaggcagcgacactggcaacagaggggacct

SEQ ID NO: 176438 - DNA, 601 bp, Human
ccaccttgccgccgccaatgcccatgccacagttgttgagcttgagttcctgcagggtgaagcaggctgagctcttgagcagggcctcgaagccttgcacaccgtcgggcccgaatgcgttgtcgcttaagtccagctccaccagctgagccccagctgtgatgagtccttcccctagtgagatctgggcacagaggaagctcgtgtcagtttcatagacacccagcttctgtgctgggtgctgcttctgtgccaggcccagctctgccttccaaggacaccccggctggtgcagaaccarcacagacacaaaccatttcagtattcttaagactggaaaccctgcaaagggctcctaacagctggagagtgggggatgcgtatgcctggagtggcccgggaaggctccttgtaagaggtggcatttggacttagtctggatgagaatcagctagtcaacatgaaaagactccaggcagctgaaaaaacaggagcagagagacataagcatgaagcagcaggctgtgagcctggaggaaagctgtgggtaggctccagaagaagccgtggcatgggctttgggtggaagggaagtgagggg

SEQ ID NO: 176439 - DNA, 601 bp, Human
gctctaccagctgctctgcgggtacagtgagtatagggatgccccaagccctgagttttgcagaggcagcaggctggagcaggtatgcagtggcactccctctgcgttgccaagccaacccaagaactggggatggttgcttggcaaccccaccctcatggacgcctctaccctccggccacaggctgttgcctttgaggcctttctcttttgaaaacaacggctgaccatcccagatggtggtggccaagggccagggcacatatgtcagacggatgtggatggaccaggggactctgcrgggagggggctgccacacccaccttgccgccgccaatgcccatgccacagttgttgagcttgagttcctgcagggtgaagcaggctgagctcttgagcagggcctcgaagccttgcacaccgtcgggcccgaatgcgttgtcgcttaagtccagctccaccagctgagccccagctgtgatgagtccttcccctagtgagatctgggcacagaggaagctcgtgtcagtttcatagacacccagcttctgtgctgggtgctgcttctgtgccaggcccagctctgccttccaaggacacc

SEQ ID NO: 176440 - DNA, 601 bp, Human
ctaaaggcactgggatggagttggaagagaataatacggcaggccgcccttgatgcaggttctgggaagcaaagaagctccactctacactgaccagcccaacgtgaagctctacactgaccttgcctgaggacacctccctgggcaaggccctgtctaggaataaaggtgagctgtgacggtgcccccctgagcatatgctcctcttttcagactccctctgcctatgtgccaggctctaccagctgctctgcgggtacagtgagtatagggatgccccaagccctgagttttgcagagscagcaggctggagcaggtatgcagtggcactccctctgcgttgccaagccaacccaagaactggggatggttgcttggcaaccccaccctcatggacgcctctaccctccggccacaggctgttgcctttgaggcctttctcttttgaaaacaacggctgaccatcccagatggtggtggccaagggccagggcacatatgtcagacggatgtggatggaccaggggactctgcggggagggggctgccacacccaccttgccgccgccaatgcccatgccacagttgttgagcttgagt

SEQ ID NO: 176441 - DNA, 601 bp, Human
agatatccccaactgctgttacttctgtgtccccagcccttttctccctttggttagaaagtgtgtgtaggggttgcagcctggcactcagtgtcctccaaccctgggtctaaaggcactgggatggagttggaagagaataatacggcaggccgcccttgatgcaggttctgggaagcaaagaagctccactctacactgaccagcccaacgtgaagctctacactgaccttgcctgaggacacctccctgggcaaggccctgtctaggaataaaggtgagctgtgacggtgcccccctragcatatgctcctcttttcagactccctctgcctatgtgccaggctctaccagctgctctgcgggtacagtgagtatagggatgccccaagccctgagttttgcagaggcagcaggctggagcaggtatgcagtggcactccctctgcgttgccaagccaacccaagaactggggatggttgcttggcaaccccaccctcatggacgcctctaccctccggccacaggctgttgcctttgaggcctttctcttttgaaaacaacggctgaccatcccagatggtggtggccaagggccag

SEQ ID NO: 176442 - DNA, 601 bp, Human
gctagaatagagtctctggctctcccagcgtatgccactcactctaggttgggccacgcctgctttctgtgctgacgcaaacgtttttatatgtttctgtttgtttgtttgtttgtttgtttttttgagacggagttttgctcttgttgcccaggctggagtgcagtggcgccatctcggctcactgcaacctccacctcccgggttcgagcaattctcctgcctcagcctcccgaatagctgggactacaggcacctgccaccacacccagctaatttttgtatttttagtagagatggrgtttcaccatgttggccaggctggtctcgaacgcctgacctcaggtgatctgcccgactcggcctcccaaagtgctgggattacaggcatgagccactgcaccaccgtgcccggcccatttttacatcttaacacagggatagcttattgcccaagtggacttgggggagggctggctaaggcaggcacagagcctgcccctgctcaccctcacgtcaggccgagggacacaggcaccctctgcaggggaggccactccagctcctcagcctggggctccatgggcctcacagcactagc

SEQ ID NO: 176443 - DNA, 601 bp, Human
gtgcacctcaaggctgcaggggcaggatggacagaaaccactcaccctaaaagcttctgccaaggcagtggcgccatcattctccagacggtttctgccagccacaaagaccttcagggccagaggcttgccttgggcactggatttccggtgacattcggtcagagctgcagccaggatctgtggggaaaggcaaggggccctggtcatgggcaggagccccttctcccagcggggtggccactgctgctgaactgctcttcaacatcccacgccacccatcggtgcaggtcaggggacrcaggactgctaacagctcaacagtcacaccttaaatatgtccagcacttcagttacacaaggtttttatctctaatgctgtgtcacaccagcctgagaggtttagcttcactttcgagacggggagaccaagccctactcaggaaagggagagaccacatggagtggatgaacttttagccaggtccaggggaaggacttcctagtcagctcacttcactgtctaaggccctctgctaggtgggaaaatcatggctcccattttccagctgaagaaactcagggtaagaggaacggaaac

SEQ ID NO: 176444 - DNA, 601 bp, Human
gggcacgtgacgccccaggtctcttggttgagtgccagccctgggattagcatccagaactgtcagcctactatgccgagtgcacctcaaggctgcaggggcaggatggacagaaaccactcaccctaaaagcttctgccaaggcagtggcgccatcattctccagacggtttctgccagccacaaagaccttcagggccagaggcttgccttgggcactggatttccggtgacattcggtcagagctgcagccaggatctgtggggaaaggcaaggggccctggtcatgggcaggagccycttctcccagcggggtggccactgctgctgaactgctcttcaacatcccacgccacccatcggtgcaggtcaggggacgcaggactgctaacagctcaacagtcacaccttaaatatgtccagcacttcagttacacaaggtttttatctctaatgctgtgtcacaccagcctgagaggtttagcttcactttcgagacggggagaccaagccctactcaggaaagggagagaccacatggagtggatgaacttttagccaggtccaggggaaggacttcctagtcagctcacttcactg

SEQ ID NO: 176445 - DNA, 601 bp, Human
cacatactgggggggattaagaacccccattctaagcccaccagaggacacctatgaaggctcaacacaaccacagcgcaccccctcctcccagtgcactgaggacagcaggctgacggcagggagggatccaaggatggcagtgaggcccccaccagctccagaggaggcagcaggagctcccctgcagccaggggtgcagggagacacaaggcagatctctgcgatgttcacttggcactgaagcaggcaaagggtatctacagacagcctcgatgggcagccaggacattccggcccrtatgagcaatgctcctaggatactgtttgctgaagaaaacatttaaattaagagaagaggggccggacgtggtggctcacgcctgtaatcccagcactttgggaggcccaggcgggcagatcacttgaggtcaggagttcgagaccacctggccaacatggtaaaaccccgtctctaataaaaatacaaaaattagccgggtgtggtggcgggtgcccgtaattccagctactcgggaggctgaggcagaactgcttgaacctgggaggcggagactgcagtgagccaagatcacgcact

SEQ ID NO: 176446 - DNA, 601 bp, Human
ggttcagggactacatgtgcttgtttgttatgtgggtagtcacaggcctttctaatgctgtgaggtttattgtctacatttataatcaaaggtcacactacatattttagctacattagtaataaataataatgttattttttcctcatccatgttcacagacccctgaattctatccacatactgggggggattaagaacccccattctaagcccaccagaggacacctatgaaggctcaacacaaccacagcgcaccccctcctcccagtgcactgaggacagcaggctgacggcaggragggatccaaggatggcagtgaggcccccaccagctccagaggaggcagcaggagctcccctgcagccaggggtgcagggagacacaaggcagatctctgcgatgttcacttggcactgaagcaggcaaagggtatctacagacagcctcgatgggcagccaggacattccggcccgtatgagcaatgctcctaggatactgtttgctgaagaaaacatttaaattaagagaagaggggccggacgtggtggctcacgcctgtaatcccagcactttgggaggcccaggcgggcagatca

SEQ ID NO: 176447 - DNA, 601 bp, Human
cccatctctactaaaatacaaaaattaactgggtgggcatggtggtgcacacctgtagtcccagctaatcgggaggctgaggtgggaggatcacttgagcctgggaagcttcaactgcagtgggctgagattgcaccgttgtactccagcctgggcaacagagcgagaccctgcctcaataaaattttttttttttttgggttcagggactacatgtgcttgtttgttatgtgggtagtcacaggcctttctaatgctgtgaggtttattgtctacatttataatcaaaggtcacactacrtattttagctacattagtaataaataataatgttattttttcctcatccatgttcacagacccctgaattctatccacatactgggggggattaagaacccccattctaagcccaccagaggacacctatgaaggctcaacacaaccacagcgcaccccctcctcccagtgcactgaggacagcaggctgacggcagggagggatccaaggatggcagtgaggcccccaccagctccagaggaggcagcaggagctcccctgcagccaggggtgcagggagacacaaggcagatctctgc

SEQ ID NO: 176448 - DNA, 601 bp, Human
ggcgcagtggcttatgcctataatcccagcactttaggaggccaaggcgagtggattacctgaggtcaggagtttgagaccagcctggctaacatggtgaaaccccatctctactaaaatacaaaaattaactgggtgggcatggtggtgcacacctgtagtcccagctaatcgggaggctgaggtgggaggatcacttgagcctgggaagcttcaactgcagtgggctgagattgcaccgttgtactccagcctgggcaacagagcgagaccctgcctcaataaaattttttttttttttgggttcagggactacatgtgcttgtttgttatgtgggtagtcacaggcctttctaatgctgtgaggtttattgtctacatttataatcaaaggtcacactacatattttagctacattagtaataaataataatgttattttttcctcatccatgttcacagacccctgaattctatccacatactgggggggattaagaacccccattctaagcccaccagaggacacctatgaaggctcaacacaaccacagcgcaccccctcctcccagtgcactgaggacagcaggctgacggcag

SEQ ID NO: 176449 - DNA, 601 bp, Human
aagtgattctcctgcctcagcctcctgagtagctgagattacaggcgtgcgccaccacacccgactaattttgtatttttagtagagatggaggtttcaccatgttggccaggctggtcttgaactcctgacctcaggcgatccagcttcctcggcctctcaaagtgctgggattacagacgtgagataccacacccggccattcagcattttcttgacaggctaactcatatgagttctagggctcttgttttggtcacctcctctcccaggaaggcttcctggattcccccagccacgrtccagtgtgcgttcctctgtgctcccggagcacctggtccctcctctatcacggtggtcctcatcctgcctacattcaaagcctatattccgtctgcatcccatcggcccctgagctttggaggagagggccatgtcccagtctccactgtgacccaggactgagggttggcctggcttaactgtgccaaggaatcttctgctgtcttcaggtgctcagtgcagcacagggcaatggggggagcgggtggtccacaaataaatacaggaaggccaacctgggcacactccaggtcaggcc

SEQ ID NO: 176450 - DNA, 601 bp, Human
ttttctttttttttccttttttgagacggagtctcgttccgtcgcccaggctggagtgtgatggcatgatcttggctcatcgcaacctctgcctcccaggttcaagtgattctcctgcctcagcctcctgagtagctgagattacaggcgtgcgccaccacacccgactaattttgtatttttagtagagatggaggtttcaccatgttggccaggctggtcttgaactcctgacctcaggcgatccagcttcctcggcctctcaaagtgctgggattacagacgtgagataccacacccrgccattcagcattttcttgacaggctaactcatatgagttctagggctcttgttttggtcacctcctctcccaggaaggcttcctggattcccccagccacggtccagtgtgcgttcctctgtgctcccggagcacctggtccctcctctatcacggtggtcctcatcctgcctacattcaaagcctatattccgtctgcatcccatcggcccctgagctttggaggagagggccatgtcccagtctccactgtgacccaggactgagggttggcctggcttaactgtgccaaggaatct

SEQ ID NO: 176451 - DNA, 601 bp, Human
cctgcacacatctctgctaacacacaggcagccggactagccttctgtggggccacgggaccctggcagccaagaagccactgcgttcagagcccagcactgttaccactggcagcttccttccctccttgagctagggtctccctgaaggcggggtctttggctcaaccccatgtggcctgcacttggtacaaagccaagcactaaatggggactcaaaaaacagctgctgggccaggcacagtggcctgcacctgtaatcccagctactcagaaggctgaggtgggaggatcacttgakcccagaagttcaagaccagcttgggcaacagtaagattccgtctcaaaaagtgataataaataacaaaacaaacaacagctgctgaacaaatcaaccaggaaaacagatgtggggagcagtctgctcctgtgcagcctgagaacaaaccagcggcagccgctgggggctgcagaggcggctcaggagaaggtggcatgaagaatcagagctgcccgaggagggcgtgggttaccttgggacctgcaaccctgttcaggacatgttcaaagagctggagccatggggcacacacccagggg

SEQ ID NO: 176452 - DNA, 601 bp, Human
aaccatggctcagaggggtgtggaggctcacacagcatcacagggcccgaagtggaggagctgggatatggacacaggcccacctgccttcagaccagacccctgtgcccccagccgccccaccacccacagaccccagagggaggacgtcaggcgtccaggctggcacctttagcttgggcaggccgccgcggatggcatctgcaatggcaactgcacccttggagcgcaccaggcagtccccaaaattaatcacctccacctgccgcaaggtcttcaaggtctgtgagggggaagcaakggtccagagtgagggtgcagaccacaccccagccctcagcaagccccgggggccccacacggtcacatcccaagccagccaccacacactgtcctcctctgcaagtcaccagctttgccgtcttctacttgttggcctctgggcccctggccaaacctcctccacccctccccatgttacggccagaactcttcctgagaccaaccaagcaaggttcctgctgagcatccgggtcttccacacgtaagctgatccctctgcctgaaacacccatcccccaccctctgtccagagaaagac

SEQ ID NO: 176453 - DNA, 601 bp, Human
ggccatgttgaagccctccagcacctcctgaagctgttcacagccttcttctcccagggtgttgcctgctcaaggggagggaagagcagtcagccggggtgccagggccagcctagcagacctgtgcagaggcctcccccatccgactaccattcaggtccagcttctccagctcagctttgtctgccatggcctcagcaacagccagggcagcatccctcttgatttcacagaatgacaagttcagctcctgaaaataagaggaagggttggaggcaggcagaaacccgggccaggacascaggttctactctaagcctcagtttccccaagtgaggatatggcaggctctgtcctccaggtggggcaaagtgggcaggaagaataacaccaacaacaaaaataatgccctgcagccaacgatgagtcacgtactgtgtttacttaaatcacaagacagtgatgtacaccactccctgcctcccgctttagaaatgaagaaaccatggctcagaggggtgtggaggctcacacagcatcacagggcccgaagtggaggagctgggatatggacacaggcccacctgccttcagaccagac

SEQ ID NO: 176454 - DNA, 601 bp, Human
atccaggagatggccactccccggccacccaccttcacctccaggtagactccccaggccccatggtctcttcctttctagagtcagcgtcttaagaacaatcccgagtgcagccccttctggctgcccccacctcccacccccatcactccccaggccccaccacatcaggatgagatctggcctcaccccttcagaggcctccccaactccaccactctacagggtggccccgctcagcccgtacgagctcctctgttgaacggacaactcattctgtctccaccccacgagacagaarccctgactgtcccatccttatagccctgatgcctagtgtatgacctagtacgtaacaggagtgcacccaacgtttctgaataaatacaagtagaaacaaataaaggggccaggtgtggtggtgggtgcctgtaatcccagctacttgggaggctgaggcaggggaatcacttgaacccaggaggtggaagctgcagtgagccgagatcacgccactgtactttagcctggggaacagagcaagactccatctcaagaacaaaagaaagaaagaaaggaatggcctgaccccgacctctgg

SEQ ID NO: 176455 - DNA, 601 bp, Human
tacaggtgtgggggaggaagaagagtaggggtgtccttgccccataggaaggctggaccatttcccagggacagtgggacctgtgaggttcagcccacctcggagtccccagttcctagcctcagctcagggcctagcaccgaggagacacgactgagtatctgacacacgaatgaggccgacttggagatgcgaggggcacagggagcccgatgctgatggcccaaccggacttggatccaggagatggccactccccggccacccaccttcacctccaggtagactccccaggccccayggtctcttcctttctagagtcagcgtcttaagaacaatcccgagtgcagccccttctggctgcccccacctcccacccccatcactccccaggccccaccacatcaggatgagatctggcctcaccccttcagaggcctccccaactccaccactctacagggtggccccgctcagcccgtacgagctcctctgttgaacggacaactcattctgtctccaccccacgagacagaaaccctgactgtcccatccttatagccctgatgcctagtgtatgacctagtacgtaacaggagtg

SEQ ID NO: 176456 - DNA, 601 bp, Human
gcccacatccacatgacctcaggaagctacaggtgtgggggaggaagaagagtaggggtgtccttgccccataggaaggctggaccatttcccagggacagtgggacctgtgaggttcagcccacctcggagtccccagttcctagcctcagctcagggcctagcaccgaggagacacgactgagtatctgacacacgaatgaggccgacttggagatgcgaggggcacagggagcccgatgctgatggcccaaccggacttggatccaggagatggccactccccggccacccaccttcrcctccaggtagactccccaggccccatggtctcttcctttctagagtcagcgtcttaagaacaatcccgagtgcagccccttctggctgcccccacctcccacccccatcactccccaggccccaccacatcaggatgagatctggcctcaccccttcagaggcctccccaactccaccactctacagggtggccccgctcagcccgtacgagctcctctgttgaacggacaactcattctgtctccaccccacgagacagaaaccctgactgtcccatccttatagccctgatgcctag

SEQ ID NO: 176457 - DNA, 601 bp, Human
tgggaggccgaggtgggtggatcatgaggtcaggagatcgagaccatcctggctaacgtggtgaaaccccgtctctactaaaaatacaaaaaattagccgggtgtggtggcgggcgcctgtggtcccagctactcaggaggctgaggcaggagaatggcgtgaaccctggaggcggagctggcagtgagccgaaattgtgccactgcactctagcctgggcaacagagcgagactccatcccccacaaaaaaacaaaaaaaaaaaacaaaaaaaaatcagatcttgtccctgtcctcaagragccccaggtttcatggagagacagaaaacgaagacagctttgtcacacctagagcccagggcttggcaggaacactgcccaggttgagatgccagggcaggggcgcccacatccacatgacctcaggaagctacaggtgtgggggaggaagaagagtaggggtgtccttgccccataggaaggctggaccatttcccagggacagtgggacctgtgaggttcagcccacctcggagtccccagttcctagcctcagctcagggcctagcaccgaggagacacgactgagtatctgacac

SEQ ID NO: 176458 - DNA, 601 bp, Human
tcacctgaggtcagaagttcaagaccagcctggccaatatggcgaaaccccggctctactaaagatacaaaaattagccaggcgtggtggcaagcatctgtaatcccagctgtttgggaggctgaggcataagaatcacttgaacccgggaggcagaggttgcagtgagccgagatcacaccactgcactccagcctgggtgacaagagtgagactccatctcaaaaaaaaaaaaaagaaatataggtaactatcattacactgggaccattttcctttttttactcaatatcatgcaatmaaaaaaaaatgtttgtggctactgtgcttaaggagacaccccctaccccattgtgaaagtgcctcgggatttcacgttctcaggaccagggctctgattgtggcagatgatagaaactcaccccagtgttagggtccagaatcttccgtgagggcgtggctgacttctctccctgccctcgctgctgaggctcttcttcctcctcctcctcctcttcttcctcctcttcctcatcttcctcctcctcttcttctgcttcctcttcttcctcttctccttcctcctcctcctcctcgtcct

SEQ ID NO: 176459 - DNA, 601 bp, Human
tggttcctaagggtcaccaagacaatcctctggtgggtggggaaaaaaaaaatcagaatttctatttatgcttatttgtttattctttcagaaacccttatgcatatcttataatatacataatgcagcagcactgctacctgtaaatagacatttatattggggtaaatagaaatataggtaactatggctgggcccggtggctcaatgcctgtaatcccagcactttgggaggtcgaggagggtggatcacctgaggtcagaagttcaagaccagcctggccaatatggcgaaaccccrgctctactaaagatacaaaaattagccaggcgtggtggcaagcatctgtaatcccagctgtttgggaggctgaggcataagaatcacttgaacccgggaggcagaggttgcagtgagccgagatcacaccactgcactccagcctgggtgacaagagtgagactccatctcaaaaaaaaaaaaaagaaatataggtaactatcattacactgggaccattttcctttttttactcaatatcatgcaatcaaaaaaaaatgtttgtggctactgtgcttaaggagacaccccctaccccat

SEQ ID NO: 176460 - DNA, 601 bp, Human
cttttaagtgctacatccacacattgcaataaaaatcctgagaagagttttatgggcacaagaaagtgatgaatggtgctacaccaaagtgataggccacagaaaggcttacaacatctgatttatcatgttaaaagaaacaaagaatacaggcaaaacctaacaaagcaattggccgaaatgttaagccaactctgagagtgggcccattttatttctctgtaacctccgagcctccgctttcttatctacaaaataagggctggccgggcacggtggctcatgcctgtaaccctagcaytttgggaggccgaggtgggtggatcatgaggtcaggagtttgagaccagcctggccaacgtggtgaaacctcgtctctactaaaaaatacaaaaattagctgggcgcgggaggctgaggcaggagaattgcttgaacccaggaggcagagtctgcagtgagccgagatcgtgccactgcactccagcctgggcgacagagtgagactccatctcaaaaaaataaataaataaataaataataaaataaagtaagggcagcagagtctacatttcatgttgccaagagggttaaataaaat

SEQ ID NO: 176461 - DNA, 601 bp, Human
aactggctcaggtttcgttagatgtggaggctcagtcaagcacatggaaacagggtggaaggtgacaggtgctggaatggaggaaacagacagggtggggagagggttgtgatagggctggagggatatgggctggtgctccaaggaagcccccataatgttatggggaaaggtgtcctctgtgcaaggaacctccaggtagagtggacgtgagcacagaagctccaaggtgtggacaagggcttggctctcaccatccctcctcccgatagacctgcgtccattgggcttgcagatgtgrctatctggacttcctagagcgggctatgggttctaactgtacatggctgtgtggatttgggaaaggcctcagtttctcagtggtgaaaaacagggagaagagcagccagctggctccacggcaggaccctgacggaggaaaaactcaggtggccaaagagcagttcccatgagagcgctggggctgacgagttacggcaaccacgaaggatacctggggcccacgagcatcaagggacagagggcacccaggtctcacccagcccacattacctactgcatcctgcactgccatcctcac

SEQ ID NO: 176462 - DNA, 601 bp, Human
gctcggcactgcagcaacagcactgctatggaaaggggctcagggagagcacactgtgctggggtggggtggggtggggtcggggtgaggctgtggccagccatgagattcacagtgaggctctacctagcacctggcagaggaggggaacagtgagatctgccattcaccaaggccagtccagctgcagcccaaggggtggtctggtgtgggggaaatgcggccagaaggtaaggcctggctaaggaggcggcgccatgcagacactggagtggacagggctgccgcggcaccagctggrtgctggaggccagcgggggccgctcacgctccgccagccccgcctccccacatgcaccaagtatcctgcctcagctggtgggctctgggctcccccagcaaagggacttccttgctcctctgcctgccccatgtccccggatggcgccgactgactggaagtgtggctggtcagggcgcttggagacaatctcacctaaccccccggttggacaaatggggagactgaggcctgatgaaggccacaggttggccaggggccacacagggccttcagagggcaagcctcccgacccctccc

SEQ ID NO: 176463 - DNA, 601 bp, Human
gactttccactcctaccttcgaaaaaaaggaaatacactattaggaattacacagttcagtaaagtatactaaagctcatgtacttttgtctttcttcagccgaatgtttgataatattacagcgaatggattacaaacgggttcccatggctccgcatccatttgagtccatggctaatccatttctgtttttattttttagatggagtcttgctctgttgcccacgctggagtgcagtggtgcgatttcagcttactgcaatctctgcctcccgagttcaaatgattcttgtgcctcarcctcccaagtagctgggactataagcgtgcaccaccatgccaggctaattttgtattttttgtggagacagggtttcaccgtgttggccaggctggtctcaaactcctggctcacgcctgtaatcacagcactttgggtggccgaggcgggtggatcacctgaggtcaggagtccatgggtaatctttaaatttgaacttccgtattccacctgaatttactgaatcaataagatataatttacagtaaatgtagcacaaagttttctttccattccccactccatatgcgtatcttctg

SEQ ID NO: 176464 - DNA, 601 bp, Human
ggcacagtgtctcacgcctataatcccagcagcactttgggaggccaaggcaggtagatcacctgagatcaggagttcgagaccagactgaccaacatagtgaaaccccatctttactaaaaatacaaaattagctggacgtggtggtgcatgcctgtaatcccagctacttgggaggttgaggcaggagaatcatttgaacccgggaagcggaggttgcagtaagctgagatcctgccatggcactccagcttgggcaacaagagcaaaactctccaaataaaaaaataaataaataaawaaaataaaattaaaaaaataataatgaataaagtgagagtatcctatatcacctctgggcagaagcatcatgcatacataattattctactgaaaaacagctttttttttttccttttttacaaagggaggtagtgctcgcttcagcagtacatatactaaaattggaacaatacagagaagattagcatgacccctgcacaaggatgacatgcaaattcgtgaaacgttccatgtttttgaataattgcatccaaaaaaaaaagggagaggggtagggaatgtttctgggaaccaaatg

SEQ ID NO: 176465 - DNA, 601 bp, Human
gtctcatgtgatctcctagtacctctcatccccacacttagttccagccacacaccagcctccttagaatccctcaagcatgcctttacaccatgcccaaaaacgtttctttccaacaccctcatctattcagttctctgctcaaactcctcagacagaccttctctgaatactccatctaaaaagacccaccactgccattcctatcccccttctctactttattctgttttacagcattcttttttttttttttgagacggagtctcactctgtcgcccaggctagagtgcagtggtgmgatctcggctcactgcaagctccgcctcccgggttcacaccattttcctgcctcagcctcctgagcagctgggactataggcgcccgccaccacgcccggctaattttttgtatttttggtagagatgaggtttcaccgtgttagccaggatggtctcgatctcctgaccttgtgatctgcccacctcggcctcccaaagtgctgggattacaggtgtgagccaccgcgcccggcctcttacagcattctttaccaccaggcataaaacctatgtctttctccactggaatgtatactcc

SEQ ID NO: 176466 - DNA, 601 bp, Human
ttgaagaaaaaaggccaagttaaaataggaaaacaaatggttttcatttggtggcagctgaaatcaaagtatacatgtatatacattctaatccatcatctatcccatgtggcattttccaaggttttaagagtctaccacgccaaaccctttgccactttcactgcttttgctttgcttttcccctttcttttctctcgctttgccgtcagcctttttctttgcctttggttcatccatattgggtactgtccatgctggtctagaagagtctttttgtttctcttagtatcagtctccmttttcatgtcatctttttcatcttttacctcacattgcattttctcttggcaatgtttgggtaccaccacagttgctatctcttgaacatctttcattaaaacatcaccgtctagtttgagaatacttttaagcctgctggcctcctttggggcattcttttttctcttttcagcacgcatctttcttttccacttactccgtaagcttttagccatgttttacctgagaaacgaacacccacacctcagctctttttaacctaattctaattacctaataattctacttaataggatta

SEQ ID NO: 176467 - DNA, 601 bp, Human
tcaccatgcaagttcaacaccccacagcaccgtttcagatgcgtactctcctgactgcttgcctctgtggctcagtgcgaatactctgcattcatgctggagtacttgagaagggcacacactctagagctacactgtctgagtgcaaatgctggcactcattcttgttacacaaatgaccttgagcaaggtgtttaacttcccttacttttatcatctataaaataattctacctaacaggattctacctaataaaaaaagaattacctaattctttttaacctaattctttttttttttgtatcaaagaaaatattttattcaagttcccaaaacaaacttcaggagttatgctgggtttgaattgaagaaaaaaggccaagttaaaataggaaaacaaatggttttcatttggtggcagctgaaatcaaagtatacatgtatatacattctaatccatcatctatcccatgtggcattttccaaggttttaagagtctaccacgccaaaccctttgccactttcactgcttttgctttgcttttcccctttcttttctctcgctttgccgtcagcctttttctttgcctttggttcat

SEQ ID NO: 176468 - DNA, 601 bp, Human
ccaagcagctgggattacaggcacgtgccactgtgcttagctaatttttgtatttttagtagagagagggcttcaccatgttgtccaggctggtctcaaactcctgacctcaagtgatccacccacctcggcctcccaaagtgctgaaattacaggtatgagccactgtgcctgtcctaatctgacaacttttttctttcttttttttttttttttctttttttgagatggagtctcacactgtcgcccgggctggagtgcaatggcgcaatcttggctcattgcaacctctgcctcccargttcaagtgattctcctgcctcagcctcccaagtagctgggattacaggtgcctgccaccatgcccagctaattttttgtttcactatgttggccaggctggtctcaaactcctaaccttgtgatccacccaccttggcctcccaaagtgctgtgattacaggcatgagccaccacgcctggccctgaccacttctttctactcctctgctatactcgtccaagtcaccatcatctcttaccttgtcaactgcaacagcttccacaaacccccaccagcaagtagtagtatattaataat

SEQ ID NO: 176469 - DNA, 601 bp, Human
gagcggaggcacctctttcttctttttgaggacagcattgcctgctcccgtggggtgtgtttccattcctcaaggtgaggacaaggtgactagggggcgcggtcgttgttgagtcttctaggcccagttcctgaggcctcacttcccatctcttagcaacagaggcatgacagcatctacggttgccaggcctggagtctggagaagaaactaggaccctgtaccaccttttgaggaccctgcggaacgtggaatgtcggggaggggggcggtcttctgggcccatacgtagtaaataatrtaataatagtctctcacctttgcacaagatttgaggcctgttttaattcttcataatattatttgattcatgtaatcgtaggaatgaggtggtttttctcatttgatgataaagctggtagaaagtaggtgaaagttctgattctcaagagtgtcaccgaagtgctgtggcagaagcatgggccctaccaccactcagttcttgtttatgtcagcctgccctcacagaactttatgaaccacggtgcaattatttctgtttgtcagaatgcagtacgaatattttgagcctcacaataag

SEQ ID NO: 176470 - DNA, 601 bp, Human
aggctttttaccagtcagccaaaccgtttccccagagggagtagaaactgatctctgtggagtgggctggatataggggatacagttcagtcggctctgtgcctgtttgggttatgtctttgagactgtgattgtctcctgccctaaacaccagtgaggctggtgggggagaggctagaggggtgggttgcacagaggcagctttattccttgactgagcttcagctcagcctcacaggctgcctgttgagcttgcagagaatgcccgtctcaagtgtgtaggtgcagagctgctgcctgyggggccagagcagggcttgggatttgtatgcagttcatagtgtacgactgatgtaggcagcaaaagagaattagtcagatgagcgaatctgtcatcagcctattccttaaaggaaccccctgctgcctttggtacccatttagaggctttgacttggagagacatggctccttgctccctttccaagcctctgaaaaggactgcatcacttttgttcctgccagttgcatagcaaccaagctagctgactgcctgctggcaggagggaattgtttagctttgatttcttaggagaggagc

SEQ ID NO: 176471 - DNA, 601 bp, Human
aattgtgtgttttatgatttttctatattttctccatgaaatatatcttgctttttataacggaggaaaaattctggtaattttttttttaaatagagactaggtctcactatgttgcccaggctggtcttgaactcctgagctcaagtgatcctcctgcctcagcctctcaaagtgctggaattacttttagtattttacatattacataattacatacttgctattctttgggaacccattcatattatttcatgcctcacagtaactcagaataacattcatatcatttcattcctcrcataatactgcagatattattctttttttccaagtgaggaaattggggtgaaatgtgcttgtcatgtaggtagtaagtgacagagctgggctttggagtcagctcttttttttttttttttttttgagatggagtttcactcttgttgcccaggctggagtgcaatggtgcagtctcagctcactgcaacctccacttcccgggttcaagtgattctcctgcctcagcctcctgagtagctgggattataggcgtgtgcgaccacactctgctaatttttttgtatttttattagagacg

SEQ ID NO: 176472 - DNA, 601 bp, Human
aatcttgcctacttttgcgcttgattgctcatatttctgtggcctcactgaatcttgcacctaatgtgcacaatagcaactataatactacagcactttctgttttggtgtcttccttattctaccagatggtaatcctgacggtaggggccccatggtggtgttcccagtgtccaatgtggtacaactaggcatccctcaggtgcgctatagcagatgggacgtgggcatgtcaagatagtgagccctggctttaccctaccctagcagggtgacatgctgagcctgccggttgcctcctggcagcagtttagtctgcttactgctctgtggtgtccaaatgtattattttgttaatgtgccttaacttggaaaagcttggaagcctcatggtaacagcatttggcacctaggaaggtattcattgttaaatgaattctttgttaagtgaggtagactacagggatcattctccctgttttatagaagaaagagtaagctgtgtgaccagccagtggcctgatcataatcgagtgctgttctgagtctcatgtgcgttctggggcaacacactgggttgcatttcacatgtgcacacatg

SEQ ID NO: 176473 - DNA, 601 bp, Human
ataggaggctctcatagggctggggattcggagaaggattccctgagaaagtgaaatgtatttggagtttgatggatcaactggatgttccctaggcaaagggcagactgggaatggaggtggacagcaaacattccaagcagaagaaaaactgcatctgtaaagacctgtggcaggtccctttagaatgtgttctggccaaggaggttcatcatgttcagtgcccttgaggaaggcgggttctgaatttcccagataccagatagatgagatcccactgccaggggcccatgagcagaasgggtttgagagggatgggagactttccaaggcaaattctaacaaattacaaataatctggagaggagaaagagaggcacctaaataaatcagtttagagttttagaatgacttgtccaaagttggaagggggtcaggtaaccaaggaggaacagtgcagagcagctggaatacatcagaagggggtcaggaatgccaaaggacctgatgagctaaggcttctggaaaatgctaatcagccacaagggcctttaaaactgtctgcagtaagaaaaataagaagaggcatgctgtttctggc

SEQ ID NO: 176474 - DNA, 601 bp, Human
aaaggaagggaattaggcaccaccttttgaagggatgaggaaacatccaaagctcacgcacagggttttcctcattcattcttccctctgacccatggatatttgttgaatctccagtatgtgccaggtagtccagacatagagatgagtaagataaataaggcttgatctcaaccctcaagaagcttatagtgcaggtagactaatagctatggtttggatagtgttttacagcttaatgagcactttcacttatggtcttatttaaccttcccagtaccccgtgtgatcaccagagctrgttatatccctattttctatctcctctgggttttagtcaatgagggcttttcttacattgatacaccttacatgatagaacttgactttgatcccagcgatttttgtctataaatcccttgcacttttttcctaccccaggctgtgttccttgtggctgctttgtcatccctgtcctgcagatgaggaagctgaggctgcagttactgaacagctcttgacactttaattcctggatttttttcaccatactgagctgccctcggggatggactctcctaagtgctccattgacagtggc

SEQ ID NO: 176475 - DNA, 601 bp, Human
ctaccaagcatcctacagcgcacagggcagccccacaacaaaagaattctgcggcccaaataggttcatagtgccctggctgagaaaccctgacacggagaaagagggcagaggtgaggttatgctaaaaagaattatattctagccgggtatggtagcccacgcctgtaatcccggcactttgggaggccgaggcaggcggatcacttaaggccaggagtttgagaccagcctggccaacatggtgaaacactgtgtctactaaaaatacaaaaaaattagtcaggcatggtggcgagcrcctgtaatcccggccactcgggaggctgaggcaggagagccgcttgaacccaggaggtggatgttgcagtgagctgagaccacaccacagcactccagccagagtggtgtctctggtgacagaggaagagactctggctcaaaaaataaaaataaagcgttctattctaagaattttttagaaggccaggggacttgctgggcgacttctcttccaccttgtgtctccaacagaaggggtctaagtctgttcttgagaactggatctgtgtcatctggagagcagagggacagatggata

SEQ ID NO: 176476 - DNA, 601 bp, Human
gaacccaggaggtggatgttgcagtgagctgagaccacaccacagcactccagccagagtggtgtctctggtgacagaggaagagactctggctcaaaaaataaaaataaagcgttctattctaagaattttttagaaggccaggggacttgctgggcgacttctcttccaccttgtgtctccaacagaaggggtctaagtctgttcttgagaactggatctgtgtcatctggagagcagagggacagatggatatgaagacccattttgtcatcctcagttaatcctcagggacattcartgatgaacccatcctaaagcttcagcattgctgagcttttttatatagcttcaatcatttgcttccaaggtcttgggtttttaagcccatgtgctattttttgtctccctcggggcccagaaggaggggctgtgagtcattgcccgtacaccagccttggcggtgctgccgcaatcggcgcaggctgtacctcaggctagtgctgtttttattcatagagatgctcagagttgccagttggtctgctgttgccagcagatccagcaccttagggaccttttttttttttttttttttttt

SEQ ID NO: 176477 - DNA, 601 bp, Human
cacacctgtaatcccagctcttcgggaagatcatgtgagcctaggagttcaagaccagcctggtcaatacagtgaaaacccatttctacaaaaataaaataaataaataaataaaattagccaatgtggtggtgcgtgcctataatcccagttactcagaggctgaggtgggaggatcgcttgagcctgaaaggttgaggctgcagtgagctacaattgtgccactacactccagcctgggtgacagagcaagaccctgtctcaaaataataacaataataataataataataataataaagaaaatggaacattcaccatgtgctggccctattccagattccaggtgtggagagaccgggtagattagcgtcaggagcacagccgtagggccacactgctgcctcttcgtggtccagctgtacccctcactggcttcgtggtctggagcaaagctactctgtccctctgtgctgcagcttcctcatctgtgctgtgaggataaaatgagttttatacatgaaaatacttaagataatgctgagctgaaagtaaatgctacgataacgctggtctctagtgacagaaagccaatcagtag

SEQ ID NO: 176478 - DNA, 601 bp, Human
cagaccctctcttccaccctggccccctggtggtatcctggctccacagtggctctttcccctcagctgaaaggacagtcctgcctgccggccggcggtttccacattagcaacaacactggtgggggtaataatgttacaggagctcccacagtgccgggaactgcacatggccgggaacgtgggtcctctgcagccctggggacagctgcccacaacagggctgctaccttctggggctggctttctgcttgctttatgggctcagagtgaatcttctggagatgagatgcacactcayagcattcagagctcattccctcatgcgttcaacaaattgaacattctttatgtgccaggcactgggctaggtactgaggttcagtgtgaacaagtcaggcaggggccctgccttcagggatctgcttgtgggtgtggacactaaacaatggccgaggtaggtaactgcagatctgggtatgtgttaggaagggaaagtgcgggacttggtcagtataaaaaagaggtctaatttagatgctgggggaaagagagagcttctttgaggatgtgacagataacctgaggactgaacatatga

SEQ ID NO: 176479 - DNA, 601 bp, Human
tggatgacatatccatcagctcttatgctcttcctcctttgttttgaaactgattttcattatgtcattatacgtgctcattttctgggtgagaagttaaaataatacctcctaaccacccaggtaaccagcattttaagtgcgacatgtttctttccacattgtcttctgggtgtgtactcaagcatctctattcccataaactctcatacagaacatggtattattttgttttttttcacaagtgtcaccccttgtggcatgcatcactgacatttgatgagcccatactgtgtctcargtactaggctgagcacttgaaagatatttgccatgccctgtgaggtaggtgcttttactatccacaccctacagaggaggcagctgaggcacagagatgttaaccttcttgcccagggacacctagctggcttactgtggagccaggcctgtgggcaggagggctggtctggagcgagtgccccatgccaccgtgctgctctgccgcctccctcgcccccagagctctttctgcttctgcacgtggcgctcctcggatttctttttggctccttcatggtgttctgtagggtgaaggtac

SEQ ID NO: 176480 - DNA, 601 bp, Human
tgagtcaggctgtaatctgacgccgcatgggctcccagcaccgccccgctctgaaaccagagccagcaggggatcactcctctgccctgcccaaccatcactcttgccaggaaggggctgcgtggaatggccgtttgcagcggcctgtggggactagaaagcccctctctgcagcagggttagggagtcaggtggacccagtcttggccttctgttacaaagggcactgcaatgcaggtgtctccctttctacctcagtacaaatgcccaggcctttatggcagctcctgggccaaagttyggagccgtgagtgatggcagctcacatctgccaccggctagctgctaagcatacagcagctcgtgtgtttgtttctttaaaaagaaaatgcccaggggccatgggagtactttgcagctttactttcttcccgccttgatgtcacgtcttcagcagcctcagtccattaggtccaacccaaacctgaacccctttccctctgggaagtgccctggccccacttggcccgcagaccttcctccacatcacagctttctggttcctctgtggagcctccccggccctccccgtgcctggcac

SEQ ID NO: 176481 - DNA, 601 bp, Human
aagcatacagcagctcgtgtgtttgtttctttaaaaagaaaatgcccaggggccatgggagtactttgcagctttactttcttcccgccttgatgtcacgtcttcagcagcctcagtccattaggtccaacccaaacctgaacccctttccctctgggaagtgccctggccccacttggcccgcagaccttcctccacatcacagctttctggttcctctgtggagcctccccggccctccccgtgcctggcacagtggcttccagtggatcctctgtgggatctcttcacattatgttccagcatctgccaagtgctttctgcactggatcatgtgctctgtggggacagggactgtggcttatttattcctctctagctctgggtttgggaccaggtcagtacagagcaggtccttaatgtatgtgtgtgttgtgtggatggatggctgaatttccaggtgtagttctaggcattagtccttcttcccagccctcacccccatctgtccagccacacccacagaccggggagctcactgtcacggccagcgtcatcgtgacatcttctgcagtcctcatgtctgcctgacctctccccc

SEQ ID NO: 176482 - DNA, 601 bp, Human
caccgtgtggaccacaagtgtctacaccgtgtagaccaccccgaattctgtgtgcccagccttcgtggatccaacttttacaagcttgaggctctttagggatgcactagtcttaaatccttgtacgtggcagcattggccagttcttcgcagccaggtcttccctctgcatccccaagagatgagacctttggaccttagagtctgctaggcagatgcttgtcctgaggcagaggccctggggtttctgtaagatttctgggagcactggtgggtcctgagagttcacagagcctgtcayacctctcatgtgttcttccccacatccccgggtggggcactaactccatctgactgatgagcggcagaacctcaggtgaaggctcttgctgcaaaacaataaataaaaatgttgcttcccgcaggcactattctgtgcctcatggacaggatctcatccagtcatcagtgaaccaatgatgtgagcacgattgttagctatttcttgatagggaaactgagctccgagagaagtgacttgtccatggtcccacaacaactagtagatggtggggccagacctcagaccccccgatacagg

SEQ ID NO: 176483 - DNA, 601 bp, Human
caccctggagacggcctggattaaatggggctgctcctaccagttccatcctgggagagtggctggacgtggttgggaggccccgggtcagtggggccattttttggtattctcggctgagggcttctaaatataacatcttggattatttttcagattattctggaaaactatgcgtaccctggtgttcttctgattggcactgactcccacacccccaatggtggcggccttgggggcatctgcattggagttgggggtgccgatgctgtggatgtcatggctgggatcccctgggagytgaagtgccccaaggtgagggtggggagggactcattctgggctggctgtggggtggtggttggtggggatgaacgggagacggtgggacccaggagggaaaagggaacaagttagactcgaatcttctgggagggaggtagagaccaataagcagcaatgtgaatggcagcagggccatcctgacttcgtggctggcacaggcacacacggcctctcacagccgcctcgccccctcctgtccaggtgattggcgtgaagctgacgggctctctctccggttggtcctcacccaaagatg

SEQ ID NO: 176484 - DNA, 601 bp, Human
gcatgaccttgaatctctctgagccagttcctcccctgccaaaaagaatagcaactgggcagtgtctggtcaggtcagcctacagtacgtggtgcctgttcaatctcttgggcgacagtcaggccccaagctcgcagctcagtgtgtgggggctgaatcttcacctgagtcctcttcattctacccagcagccaccctgagctggggccctgagctctgatccccatggcctcccctcaccggcccaggtttttacccagggcctcaagggatgagtcggcccgctgtcaccacatctctytgagtgggaggagaagcaatgcagctccctggtgtgaagatgcaggtggccgcgtagcaggtgtgtgggaccctggcccggccaccagccaatgcccggggctctgttgctccacaggcatggcgacaatctgcaacatgggtgcagaaattggggccaccacttccgtgttcccttacaaccacaggatgaagaagtacctgagcaagaccggccgggaaggtgagctggcaggggcaggcccgtgtgggtggaacagtcacatgcccgctcctccccaagacagagctatgcctttcc

SEQ ID NO: 176485 - DNA, 601 bp, Human
cacatgcccgctcctccccaagacagagctatgcctttccctgtagggcaggggttcttaacccattgtctccagacaggcgtccgaggctctgagaaagccctgaagaggtgcaatatgtttctgagtagattgtctggagctctctccagcttctcaaagggcctggcatctgagttcaagatagccccacctcaggatgggcatttcattttccctggaaggtggctgaatgcccgcccttctcggcctggtccctgctgccccctacaggaaactccggaaatgacatggatcgctactgttgataattcctgacctagcaggggaacatttggaaggagaaccactttcccagcctcccctgacaacttccctgaggctctagcctggcttctttggagctcagagggcattggcacctgtgaagggtggtgcgttgtgggagtgaacgaggagccagagaccaggggccatggggagagccgtaagcacgtggaatccttggaaggctcctccctttccttattgagtgactgcttcttcaaaacccagctcttcacttccaggacaccctccccggctctgaaccttagctggc

SEQ ID NO: 176486 - DNA, 601 bp, Human
atcccagctattcaggaggctgaggcaagataatcgcttgaacccgggacgcagaggttgcagtcagccgagatcgcaccactgcactccagcctgggcgacagagcgacactgtctcaaaaacaaaacaagaaaaacctcagggtgactcgtgggcccctgggtccccagtgttcctgcaaactgcttcctgaagcagcctggagcagtgggtggggaggggggagacacagccacggggagagcagaggtagctctggctgctgaaccagaagtggatgtcagtttgccaccagctcakctttaggagaagccaaggtttcaccctgaagggtttttgttatctgagttcagagggcaaatcccagcagggttaggcaccctgagacgcacagatcagagcaggtgtttgcagagccagaggaagggcaggctagaggatcccgtctgcaggagttcacacctcggctctgccacttaagttgtgtggccttggtcacgcacttagcctctgtaggccccttgctccatcacgtgtggaacctacagcagtcgtgaggattgaatgaattcatgtaactaacactgacggaggtttact

SEQ ID NO: 176487 - DNA, 601 bp, Human
agcggccgggcatggtggctgacacctgtaatcccagcactttgggaggccgaggcgggcagatcatgaggtcaggagattgagaccatcctggctaatgtgatgaaaccccgtctctactaaaaaaatacaaaaaaattagccagacgtggtggcgggcgcctgtagtcccagctactcgggaggctgaggcagaagaatggtgtgaacccgagaggcggaggctgccgtgagccaagatcgtgccactgcactccagcctgggcagcagagcgagactccatctcaaaaaaaaaaaaaagattccaaaagcaacatcgaatgggagataatgaacttaggaagctgacagccttgatccattccatgcctctgctgtctcctagctatgtgacttcaagcacagcatgtcacttctgagcttcagttccttcatctgcagagctgagcccagccttgcagggctggagggagcccgggagcgggtgtgtgcagagccaactgctcagttcttccctgtgatgaggtttcagtcaagagaaagtcgttggcctctctgtggggacgtggtgaggcagtgaaagaggctgtccccgcttca

SEQ ID NO: 176488 - DNA, 601 bp, Human
ctcaccctgtggcagaagtgggcaaggtggcagagaaggaaggatggcctctggacatccgagtgggtgagcaccttccaccccatctgtttagcaggtctcagggccagtggctctgcccagggctgtagacaatcacctatgcctactgtgtggcactttctaaggtgggcagtttctgaaatgggtttattattgaaaaattactttttcggccagaagtggtggctcatgcttgaaatcccagcatttcaggaggccaatgcaggtggattacttgagtctaggggttcaagaccakcctgggcaacatggaaaaaccccgtctcttaaaagaaaatgcaaaaattggccaggggcagtggctcacacctgtaatcccagcactttgggaggccgagatgggtggatcatgaggtcaggagatcgagaccatcctggctaacacggtgaaaccccatctctactaaaaatacaaaaaattagccaggggtggtggcaggcacctgtagccccagctacttgggaggctgaggcaggagaatcgcttgaacccaggaggcggaggttgcaatgaaccgagattgtgtcactgcactcc

SEQ ID NO: 176489 - DNA, 601 bp, Human
ctgtggcagaagtgggcaaggtggcagagaaggaaggatggcctctggacatccgagtgggtgagcaccttccaccccatctgtttagcaggtctcagggccagtggctctgcccagggctgtagacaatcacctatgcctactgtgtggcactttctaaggtgggcagtttctgaaatgggtttattattgaaaaattactttttcggccagaagtggtggctcatgcttgaaatcccagcatttcaggaggccaatgcaggtggattacttgagtctaggggttcaagaccagcctggrcaacatggaaaaaccccgtctcttaaaagaaaatgcaaaaattggccaggggcagtggctcacacctgtaatcccagcactttgggaggccgagatgggtggatcatgaggtcaggagatcgagaccatcctggctaacacggtgaaaccccatctctactaaaaatacaaaaaattagccaggggtggtggcaggcacctgtagccccagctacttgggaggctgaggcaggagaatcgcttgaacccaggaggcggaggttgcaatgaaccgagattgtgtcactgcactccagcctg

SEQ ID NO: 176490 - DNA, 601 bp, Human
gaacccaggaggcggaggttgcaatgaaccgagattgtgtcactgcactccagcctgggtgacagagcgaggctccgtctcagaaaaaaaaaaaaaaattggccaggtgtggaggcgcatgcctatagtcctagctactcaggaggctaaggtgggaggatcacttgagtcctggaggtcaaggctacagtgagccgagatggtaccactgcattccagcctgggcaacaaaggcagactcaaaactgcagactcaagcaacagagcctgcctccaaaaaaaaaaaaaaaaaaaaaaaagraagaaaagaaaaattactttttcttggcagaaaagaaaaatatgtttattgtagagaatattcacaatcaagaagaatttttaaaactcctaatctcaacccccagccaggagcaagctcttagagctcttggagaggtgtgctgtgtttctgtgtattgtgtgcatagattttcccgttttacattttatatcacccatgctgctttatgtgacttttcatgctttacacatgcagacgccctggcatgccagtcactggcatctgctgctgctgggtacagtgtggctgtgaagagca

SEQ ID NO: 176491 - DNA, 601 bp, Human; identical to SEQ ID NO: 18368

SEQ ID NO: 176492 - DNA, 601 bp, Human; identical to SEQ ID NO: 18369

SEQ ID NO: 176493 - DNA, 601 bp, Human; identical to SEQ ID NO: 18370

SEQ ID NO: 176494 - DNA, 601 bp, Human; identical to SEQ ID NO: 24641

SEQ ID NO: 176495 - DNA, 601 bp, Human; identical to SEQ ID NO: 24642

SEQ ID NO: 176496 - DNA, 601 bp, Human; identical to SEQ ID NO: 24643

SEQ ID NO: 176497 - DNA, 601 bp, Human; identical to SEQ ID NO: 24644

SEQ ID NO: 176498 - DNA, 601 bp, Human; identical to SEQ ID NO: 24645

SEQ ID NO: 176499 - DNA, 601 bp, Human
tgctggccatgacattggagttcggctctgaaggatcaacaggggtcctcaggcagataaagaaggacatttcaggcagaaggagcaggctgtgtgagggctggagcaggaaggaatatagcaagtggagaagctccgaggtgcccaacatgagaacatggggcgaaggcttgggagcacctggagttggggccaggtcatggagggctttgactgtcaggccaaagggcttggcctttgtctggcaaacagaggagggtcattcagaagactgaaggggtctgagcagggcaaggaacasatgagtgaggaaggatcagagggggacttaggagatagaatttatttatttatttatttatgagatggagtctcgctctgttgcccaggctggagtgcagtggcgtgatctcagctcactgcaacctccgcctcccagattcaagctatgcttctgcctcagcctcccaagtagctgggactataggcgcgtaccaccacacccagctaatttttgtatttttagtagagatggggtgttaccatatttgccaggctggtcttgagctcctgacctcgtgatgcacctgcctcggcctcc

SEQ ID NO: 176500 - DNA, 601 bp, Human
gaaggacatttcaggcagaaggagcaggctgtgtgagggctggagcaggaaggaatatagcaagtggagaagctccgaggtgcccaacatgagaacatggggcgaaggcttgggagcacctggagttggggccaggtcatggagggctttgactgtcaggccaaagggcttggcctttgtctggcaaacagaggagggtcattcagaagactgaaggggtctgagcagggcaaggaacacatgagtgaggaaggatcagagggggacttaggagatagaatttatttatttatttatttatgagatggagtctcgctctgttgcccaggctggagtgcagtggcgtgatctcagctcactgcaacctccgcctcccagattcaagctatgcttctgcctcagcctcccaagtagctgggactataggcgcgtaccaccacacccagctaatttttgtatttttagtagagatggggtgttaccatatttgccaggctggtcttgagctcctgacctcgtgatgcacctgcctcggcctcccaaagtgctgggattacaggcgtgagccaccacgcccggccaggagatagaatttataaga

SEQ ID NO: 176501 - DNA, 601 bp, Human
agaatttatttatttatttatttatgagatggagtctcgctctgttgcccaggctggagtgcagtggcgtgatctcagctcactgcaacctccgcctcccagattcaagctatgcttctgcctcagcctcccaagtagctgggactataggcgcgtaccaccacacccagctaatttttgtatttttagtagagatggggtgttaccatatttgccaggctggtcttgagctcctgacctcgtgatgcacctgcctcggcctcccaaagtgctgggattacaggcgtgagccaccacgccyggccaggagatagaatttataagacctgatagctaatcgctgactcttaagattgtgaagtggattcctttgcagattactttggggagaaggtagggggagtacagaggaagcttctcccttcatggattcctcagctcctgtctcagcatactcaggaacttccagaggagcggcaaaggaatctggtgaattctgtttctttgtatttgctaaccaaaaggctgtctcctggcatcaccccagtgtctgtgatgttcagctgtttttccagtttctgaaatcagtgcctgtgctgta

SEQ ID NO: 176502 - DNA, 601 bp, Human
gggggagtacagaggaagcttctcccttcatggattcctcagctcctgtctcagcatactcaggaacttccagaggagcggcaaaggaatctggtgaattctgtttctttgtatttgctaaccaaaaggctgtctcctggcatcaccccagtgtctgtgatgttcagctgtttttccagtttctgaaatcagtgcctgtgctgtacccagccctcatctttctttccctctccatctcccatcttttatcatgagctgcctcttggactaaaggtttgaggctcgttcagtgaaccgccaytgacagtttgggccttgcattgcttcggggggcacgtctgatcttcccagagtaaacattggtcattttacctggactaatgccagcacacacccgtgtctgggtggcctttctggtcattcttggaagcaggatggagccacggtttctgctggggtggatctgtagggcagcgggtttggaaagcagtgggttgcatctctaaggtggggactcctgtcattggctcaggacattgagccactatcgtggggaggagcacctgcaagtgacaggagcctcctcatccttgccctgagc

SEQ ID NO: 176503 - DNA, 601 bp, Human
cttctgtactaattcccaggtgcttggggtagacgagttatgtgcagcctcctcgtggggaggccagagaacgggtctgtcacagggccagccctgccccgccctcctgaccctgtcccgcgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgygcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggtagcgcccgcccccaccctctcccctcggcacccctgcccgggctcaggcttctcagggcctgtgagaggccacctggggcaggggcaggagggcgggaggtggc

SEQ ID NO: 176504 - DNA, 601 bp, Human
accagggcaagaggagaagcagggagagcagttaggtggtcactgctgtggtctgcggtgacagtggcttgatggcctggtggggggtgggtagagagaggtgctgtggaggaagcccagacaggactccctggggattggcccggggattagggaaagggagggtcaaggccacggctttaaagttgcccacagtctggcgttgtcctaaaatccccgcccttaccaaaaagtgctcccttccatgaccacagcctgagatctcacccaccagcccccacctcctttccctctaggtaastcccactggaagatggattctcagccccaccagcctgatcttcccaccttttcaagtccccttgatccagatccccagaccccccccttttccctgccacccttcttgtctttacttcctccttacccaacctggagtccaaggtccatcattaaaaccctccctggcatactccctcaagcctctggtcccttgctgctggcgtaatcccagcctgatttactccagctctctgctccacacctgtgcctgggcactggagggtatggagaggaaagacaacacgtgaggcggccatgc

SEQ ID NO: 176505 - DNA, 601 bp, Human
cagccccaccagcctgatcttcccaccttttcaagtccccttgatccagatccccagaccccccccttttccctgccacccttcttgtctttacttcctccttacccaacctggagtccaaggtccatcattaaaaccctccctggcatactccctcaagcctctggtcccttgctgctggcgtaatcccagcctgatttactccagctctctgctccacacctgtgcctgggcactggagggtatggagaggaaagacaacacgtgaggcggccatgctgctgtccccatgccgatgatscccctgccaggaaggccctctgccctgctgggagcctcactttcctctggtctgtccactgcagcctttaaaactatctgttctcctcattcatccctcgtcctcactcatagctgacgactttgcttccaatttcagaaaacagaatgaaatggaagagaactttccccagttccctccacaactcacctgccagcctctgtgcacagggactcaaggctgttccagcttctgtccgggctgactcccaccatccccatccttcagtatttccccccaccccacagttgggcccttcct

SEQ ID NO: 176506 - DNA, 601 bp, Human
ctaaactccaggctcaacagcccagccatctacacagtccctccacgtggtggcctcagagctactgcaagcttccatgatcacagctgaattgctggtggcctgccctgccccaaacctgtagctctgtcctcttctccatgggaatggaagctctttgctctcattgctcaagcccaaaagcccgggggtcatcctcagctgctccttctctgtcatacactgcgtcctattcgtcagcaaaatccatctagaatctgcccgcttctcgctgttgccactgccacctcctgagctaggscaccttcatcttttggtctctcacctaaatcattgccatagtctcccagctggtctccctgctttcacccctgctctgacagtctcttccagcacaacagctagggcggtcctgtccaggcataagtcacagcacgcctctaccctgctcagagcctccatggcacccatcttacccgagtcaaagccccgtccttcagtggcccttgggccttgtgcagtcactgtgtcacccccaacatccccacctctgccctcgccctgcccagctgcccgttggtctgctcctgcctcctgccgt

SEQ ID NO: 176507 - DNA, 601 bp, Human
tgccactgccacctcctgagctagggcaccttcatcttttggtctctcacctaaatcattgccatagtctcccagctggtctccctgctttcacccctgctctgacagtctcttccagcacaacagctagggcggtcctgtccaggcataagtcacagcacgcctctaccctgctcagagcctccatggcacccatcttacccgagtcaaagccccgtccttcagtggcccttgggccttgtgcagtcactgtgtcacccccaacatccccacctctgccctcgccctgcccagctgcccrttggtctgctcctgcctcctgccgtggcagtgccatctctcctatgcagagccctaggcacccactgccctgtgggtcatctcttcaggccttcaggtttctgtcactcagttcccctggccctccctgacggccccaccgaggacaagagccacctccacccccagcaagatcgccctccttgcctgctttgcttttccccccagcacgaaccactgctggccacgctttgtgtttgcttgtttctgtttccttctattggaatctcagttccttgagaacagggcctggtttttcact

SEQ ID NO: 176508 - DNA, 601 bp, Human
tctcccagctggtctccctgctttcacccctgctctgacagtctcttccagcacaacagctagggcggtcctgtccaggcataagtcacagcacgcctctaccctgctcagagcctccatggcacccatcttacccgagtcaaagccccgtccttcagtggcccttgggccttgtgcagtcactgtgtcacccccaacatccccacctctgccctcgccctgcccagctgcccgttggtctgctcctgcctcctgccgtggcagtgccatctctcctatgcagagccctaggcacccactrccctgtgggtcatctcttcaggccttcaggtttctgtcactcagttcccctggccctccctgacggccccaccgaggacaagagccacctccacccccagcaagatcgccctccttgcctgctttgcttttccccccagcacgaaccactgctggccacgctttgtgtttgcttgtttctgtttccttctattggaatctcagttccttgagaacagggcctggtttttcactgctgtacctcccgtgctttgaatggtttctggcacatagtgggtgcttagtaaatatgcgatgagtg

SEQ ID NO: 176509 - DNA, 601 bp, Human
ccacccctcagccagtcactggctggtggacgggcaggcaggaagaaccacttgtggctcaggcctgggtgtcctcctctccaggccatggcaggggccagctttatgtaaatgaagcccctgagccaggtgcaagaatgggtgtctgtcatggaaccctgctacccctctcacacacacaggaagagatgagggcagggccaccaggagaaaggggaatgggggaagcagaaatcaagtaggagctggcgcttctgcccatcgacagttccccacagagatcccctctgggcagccagcygtttttgagaaggtgagcctctcacacaggttcaaggccccgtgagaacgggagagggcccgggacgcgctgcttcctgccgcccgcactgcagaagtgcaggagcctgcaagcacccggggcttattcagaggcgctgggggagaggggcactcccgagcggtaggagaccaaaggcccccccccccgggaagatgggccgagtgacgctgcttgtctctgtgtcagtgcaatgggatgtccaaccgcttctggggctggggccgcgaggacgacgagttctaccggcgcattaaggga

SEQ ID NO: 176510 - DNA, 601 bp, Human
gaagaaccacttgtggctcaggcctgggtgtcctcctctccaggccatggcaggggccagctttatgtaaatgaagcccctgagccaggtgcaagaatgggtgtctgtcatggaaccctgctacccctctcacacacacaggaagagatgagggcagggccaccaggagaaaggggaatgggggaagcagaaatcaagtaggagctggcgcttctgcccatcgacagttccccacagagatcccctctgggcagccagccgtttttgagaaggtgagcctctcacacaggttcaaggcccygtgagaacgggagagggcccgggacgcgctgcttcctgccgcccgcactgcagaagtgcaggagcctgcaagcacccggggcttattcagaggcgctgggggagaggggcactcccgagcggtaggagaccaaaggcccccccccccgggaagatgggccgagtgacgctgcttgtctctgtgtcagtgcaatgggatgtccaaccgcttctggggctggggccgcgaggacgacgagttctaccggcgcattaagggagctgggctccaggtgagattccccgggccccgccgccacct

SEQ ID NO: 176511 - DNA, 601 bp, Human
atgagggcagggccaccaggagaaaggggaatgggggaagcagaaatcaagtaggagctggcgcttctgcccatcgacagttccccacagagatcccctctgggcagccagccgtttttgagaaggtgagcctctcacacaggttcaaggccccgtgagaacgggagagggcccgggacgcgctgcttcctgccgcccgcactgcagaagtgcaggagcctgcaagcacccggggcttattcagaggcgctgggggagaggggcactcccgagcggtaggagaccaaaggcccccccccccgggaagatgggccgagtgacgctgcttgtctctgtgtcagtgcaatgggatgtccaaccgcttctggggctggggccgcgaggacgacgagttctaccggcgcattaagggagctgggctccaggtgagattccccgggccccgccgccacctcagctgcggtggctgccctgagattttcttctgtttcctcagatgaagctcctggggtctggagatggccctgattctgatccctgccctaaccctgccctgcatggtcatctagccagttccttgccctgtgggccccagtctcct

SEQ ID NO: 176512 - DNA, 601 bp, Human
gctgccctgagattttcttctgtttcctcagatgaagctcctggggtctggagatggccctgattctgatccctgccctaaccctgccctgcatggtcatctagccagttccttgccctgtgggccccagtctcctctcctgcaggctgggagtgcaggtcccttcctgtgggacctcgggagctggtggtgagggctggggctccaggaagggcagcctgaccccgacttccttggacctccctagcttttccgcccctcgggaatcacaactgggtacaagacatttcgccacctgcaygacccagcctggcggaagagggaccagaagcgcatcgcagctcaaaaacaggtgctggcagggctcctcattggggacggataggtggtcatgtggggagccagcaggcccgggctttcaccaagttctccttggcccaaatggtcccatcctcccctgcttggcccaggtcagtcgacgggcattctgcttgggcaccgtgccctgctctggtggctgctgtgggcaccctgggcactgtgggtcagcccagacctcagggtccatgcaggctggcagggtggggtggcggaggcgtag

SEQ ID NO: 176513 - DNA, 601 bp, Human
cacaactgggtacaagacatttcgccacctgcacgacccagcctggcggaagagggaccagaagcgcatcgcagctcaaaaacaggtgctggcagggctcctcattggggacggataggtggtcatgtggggagccagcaggcccgggctttcaccaagttctccttggcccaaatggtcccatcctcccctgcttggcccaggtcagtcgacgggcattctgcttgggcaccgtgccctgctctggtggctgctgtgggcaccctgggcactgtgggtcagcccagacctcagggtccaygcaggctggcagggtggggtggcggaggcgtagctgaaggtgccagaatcccagccacacccgggatgcagggatcccaccctcaaacagccccttctctaggaggcttatgcatccaactggagatcccggctcgcctgcttcctagtggggcacagccctgggcaagaggcttcactgctttgagctctgggttcttcctctccagtggggaccacaggacctctgatggcgaggttgtgtggggtcagtgggtagctggcacccatgcagccctgagtccgtgctctttcctctctt

SEQ ID NO: 176514 - DNA, 601 bp, Human
cacctgcacgacccagcctggcggaagagggaccagaagcgcatcgcagctcaaaaacaggtgctggcagggctcctcattggggacggataggtggtcatgtggggagccagcaggcccgggctttcaccaagttctccttggcccaaatggtcccatcctcccctgcttggcccaggtcagtcgacgggcattctgcttgggcaccgtgccctgctctggtggctgctgtgggcaccctgggcactgtgggtcagcccagacctcagggtccatgcaggctggcagggtggggtggcgraggcgtagctgaaggtgccagaatcccagccacacccgggatgcagggatcccaccctcaaacagccccttctctaggaggcttatgcatccaactggagatcccggctcgcctgcttcctagtggggcacagccctgggcaagaggcttcactgctttgagctctgggttcttcctctccagtggggaccacaggacctctgatggcgaggttgtgtggggtcagtgggtagctggcacccatgcagccctgagtccgtgctctttcctctcttcctccccaggagcagttcaaggtgg

SEQ ID NO: 176515 - DNA, 601 bp, Human
gacctgcaggacacgagagcttgtctctcgcgtccatccctccaggcctggctgctggccagtgctgcagtaccatgccatggatgcccagccatctcatcctctcctccagaagcccccaggtcagagtccccacctggctgccctcccagtgtgcgggtgaggccagcccaagcggggtccctcagacctgccctcctctttgcctcagtttcctcaagaagaacctgttcccatctgccagcagggagaggaggcctaggaaccagatgggcaccttccctagaagaagagtattacgggggggttaaaggattccaggatggggctgtgaggaacccctcggtttcctttttccaccaccctgggccgccagccccagagcaggtggtccatcccctcccccagctcagcgggagacaacagctggggggcggggtgaggggcggcccagctcctcccccatcagggaccgagtgccccttgctgggggccggtggatctgttcaccccttcagccgtctttgggggctccctccacacttgttctccagagggcttcctcccagggatctcagctggccccttaggcagctcggtg

SEQ ID NO: 176516 - DNA, 601 bp, Human
cacagtgagtcatatcacaaccaggacaacagtggcccttcccaccatacaacctcatttcctgggtcccctgctccctgtgccagagtagtggtgcacttcagaggccctgccacctaggagtgaactcccccaaccacccctccccattggaggcaaggtaagggtcggggggcagacagcaatttacccaagacacccctccctctggacctatgtgcagggtctgcctctgagtcttcagacctcactgcacccctggttccatgctgggccctggggtattcatattctcttgtgyagaaagtgatcctcacacccctttttcaaaatgttatctgggcccttagtgaacgaatgtgtgcatgtgcgagggtacatgtgtgcatctgtgtgtgtcccacacacaacccagatgggggctgacgcacaccagtgatgaataactcgctttggccacacggatgctgctggggtgggtgggggcaggcctgtgttgagcaggatgtggggcaacaggggttgtgtggccttggcaataggccaccagagctctgcttttaggagaaaatggggtgttggtagacaacacccctccagg

SEQ ID NO: 176517 - DNA, 601 bp, Human
tgaggggagaaattgctggctggtcgagctcagtgcgcagcatcccggccctggccctggcagcctacaacccagtggagcgggtgtgtgatggagattccaaggcgacggttccttggttaccgttccctggctaccaggatcctcatcccccattggctagtgccaggaacttacctggcacgtgccttggtccccgctgcccctcccccggggagggaggaggagaagagagaacctggtgctcccaacagctctgggcatcccccagtaaccatggcaaccctgcaattggcacacractggcccaccccaactgcattctccttgaacacaaaggaccctggggacccgccctcagcctcaatctccgcctctctgaaatggggatgaggtcactgcagtcactctcgcccagactctggccccggggtggccaagcctgagctccaggccttccagcccctaggctgcctcagtcctggctgaggcttcctgagactgctggcctttccttctgtctgagctctaacagaaagctgacctggtggccttcctccttcctcctcctccctagctttgtgtgccctggctccttttg

SEQ ID NO: 176518 - DNA, 601 bp, Human
gtggtggtggttatcctacaatgtgaatgaatttaatgccgcttaatgaaatgcagattttaaaatgactgaaatggtacattttatgtattttgccacagttacatacatgtggccaggcgcggtggctcacgtctataatcccagcactttgggaggccgaggcgggcagatcaaccgaggtcaggagttcaagaccatcctggccaacatggtgaaacccagtctctacaaaaacacaaaaattagctaggcatgatggtgtgcgcctgtaatcccagctactcaggaggctgaggcrggagaatcgcttgaacctgggagatggaggttgcagtgagccaagatcacgccattgcattctaccctgggcgacagagtgagactccatctcaaaaaaaaaaaaaaaaaatacatgaatcaacttatgaaaaaaagatcttacccagctcgttctccaccatgttctttatgtggcaggtggcaggtgtgtgttgaatgaatgactgaggatggagcttaccagccacacatcatccccaccccatccaagggcagatgtgactggagtgacttaatgctgctgcctgcaggactgtct

SEQ ID NO: 176519 - DNA, 601 bp, Human
gaggctgaggcaggagaatggtgtgaacctgggaggcggagctggcagtgagctgagatggcgccactgcactccggcctgggcgacagagcgagattccgtctcaaaaaaatttaaaaaataaaaaaattttaaaaaacctcactctgaaaggataaataaaatgtggtatatccatacaatggaatatgattcagccttcaaaaagaaggaaattctgatgcatgctacaacatggatgaatcttaaggacatcatgctaagtgaaataagccacacgcaaaaggacaaacaccgtgcrattccactgataggcagtctccagagtagtcaacttcatagagacagaaagtggaatggtcgttgccaggagctggcgagtggggaagggcagaatttgtgtttaatggatggtggtggtggttatcctacaatgtgaatgaatttaatgccgcttaatgaaatgcagattttaaaatgactgaaatggtacattttatgtattttgccacagttacatacatgtggccaggcgcggtggctcacgtctataatcccagcactttgggaggccgaggcgggcagatcaaccgaggtcagg

SEQ ID NO: 176520 - DNA, 601 bp, Human
ggcatggtggtgcacgcctgtaatcccagctactcaggaggctgaggcaagagaatcgcttgaacccaggaggcagaggttgcagtgagctgagattgtgccattgcactccagcctgggcgacagagcaagactctgtctcaaaaaaataaaaataaataaataaataaacttggctgggtgaggtggctcacacctgtaattccagcactttgggaggccgaggagggcagatcatgaggttaagagatcgagaccatcctggccaacatggtgaaaccccatctctactaaaaagacaataaataaataaataaataaataaataaataaataaataataaactttatctgctgggtgcggtggctcatgcctgtaatcccggcactttgtgaggccggcgggtggatcacctgaggtcaggagttcaagatcagcttggccaacatggtgaaaccccatctctactaaaaatacaaaaattagccaggcgtggtggtgggcgcctgtaatcccagctacttgggaggctgaggcaggaaaatcacttaaacctgggaggcaggccgggtgcagtggctcacgcctgtaatcccagca

SEQ ID NO: 176521 - DNA, 601 bp, Human
acaaaggctttaataaactaccaaccatgtgaacactgaaacaagtaaggcccagagggaggagagagatcaacacactaaccacatgggtcaaagccactgctgtgcctaaagcattttcagatacacgggagctcccctgcaggccaggcaaaaagggaactcagatatggaacacaattcgtaacaggggagagaaagcaacagctccttaagccaagagaaagcatttcacagtgctaaatcccaaagtctctcgcatattcccttccttagaggacctgaaattgaaagggtaccrcactgacctgctagaatgtccactgtcactctcacgtgaactatacttgaagggccagatgggactataaaataatggtaagctccttcagactttacctgaaatgttgataactggtgaaaataaatcagctcagggggttcacaacactattctgtctacctgcatgtgtgtatgtttgaaatgttagcaaaaaaataaactttatcagggctgggtgcagtgcactttgggaggccgaggtgggaggatcacctgaggtcaggagtttgagaccagcctggccaacatggtgaaacc

SEQ ID NO: 176522 - DNA, 601 bp, Human
ggcccttcgtagtatcccacctcaggagggctatcacctcagtgataactttgtgacccccagaatgaagtctaaactcctcctctgcccttgctctcctttcccaatcaaatctcccccactcctcagcccacggggttccagtcagcctaggctcttcaccttcccatgagcctgtgtcccaccagcctttgctgctctgcccactgcctgctgtaatctcagttggttcctctgccttgttcaaagaaaggaccagaggcaactaccacaaaggcttttttttttttaatctgagacrgagtctttcactcaggctggagtgcagtggcgagatctcggctcactgcaagctccgcctcccgggttcacgccattctcctgcctcagcctcccgagtagctgggactacaggcgcccgccaccacgctcggctaatttcttgtattttttagtagagacggggtttcaccatgttagccaggatggtctcgatctcctgacctcatgatccgcctgccttggcctcccaaagtgctgggattacaggcatgagccactgagcccagccctccacaaaggctttaataaactaccaacc

SEQ ID NO: 176523 - DNA, 601 bp, Human
tactgtgagatgtagacatcaagtcctcagcacgacgcagtcagttcccagaacaggcacacccgttcccacctccaagcctcagcatgggagactggcctccctcccaaatgcctgctccccacccgggggccaggccctctggtttccagctgcagcgtggccactgcttcctggggaaggacctctgaacaagaggcttgttcaggtcatttcctcctctgggtccccacagggtgctcctggcttccaccacgatgacaccacatcctaagttcctgtttccggaggcacctccccmctccgctgtgagcaacgcaggatgaggaccggggtctccgggtgggtggccagcacaaggcgggcgcatgtttgctcaactgcactcacacaccaaaggcttcttagtcggtgtcccctgctgctcaggtggcagcttgggcaggaggggctgctaaggtggtgaagtcccagggctgctctgtttttgagcctataatctaaaattttagcttatgtcaggagcactgggagaagggcccttcgtagtatcccacctcaggagggctatcacctcagtgataactttgtgacccccaga

SEQ ID NO: 176524 - DNA, 601 bp, Human
gcccgaggcctctcccgcccccagggcctggccctggatgtccaagctgccttcagccaggggcacaatcagccaagccagccgcagcctcacaccagccccagacacacagccagcctgggagcagtacagcagggacggcctgtggcgggaccccagcatggggcaagcacactcagaccagcagacagggcagggaagagcttcaggagaggcggaagcagcacactgagaagcggaacggggacacctgggtgcaagctccgggaggctccctcaggcccggggcaagagcccagcmcgcatgcattccggccttccaggccagacctaattcaccccagccgagctgctccccgtggccagcgctgtgcctcagcccatgccagagctgccccacaggccctagcactccccactgttcagccacaagcgacttcaccaccatccctggcccttcttggggtcctgccacctgggaagtggtgggcggatgcacgctggatgaagggtctcgccttctccaagggttgcttgggcaaggcctcccttctgagagagtcccagagaggctcagggccgcaacctgaggagtggggcc

SEQ ID NO: 176525 - DNA, 601 bp, Human
gccatcctccggtggctgtccaggtggctgcctgtggaacaaaccccaggtgggtcagtgagggcgggggagccgggtgagacaggattgtccaccttggggcctggccagcacctcctctctggaatctgggtgggggctgggagctctccagccccaccaggggccagactacagctccagaccctgtaagctaggcccctggaggccagtgccccataaggccaggggcaagaggcaggcagtgcctgccctgggggcaaacaccagagatcagcggtcagactgggggagtgagggyggggggctgctgggaagcggggccctccttaccacccccgccgaggcctggggctgctacctacatgggagggaggaagagaggtttggggtgcggtggcaggtgatatagggaaagggagtccgtggaggggaggaggaggaagaggaggaggaggaaggcccactgtccgatgcctttatgaaagggcagtacggacgacctgccgagagagacagacagagaaagagacagaggacaagagagggtcagtctcccccacccctgcccgaggcctctcccgcccccagggcctggccc

SEQ ID NO: 176526 - DNA, 601 bp, Human
gccaagctggccctggaggaggagcagaagccaggtgggcctgggctgggggtggcagaggcggcagcagtccctgccctggcctctgcccactatgctcatggcttcccccatccagagtccaggctggtccccaagctgcgccaggctggcgccatgctgctcaaggtgccactgatgctcaccttcctctacctcttcgtctgctccctggacatgctcagctcggccttccagctggctggaggtagggcccgggtggaggagacctgggaggggttcctgaagggccttggacaaygctggctcatgctccccagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggctgtgagttggcccaccagggtggggaagagcttggaggggcaccccaggagctgggaagggtggcaaatggggagcgtgaccccagtaaggctggcctccattcagcttgactcctgtatcagccagggacatgagag

SEQ ID NO: 176527 - DNA, 601 bp, Human
acagcctagctaagttgacacataaaactaaccatcactggccgggcgcagtggctcatgcctgtaatcccagcactttgggaggctgaggggggcagatcacgaggtcagtagatcgagaccaccctggctaacacggtgaaaccctgtctctactaaaaatacaaaaaaaaaaaacaacaaaaaccaaaaagcattagccaggcgtggtggcaggtgtctgcagtcccagctactcaggaggctgaggcaggagaatggcatgaacccaggaggcagagcttgcagtgagccgagatcrtgccactgcactccagcctgggcgacagagcgagactctgtctcaaaacaaacaaacaaaaaaactaaccatcacactctggggcatgtgtgcacacacaagcacaaatctctatttgcacataggacatgagcccacgagccctcataacgaaggcctcacacgcacacacgttcacatccatacaccatgtgcagcacgtgtacatctactcgcatggatgaatgcacacacctgtaaacgcacagcccgtgcccacatgcacctgtgacgccaacgttaggcagactcagcagcatg

SEQ ID NO: 176528 - DNA, 601 bp, Human
cagcctagctaagttgacacataaaactaaccatcactggccgggcgcagtggctcatgcctgtaatcccagcactttgggaggctgaggggggcagatcacgaggtcagtagatcgagaccaccctggctaacacggtgaaaccctgtctctactaaaaatacaaaaaaaaaaaacaacaaaaaccaaaaagcattagccaggcgtggtggcaggtgtctgcagtcccagctactcaggaggctgaggcaggagaatggcatgaacccaggaggcagagcttgcagtgagccgagatcaygccactgcactccagcctgggcgacagagcgagactctgtctcaaaacaaacaaacaaaaaaactaaccatcacactctggggcatgtgtgcacacacaagcacaaatctctatttgcacataggacatgagcccacgagccctcataacgaaggcctcacacgcacacacgttcacatccatacaccatgtgcagcacgtgtacatctactcgcatggatgaatgcacacacctgtaaacgcacagcccgtgcccacatgcacctgtgacgccaacgttaggcagactcagcagcatgg

SEQ ID NO: 176529 - DNA, 601 bp, Human
actgcactccagcctgggcgacagagcgagactctgtctcaaaacaaacaaacaaaaaaactaaccatcacactctggggcatgtgtgcacacacaagcacaaatctctatttgcacataggacatgagcccacgagccctcataacgaaggcctcacacgcacacacgttcacatccatacaccatgtgcagcacgtgtacatctactcgcatggatgaatgcacacacctgtaaacgcacagcccgtgcccacatgcacctgtgacgccaacgttaggcagactcagcagcatggcagragcggccactggggactgggacgtgggtggggggcctgacaggagttgtggtggtgcaggagctgggtgaccgtcaaattcattaggacgtcttctcttctaccagtgctggaggtgagctctgccatccccatcatcatgggctccaacatcggcacctctgtcaccaacaccatcgtggccctgatgcaggcgggggacaggactgacttccggcggtgaggggggctgggggttgggggctcgtgcctgggggaggacagccccagatgccaggaaccccaggcgtgactgtgcact

SEQ ID NO: 176530 - DNA, 601 bp, Human
caacaccatcgtggccctgatgcaggcgggggacaggactgacttccggcggtgaggggggctgggggttgggggctcgtgcctgggggaggacagccccagatgccaggaaccccaggcgtgactgtgcactggctcgagcctgccttgcaatgtggcctccctgcccagggccttcgcgggggccacggtgcatgactgctttaactggctgtcagtgctggtcctgctgcccctggaggctgccactggctacctgcaccacatcactcgacttgtggtggcctccttcaacatccayggtggccgtgatgctcctgacctgctcaagatcatcacagagcccttcacgaagctcatcatccaggtgacagcagggcctggcatggggtgagggtgggggtaacaagggacccagcctccttcactccccctgcccacatcttgcccacagctggacgagtctgtgataaccagcattgccactggtgatgagtccctgaggaaccacagtctcatccagatctggtgccacccagactccttacaggtgagtcccaggcctaaccccaggtaagaggactccctcttcagactcttg

SEQ ID NO: 176531 - DNA, 601 bp, Human
ctctacggctgcagctgacacttgtccagctggtttctcttcctcactctaccaggaaatgctttccttaaacgctttctgcagggcagggtctcatttcctcggcttggagagtagctggtgggtgggacccaagctctcactttcatcccctttctgggacagcgccccgaaggagtgtgactcacacagcagtggatgtgcttggtcttgcaaagtgtgaagtgcgtcctggctcttcctgcccaaagacgggccacagagtctccccgtgctcccttccaacctgttcccattgackccaactttcaccatgctggacctgaaccagcccgaaacagtctccagggaagctatgcaccagggagaggaggcaagtccaaggcctaccagatggggaaagcagcagcagcggcagttgagtgatcagacacttgagtctcccgggaccctgacaccgtcctgggaatcaccttcttatgtggccacactgtggactgtcaactatacctgcctggattaaacaagcatcttttgaggacttgcaacctgggaggcagggattatcacgtccccattttacagacgaggagcactgagc

SEQ ID NO: 176532 - DNA, 601 bp, Human
tggactgtcaactatacctgcctggattaaacaagcatcttttgaggacttgcaacctgggaggcagggattatcacgtccccattttacagacgaggagcactgagccccagagaagtgcagtggcttgcccaagtccatgtaattgaggtaggatacaaatcctggtagaatcctgactatctcgttgcctctctcactcaccggtctgacattctactatgtatgtctgcttcccatgctgcccatcaggcctgaaggccaccaggtgaccatagccacgtggagacgactccagagrtagcgggtgttgctctaaggagaagttctccttttcgccaccaggtggtgctgctggcacagtgctctccctcggcttccagaagaacaaaggccctagagctccccttcctctgagggggaaactgctgcgctggcccacatcctgacagtctcctgtgagcttaatcacctccttcagtccccagaaggggcctctttaatttagggtgtccctataggcacttaaatcccaactccctcttccaaaatgcttccaactagcccctgggaaaaggtgggtagcattatggacttcatg

SEQ ID NO: 176533 - DNA, 601 bp, Human
gggtttcaccatgttggccaggctggtctcaaactcctcacctgatgatccacccgcctcagcctctcaaagtgctaggattacaggcatgagccaccgtgcccggccgagacttttgtctttacaaaaaattttaaaattagctgggcatggtggtgtgctcctatagtcccaggtacccaggaggctgagtgggagaatcgcttgagcctagcaggttgaggccgcagtgagctatgatggcaccactgcactccgacctgtgcaacagagttcaaaaataaataaataaataaaaatwgaaaaagaaaatgaattaggaataggaaggaaaatgaattagggggataaattcagagagaggtacctgccaaggacatagcaaaaatggcagtgcagtagggtgtggaagagacggtttccaatgcgctgtttgaggccgctcagtgcagttggcatttgaacagacacaagtagccacgatgcggatgaagagcactctgggtggaggaacagtatgtgcaaaggctcagaggcaggaaccagcatggcaggtccgtggcacagaagggtggccagtagctggcaggagcagggtaag

SEQ ID NO: 176534 - DNA, 601 bp, Human
aggtcctctctcccagtgcccccgcggaggtccgctctcccagtgcccccgcggaggtcctctctcccagtgcccccgcggaggtcctctctcccagtgcccccgcggagatccgctctcccagtgcccccgcggaggtccgctctcccagtgcccccgcggaggtctgctctcccaatgtccccgctctgaccccagcctgctgggatgcggtttccttgcagacttccctgcccccttcacctgggtcacaggctactttgccatggtggtgggcgccagcatgaccttcgtggtccaragcagttctgtgttcacctcggccatcaccccactcatcggtgagtgcccatgtagaggtggagtggggtgggccagggctggcagggaaagggccgaaggagacgctgggggtcccacttcctctccctctgtccccaggtcttggtgtgatcagcattgagagggcctacccgctcacactgggttccaacatcggcaccaccaccacggccatcctggctgccctggccagccccagggagaagctgtccagcgctttccaggtgcgctgggagtgtagcctcgcctggggcaggat

SEQ ID NO: 176535 - DNA, 601 bp, Human
gtcctctctcccagtgcccccgcggaggtcctctctcccagtgcccccgcggagatccgctctcccagtgcccccgcggaggtccgctctcccagtgcccccgcggaggtctgctctcccaatgtccccgctctgaccccagcctgctgggatgcggtttccttgcagacttccctgcccccttcacctgggtcacaggctactttgccatggtggtgggcgccagcatgaccttcgtggtccagagcagttctgtgttcacctcggccatcaccccactcatcggtgagtgcccatgtaraggtggagtggggtgggccagggctggcagggaaagggccgaaggagacgctgggggtcccacttcctctccctctgtccccaggtcttggtgtgatcagcattgagagggcctacccgctcacactgggttccaacatcggcaccaccaccacggccatcctggctgccctggccagccccagggagaagctgtccagcgctttccaggtgcgctgggagtgtagcctcgcctggggcaggatggagctgcctctggggtgtggggcctgacaaaggtgtgacaacatggaacaaatat

SEQ ID NO: 176536 - DNA, 601 bp, Human
caccccactcatcggtgagtgcccatgtagaggtggagtggggtgggccagggctggcagggaaagggccgaaggagacgctgggggtcccacttcctctccctctgtccccaggtcttggtgtgatcagcattgagagggcctacccgctcacactgggttccaacatcggcaccaccaccacggccatcctggctgccctggccagccccagggagaagctgtccagcgctttccaggtgcgctgggagtgtagcctcgcctggggcaggatggagctgcctctggggtgtggggcctsacaaaggtgtgacaacatggaacaaatattttgactgcctactaagggccacctaatatgctcaatgaaaccattatgggcaaagtagacccaataccaccctcgagaccttagcatctaatagggagacactgctcataattacaccaataaatagcagtgagtcggatttgcaccataaggaagaggaagaggaagaggcactacaaaagagggcctggagcagtttggggaatccattgcgggggtcaaggccgcaaatggcaaaggggaattattctaggagcaaaggagtaactg

SEQ ID NO: 176537 - DNA, 601 bp, Human
tataagcattatgagggtgatatgccccggtgcagcatgaccctgtatgtggcaccaacagcatgtgccttgtgtgtgtgtgtgtccgtatgtgtgtgtgtgtatgcgtgtgtgtgtgtgtgtgtgtgtgtcttggccactgtcatgtgcactaaatgctgtgtgtgtgacatgccccaagagtgtggcatttgccctgggtgtggcatccgcagcatgtggctgtgtgggtgtcaaggagtggtggctccttcagcatgcgttgcgaagtgcttgtgccctgcatgtgcggtgtgttctytgtacacaggaggctgcctcagatggggctgcggggtctgctgacctctgccctctgcccacagagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtc

SEQ ID NO: 176538 - DNA, 601 bp, Human
gccactgtcatgtgcactaaatgctgtgtgtgtgacatgccccaagagtgtggcatttgccctgggtgtggcatccgcagcatgtggctgtgtgggtgtcaaggagtggtggctccttcagcatgcgttgcgaagtgcttgtgccctgcatgtgcggtgtgttctctgtacacaggaggctgcctcagatggggctgcggggtctgctgacctctgccctctgcccacagagccctgcctggctcccagcctggagcagcaagagcaggagctgacagtagcccttgggcagcctgtgcgkctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtggtaagagactctagcagggagtgaagggatgcctggggagacagacctgcccctcttggaccttagatgcttccctctgtccctgatgtagactccttgacctccag

SEQ ID NO: 176539 - DNA, 601 bp, Human
gtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtggtaagagactctagcagggagtgaagggatgcctggggagacagacctgcccctcttggaccttagatgcttccctctgtccctgatgtagactccttgacctccagcaacgatgatgaggaccccaagtcccatagggaccyctcgaataggcacagttacccccagcaaggtcagtaggtctccaaggacttgtgtccccgctgctgctcatctgatcactgagaagaggaggcctgtgtgggaacacacggtcattctaggggccttcccctgccctccagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggag

SEQ ID NO: 176540 - DNA, 601 bp, Human
ctgtccagctgcaggcaaccccacgcccaccatccgctggcttaaggatggacaggcctttcatggggagaaccgcattggaggcattcgggtgagtctctgggttccaagaccgtctgctcccccattttcattccttcatcagtcccctcatacctacaagcatacctataaatcaatcgaatgagtgaagcgattgcggggccccggaaggagccctggactgtggacctgggcagctctggttccccttctgctactctctggcaagtgacttaacctctcagcctcagcaactccmtttgtaaagggagaagaatcactgactggttggtctgcataagccttagcatctcatcgtcttgatgagaccctgcagggtcggctccatgctgtcatgaggcaactgagcctcagagaaggcaagggttggctcaaagtagcacagctagggagagggagagctaaaattccaaaggctcaaacccaaggctcaagcgccctggggagcctactcctttgtgccatagtccttggcctgggcctgatgttctcagggcctagagagcttgacaagagccctgtgggcaggatgaggatc

SEQ ID NO: 176541 - DNA, 601 bp, Human
accgtctgctcccccattttcattccttcatcagtcccctcatacctacaagcatacctataaatcaatcgaatgagtgaagcgattgcggggccccggaaggagccctggactgtggacctgggcagctctggttccccttctgctactctctggcaagtgacttaacctctcagcctcagcaactccctttgtaaagggagaagaatcactgactggttggtctgcataagccttagcatctcatcgtcttgatgagaccctgcagggtcggctccatgctgtcatgaggcaactgagyctcagagaaggcaagggttggctcaaagtagcacagctagggagagggagagctaaaattccaaaggctcaaacccaaggctcaagcgccctggggagcctactcctttgtgccatagtccttggcctgggcctgatgttctcagggcctagagagcttgacaagagccctgtgggcaggatgaggatctagcctcctggtcctctggcccccttggtggacatggtccggtggtcccggacactctctctgcctgcagctgcgccatcagcactggagtctcgtgatggagagcgtggt

SEQ ID NO: 176542 - DNA, 601 bp, Human
attccaaaggctcaaacccaaggctcaagcgccctggggagcctactcctttgtgccatagtccttggcctgggcctgatgttctcagggcctagagagcttgacaagagccctgtgggcaggatgaggatctagcctcctggtcctctggcccccttggtggacatggtccggtggtcccggacactctctctgcctgcagctgcgccatcagcactggagtctcgtgatggagagcgtggtgccctcggaccgcggcacatacacctgcctggtagagaacgctgtgggcagcatccgytataactacctgctagatgtgctgggtgagcgcggggctgggaacaggggaggcctgacccattttgggctcagttgtgccctcttggtggggtctagtctggcaggcaggatggactcagatgagtcaggcagcttggtgagcaggtgggtcaggggaaagcacaggggttagtgtggggctggaggagcagaggtctgccaagaggaaaaacaagaaggacatccaggcagagggcgcagcccgagcggagggcctgagtataacaaacgccctgcacttgcaggccagcatattcgt

SEQ ID NO: 176543 - DNA, 601 bp, Human
aagaggaaaaacaagaaggacatccaggcagagggcgcagcccgagcggagggcctgagtataacaaacgccctgcacttgcaggccagcatattcgtagggcgtggcgtttatatggggagccaggtggtggagggttttgaatgctaggctgagatgttgtccttgacccgaagcaatagggagccagggaaggtttaagcagggtaagcaggagacagacaagaagctgcagaaaggtccctcccttgaacttgaggaaggctggagggaggcaaacagggtgcttctatgggtgccrgtggtcagggttgactgtctcgcccggtccccagagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaaggtaaaaggtgcaccctgctgcagcctgggccccattcttctcccaccttgggttggggggctccccagcttccct

SEQ ID NO: 176544 - DNA, 601 bp, Human
gagggttttgaatgctaggctgagatgttgtccttgacccgaagcaatagggagccagggaaggtttaagcagggtaagcaggagacagacaagaagctgcagaaaggtccctcccttgaacttgaggaaggctggagggaggcaaacagggtgcttctatgggtgccagtggtcagggttgactgtctcgcccggtccccagagcggtccccgcaccggcccatcctgcaggccgggctcccggccaacaccacagccgtggtgggcagcgacgtggagctgctgtgcaaggtgtacagsgatgcccagccccacatccagtggctgaagcacatcgtcatcaacggcagcagcttcggagccgacggtttcccctatgtgcaagtcctaaaggtaaaaggtgcaccctgctgcagcctgggccccattcttctcccaccttgggttggggggctccccagcttccctgttggccacagtgtggccccaggccctgctgtgaccccagagcatgtcccccaccccagactgcagacatcaatagctcagaggtggaggtcctgtacctgcggaacgtgtcagccgaggacgcaggcgagt

SEQ ID NO: 176545 - DNA, 601 bp, Human
gtgcctctccacacgtggccgtccatgtgaccgtctgctgaggtgtgggtgcctgggactgggcataactacagcttcctccgtgtgtgtccccacatatgttgggagctgggagggactgagttagggtgcacggggcggccagtctcaccactgaccagtttgtctgtctgtgtgtgtccatgtgcgagggcagaggaggaccccacatggaccgcagcagcgcccgaggccaggtatacggacatcatcctgtacgcgtcgggctccctggccttggctgtgctcctgctgctggccrggctgtatcgagggcaggcgctccacggccggcacccccgcccgcccgccactgtgcagaagctctcccgcttccctctggcccgacaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttccc

SEQ ID NO: 176546 - DNA, 601 bp, Human
agttttcccttgtgtcatatggggtagataacagtccctactcccagcccaaggattgtggaaagtgcctggctcatagtcagggctcaataaatcttcaccactggggtgatgatgatgagaagaatttggtgtgacaggcttgatatcctgtgtcagcattagtctgtgtcagctttgacttcacatctccttgtcagcctcacaggccctctacctccttccttatggttccccccagacacaccctcagcctcccttggaccctccctaggtctgccccccacgtccactgctgtargaggacagcccttctgcttgcacccaggcccagccccggggtgctcttgctgggcactcctgcaccccacccatcagggcctctccttgcagttccccagccccctctgcaagaatggcctccactgctcttctgctcctcccctcctctctacacagctggggccacctggtgctccctgggaggcagggattgagaaatgcacattgtgtcattggcccagggccacaggtcagccccaggggctcagccagagaagccaaagcagccttcttcccaagctccccggctgcacccggc

SEQ ID NO: 176547 - DNA, 601 bp, Human
gcactgaggccctctctcccctccagggccgcctgcctgtgaagtggatggcgcccgaggccttgtttgaccgggtgtacacacaccagagtgacgtgtgagtcctgccggcggtcactgtcctaccccacaaaaagggcaaggcactgcccaaagtcacgtggccccaggagtcatgcgctcgagggctccttcagatttggtctgggacccgagtgggcccagactccaggaggagcccattccccaacagctgtggtgggtcatgtctgtggggtcccccgtcctagccccggtcgtmgggagggcgctgagccacactgagccctggccctgcctccaggtggtcttttgggatcctgctatgggagatcttcaccctcgggggctccccgtatcctggcatcccggtggaggagctgttctcgctgctgcgggagggacatcggatggaccgacccccacactgccccccagagctgtgaggcctcaccctgccctcgaccccactttccagtcctcctcctcctctgccctgaccatggcctcagggtgtgtcccggccagaaggacaacactaacaacaactcctcgtcctcct

SEQ ID NO: 176548 - DNA, 601 bp, Human
gctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccascgtcttgacgggagcattggcccctgagcccagagaagctggaagcctgccgaaaacaggagcaaatggcgttttataaattatttttttgaaataaagctctgtgtgcctgggtcttccctgagcaacatggagtggggtgaggtggagggatccctccagcagagttctgcctacaggacacggactgagggcactggaccaggccatgggctccgccacctccactgccccaggagccagtgtgtgcctatctgggtccgcctgtcccaccagccccatcttgtgtctgcgacagtg

SEQ ID NO: 176549 - DNA, 601 bp, Human
aggacaactcagtcccacctcttgctttaggaagagaatgggaaacagatccctaagaaggcgaatcatcctaactggggtgccagatgtccacttacacgtttgccttacagcacatgcttccagcagccatgcctgctaggggtgcccatgcccactctatctcaccctgaccaggcctatctggtgacaagggaaagagaagctgaagccaagctgcagaccctgtttgctcacaggctgcacatccaggaactcaggcagtgggcagcaaagtcaaagagctgcaggacaggcgggstctcagccttgcccctctgagccccagctgcccaagtgttagaaatatggaaacggagactccgagagggcaagtcatctgcagggccaagcagctgtgaaggggcaggggagaatttgaacccatatctacctgaatgcagagatgtttctatgtcaatgtgaagctttataaaacctagaaagttcccttgaaaagaactcaaggctgatgaaagttgctggaaagaaaccccagatgatccggcttgagaaaacttacagctgagtcctcgcactccctttttctggctctgcagtc

SEQ ID NO: 176550 - DNA, 601 bp, Human
ctctgacataggttacattcagaagcctcctggagaacaagaaggacccaaaggaaggcagagagcagtttgctcaaccacttccagccctcaacccccaaactgtcagggcaggccagagtcaggaacagggaagatcaagggttgacaattctggattctagaactttgggcccttccttctttgaacctggccagggcccccaggttgctccctggagaccctcagagtgacagggaggggcctaagggcctgagaacagggacagaaggggttgggagcagagcagtcatagacagrgcctggaaccaaaggtcagggccccctgccaggtcacctctgagcaccaggattcagggactcatggtccagggtatggtcgaaggtggtcagcactggtcccagcgccccatcatcgctgaaggagccccactcgacgctgacgcagacgcggccccggtcttcgtccagcactgccacatgccgtgcctcctccatgtaacacgcgttggtgcccgtgtctggcagagacaaccctgtcaaggcctgctagccaggcagcacaccctccacctgtcatcacaaatggtccatggctca

SEQ ID NO: 176551 - DNA, 601 bp, Human
ctaagccctcagtccacctggccctacctccaagagttcccaaagaaggattcttttctttggggctcccaaactggagactccagaagcaacgaatagcctcccagaggacaggtgggtgtatgcccagaccccactgccccctctgacataggttacattcagaagcctcctggagaacaagaaggacccaaaggaaggcagagagcagtttgctcaaccacttccagccctcaacccccaaactgtcagggcaggccagagtcaggaacagggaagatcaagggttgacaattctggrttctagaactttgggcccttccttctttgaacctggccagggcccccaggttgctccctggagaccctcagagtgacagggaggggcctaagggcctgagaacagggacagaaggggttgggagcagagcagtcatagacagggcctggaaccaaaggtcagggccccctgccaggtcacctctgagcaccaggattcagggactcatggtccagggtatggtcgaaggtggtcagcactggtcccagcgccccatcatcgctgaaggagccccactcgacgctgacgcagacgcggccc

SEQ ID NO: 176552 - DNA, 601 bp, Human
gttcaaccggaatggggccagggtctcctccagcaggcgccggtgggcagccagacgggcagccacggcagtcaccatcgccactccccggccaccaccatccacagaggggattaaggagacatcgcattccggggccaggagcatcactgtcccctgcaggacgctgcagaacctacagatacatacaggtgcacccggcttggccctggacccccagacacacacaggtgtgcacggcttggccctggacccccagatacatacaggtgtgcccagcttggccccagacccctagggyctcctgaagcccaaggccccatcacttttttttttttatttttgtagatatcgagtcttgctctctcacccaagctagagtgccacggagtgatcatggcttactgtaacctcaaactcccaggctccaatgatcctcccacctcagcctcccagtgttgagattacaggcgtgtaccaccatagccagcctcccctatcacttcaatttgaaatctgttctgtgcaccagccatacgcccccgtgtcgccatggcctccacccttgcacacacaaagggaagcatcgtttctctccttg

SEQ ID NO: 176553 - DNA, 601 bp, Human
agcccttccccacctctgacatcaaggttcaggctgtgggtacctgctgcccagaaccctgggccacagtctcgggaatggagtagatctcgctggtgatctgcacgcctgtggtcacacgtaccaggaggacacggaagttcgtgcccccgaggtccagggccaggaaatcccctcgctctgtgggggcagagaccctcagtgccgggatagggcttgtggctccagccccagcacacactgggacccccaggagcccatgtttcggtcccacactcaggccaggtccttaccgctgccrtcaggggtggcccggacgaaagtgggcagcatgcgaagggaggaggcctcccctcggagccccttggccatggccttccgcatctgtgcctgaaccgcagccagttgatcatggttcaaccggaatggggccagggtctcctccagcaggcgccggtgggcagccagacgggcagccacggcagtcaccatcgccactccccggccaccaccatccacagaggggattaaggagacatcgcattccggggccaggagcatcactgtcccctgcaggacgctgcagaacctacagatacat

SEQ ID NO: 176554 - DNA, 601 bp, Human
gacaggtcaggcgtaggcactgctcagcccttccccacctctgacatcaaggttcaggctgtgggtacctgctgcccagaaccctgggccacagtctcgggaatggagtagatctcgctggtgatctgcacgcctgtggtcacacgtaccaggaggacacggaagttcgtgcccccgaggtccagggccaggaaatcccctcgctctgtgggggcagagaccctcagtgccgggatagggcttgtggctccagccccagcacacactgggacccccaggagcccatgtttcggtcccacaytcaggccaggtccttaccgctgccgtcaggggtggcccggacgaaagtgggcagcatgcgaagggaggaggcctcccctcggagccccttggccatggccttccgcatctgtgcctgaaccgcagccagttgatcatggttcaaccggaatggggccagggtctcctccagcaggcgccggtgggcagccagacgggcagccacggcagtcaccatcgccactccccggccaccaccatccacagaggggattaaggagacatcgcattccggggccaggagcatcactgtcccctgcag

SEQ ID NO: 176555 - DNA, 601 bp, Human
gacatccctcgtgcagaccctgccagctccaagccctggggaccttcactgcctttcccaccaacatcaccatcagtgcatccaccatgccacccccaagtgctcctacaatgcccagctgtcctgtcattcccctgggagacatgtgacatcccccgccctcgcccctagctctctgcggttgagaggccgaagctccctggaccggcctgccaggcccttaatccaactaagaggtgctgggccaagagcaggggacacagagaaatcagagacgaggagccccacagtctggccagasgtcaggcaatgaatagccagctctgacagagcctctgtgcccccgtggaagcaccaaggagagcatcgtgggagcccagaccacggggcgagtctctgccaacaggatcaggaaagcaacagagaggaagtgactgaatccaagaagcacagaaagaaaaaggcattccaggcagaggacgcaccctggatgagggcgtctccttcctttctctgacacagcttcagctccaggaaggtgggctccttgctggccccacctggagctcctctgtccagctgtttatgcacacagcaacct

SEQ ID NO: 176556 - DNA, 601 bp, Human
gcacttcccataccgagatggcaacgattcgggctcactctctctacctctcatgctcacagcctgtccctggtcctggtccttcttccttcccgacatccctcgtgcagaccctgccagctccaagccctggggaccttcactgcctttcccaccaacatcaccatcagtgcatccaccatgccacccccaagtgctcctacaatgcccagctgtcctgtcattcccctgggagacatgtgacatcccccgccctcgcccctagctctctgcggttgagaggccgaagctccctggaccsgcctgccaggcccttaatccaactaagaggtgctgggccaagagcaggggacacagagaaatcagagacgaggagccccacagtctggccagaggtcaggcaatgaatagccagctctgacagagcctctgtgcccccgtggaagcaccaaggagagcatcgtgggagcccagaccacggggcgagtctctgccaacaggatcaggaaagcaacagagaggaagtgactgaatccaagaagcacagaaagaaaaaggcattccaggcagaggacgcaccctggatgagggcgtctccttc

SEQ ID NO: 176557 - DNA, 601 bp, Human
gctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcaggtgggcgatcctggggggattggccttgaaagggagacaaaaggagcaggggcggggtcggaccctggcggggagtctgaactacaaagcggagggggcaaatttggaggcggagacagagccaaatgccggggcaggcagggcggagctcagagrgcggtatcagaggcacggggaaggacagttagaggcggagcctagctgagctcggggcgggcttggaccccgggggtgggtataggaactgaggtcggggcggggcttgggaaatccagccctaggtttggggcggggccagccccaaggacccggcctgggtgcaggcagcccagcgcccccaccccagccccggctcacctgttccggggtcgccccgcagatcttcaacttgatgaagttcgacagctatgcgcgcttcgtcaagtccccgctgtaccgcgagtgcctgctagccga

SEQ ID NO: 176558 - DNA, 601 bp, Human
ctgcccgatggcacagcctccttggccctggccagacctggcctcaccatccgagacatgctggcagggatctgtgagaaacgaggcctctctctacctgacatcaaggtctacctggtgggcaatgaacaggtgggaacgtgacctggctccaactctaacctccttcctgatcctgaccccaactccatttctgtctctgctcagtcatggctccaaccccaattcaagttctaaacccaactccaaagcaccctcagcaccaactttcactcactcagacatccacccaccccccacytcatgtccttccaggtttccaccttcatccatcatcctattgtggtgaccttagggaggtaaaactggagagaaccactgttggagctggggtttgcccctcatcattcccagagtccagactcccatccccacagacccatcctggaaatggccatccgtggggtgccctcacctccttagcctctaggggcacccaagtgcacctaaccaatgaactttttcctttaggtgcaaactagcttaaactttaaagaagacctaggggaaaactggctttaaaggaaaccattcagtcagg

SEQ ID NO: 176559 - DNA, 601 bp, Human
tttaagagcacaaatgaacaaaactgccaatttgttaatccaaaagaatttgaaagattgctatcaataatgtattttccactacaaccttaaaaaaatccaaaagtattactgccagggtttttttgtttttgtttttgagacaaggtcttactctcatccaggctggagtgcagtggcataatcaaggctcactgcaaccttgacctcccaggctcaggcgatcctctcacttcagcctcccaagtagctgggactacaaatgtgtgccaccgtgcccacctaataccaagtttttaatttttttttttttttttttttgagacggggtttccctctgtcacccaggctggaatgtggtggtgtggccacagctcactgcagtctcaaccacctgggctcaagtgattccctcacctcaaaaacccaagtagctgggaccacaggtgtgcaccaacatgccccaccagttttttaattatctgtacagatgagatctcgccacattgcccaggctggtcttgaactcctgggttcaagtgatcttcccacaatattgggattataggtgtgagccagtgcacctggcctagttttataa

SEQ ID NO: 176560 - DNA, 601 bp, Human
gctgagggttcctggggcaaaataggaagccattgctcttactgggatgtgtactatcctgtggtttgacttttccagatcgtcaatgtatggtactctgtgaatggtgagaggctgggcacctacatgggccataccggagctgtgtggtgtgtggacgctgactgtatccttattttgggtctgagtccgtgttgctagggtctgtcagcgatggagaggctgagttgggagttgggagttgggggtgctgttgagggcctagagaacgatacctcctactccctggtctcttcactgrctgaggaaacattcaggacaaattccagttctggataaggaggtaagaggggtagaaaggctctttggggctgaacagggagatgattcacttggcatcccaagaggacaagggctcgggtgaacttcgtcatatttcttaacaactcttcaggggacaccaagcatgtcctcactggctcagctgacaacagctgtcgtctctgggactgtgaaacaggtaagctgggttcattcacctttttagcaaatattgaggacctacagtgtacctgtttgagtaaacaggtcctaggaaaat

SEQ ID NO: 176561 - DNA, 601 bp, Human
ttacaggagcctgccaccacgcccagctaatttttgtattttttgcagagatgggatttcgccatgttggccagactggtttgaaactcctggcctcaagcaatcctcccacctcggcctcccaaaatgctgggattataggcgtgagccaccgcacctggccatgaactttaaaaggtgtttttttgttttgttttgtttttcagagatggggtcttaggaatctgaacacattctggcctggagagattgcccaataacttattttattttatttatttatttatttatttatttatttgagatggagtctcgctttgttgcccaggctggaacgcagtggcatgatctcagctcaatgcagcctctgcctccgagttcaagcaattctcctgcctcagcctcctgagtagctgggattccaggcacctgccatgacgcccggctaatttttgtatttttattggagatggggtttcgctgtgttggccagggtggtcttgaactcctggcctcaggtgagccacccacctcggcctcccaaagtgctgggattacaggtgtgagccactgcgcctggccccgataattattttaaaaa

SEQ ID NO: 176562 - DNA, 601 bp, Human
gttgcccaggctggtctcaaactcctgggttcaagtgatccacctgcctcagcctcccgaagtactgggattttaggcatgagccactgcacccagcccaataatgatcttccttatttttataaatatttcttaaatatagagatatttcgccgggcaaggtggctcatgcctgtaatcccagcactttgggaggccgaggcgggtggatcacgaggtcaggagatcgagaccatcctggctaacatggtgaaaccccatctctactaaatgtacaaaaaattagccaggtgtgatggcrggcgcctgtagtcccagctacttgggaggctgaggcaggagaatggtgtgaacctgggagacagagcttgcagtgagccgagatcgcgccactgcactccagcctgggcgacagagcgagactccgtctcaaaaaaaaaaaaaaaaaagggatatttcacatttatttcagtatttgatgtttgaagtgttttgggtctttatttagaattttagtgatgtttttgtgacagaaatatgctgtaggagcttaagttcttgtttatatcaattagcctatggtaaaattggtttctttata

SEQ ID NO: 176563 - DNA, 601 bp, Human
aggaagacaggacaggcacagcggttcatgcctgtaatcctagcactttgggagcccaaggtgggaggattgcttgagcccagccaggagtttgagaccagcctgggcaacatagtgagaccctcatctctacaaaaaaataaaaaaattagctgggcatggcggtgcacacctgtggtcccagctactcaggaggttgaggagggaggatcttttgagcctggaaggtcgaggctgcagtgagccatgattgtactactgcactccagcctgggcaacagagcgagaccaaaaaaaaaaagacattagtgcctatttcatagtcaaggatgggggaataagtgaagataatatatttaaatatatataatatgtctaccctcaatgaattgcttttgctatttttgctattgcataatcacttttgctattatgacttactatttttattatttacaaacttatcaaggcagacaaaatgctatgccctgaggagtgtgcaggttctgctctggtgcgccaatttttccgaatccagcattctaaagttgtacattaaaaaattcagtctggctgggtgtggtggcttacgcctgtaatc

SEQ ID NO: 176564 - DNA, 601 bp, Human
gagcttgcagtgagccgagatcacgccactgtactccagcttgggcgacagagcgagactccttctcaaaaagaaaaaaaaaaaaacccacacacacacaaaaacatcccacacacctaatctaggaagttatgcttatgataagatcgagtaaatcaggtttccttgcttgtggctgaaatgtaataaaccctttctggtcactttgagagccttgaccagaagttctgacctaatatttagcaagtgaaaatgggaacacaaataaatgcatttagggggcttttggtgaaaacatgayaaaagggattggtaaaaaattgggagacattctcatccattttacagacatgtaaactttcccagtcacacagcaaggtgatggtagaatgcagaatggaactctagtcccccaattctgtagttttaaaaaatatagtgtatataaaatattttagatacacaggccaggcagggtagctcatgcctgtaatcccagcactttgggaggctgaggcaggtggatcacttgaggccaggagtttgagaccagcctggccagcgtggtgaaaccctgtctccaccaaaagtacaaaaatta

SEQ ID NO: 176565 - DNA, 601 bp, Human
gagaagaaaggtgggtttgggttcagctgggacttgggtctcgagcctgagaggatgaatctatgtagggcagtgggaggagggagtgactcaggccctgccagctcctgtggggctcttcctcagttccttgagcctttcagtggctcccagaagtggcagagcccacaaaacaatgaacctctactgcctgagcacggctctcacataccaccccagcccttttcccagcactgcaccccagtttcccagggggctgcctccgcccaccaggttctggctgtagcaggctgggaaaccrgtccaacctgttctcaacagggctcactgggaggaccagggatgggcttttctctctttatgtccagtgagctgtagtgttggggaaggggtctcagggtaaatgaagacctcatgggtcttcccagaggtgctgcccttggccatccctgtactcttgtgttctagaagtcaccgaagaggagaaaaccaaggaggagaagccagaagccaaagggtgaggaaggagctgcctgtggccatctccctggcattggagcaccagcccctttgtcccaccactctgaggaaaggcacaggg

SEQ ID NO: 176566 - DNA, 601 bp, Human; identical to SEQ ID NO: 23381

SEQ ID NO: 176567 - DNA, 601 bp, Human; identical to SEQ ID NO: 23382

SEQ ID NO: 176568 - DNA, 601 bp, Human; identical to SEQ ID NO: 23383

SEQ ID NO: 176569 - DNA, 601 bp, Human; identical to SEQ ID NO: 23384

SEQ ID NO: 176570 - DNA, 601 bp, Human; identical to SEQ ID NO: 23385

SEQ ID NO: 176571 - DNA, 601 bp, Human; identical to SEQ ID NO: 23386

SEQ ID NO: 176572 - DNA, 601 bp, Human; identical to SEQ ID NO: 23387

SEQ ID NO: 176573 - DNA, 601 bp, Human; identical to SEQ ID NO: 23388

SEQ ID NO: 176574 - DNA, 601 bp, Human; identical to SEQ ID NO: 23389

SEQ ID NO: 176575 - DNA, 601 bp, Human; identical to SEQ ID NO: 23390

SEQ ID NO: 176576 - DNA, 601 bp, Human; identical to SEQ ID NO: 23391

SEQ ID NO: 176577 - DNA, 601 bp, Human; identical to SEQ ID NO: 23392

SEQ ID NO: 176578 - DNA, 601 bp, Human; identical to SEQ ID NO: 23393

SEQ ID NO: 176579 - DNA, 601 bp, Human; identical to SEQ ID NO: 23394

SEQ ID NO: 176580 - DNA, 601 bp, Human; identical to SEQ ID NO: 23395

SEQ ID NO: 176581 - DNA, 601 bp, Human; identical to SEQ ID NO: 23396

SEQ ID NO: 176582 - DNA, 601 bp, Human; identical to SEQ ID NO: 23397

SEQ ID NO: 176583 - DNA, 601 bp, Human; identical to SEQ ID NO: 23398

SEQ ID NO: 176584 - DNA, 601 bp, Human; identical to SEQ ID NO: 23399

SEQ ID NO: 176585 - DNA, 601 bp, Human; identical to SEQ ID NO: 23400

SEQ ID NO: 176586 - DNA, 601 bp, Human; identical to SEQ ID NO: 23401

SEQ ID NO: 176587 - DNA, 601 bp, Human; identical to SEQ ID NO: 23402

SEQ ID NO: 176588 - DNA, 601 bp, Human; identical to SEQ ID NO: 23403

SEQ ID NO: 176589 - DNA, 601 bp, Human; identical to SEQ ID NO: 23404

SEQ ID NO: 176590 - DNA, 601 bp, Human; identical to SEQ ID NO: 23405

SEQ ID NO: 176591 - DNA, 601 bp, Human; identical to SEQ ID NO: 23406

SEQ ID NO: 176592 - DNA, 601 bp, Human; identical to SEQ ID NO: 23407

SEQ ID NO: 176593 - DNA, 601 bp, Human; identical to SEQ ID NO: 23408

SEQ ID NO: 176594 - DNA, 601 bp, Human; identical to SEQ ID NO: 23409

SEQ ID NO: 176595 - DNA, 601 bp, Human; identical to SEQ ID NO: 23410

SEQ ID NO: 176596 - DNA, 601 bp, Human; identical to SEQ ID NO: 23411

SEQ ID NO: 176597 - DNA, 601 bp, Human; identical to SEQ ID NO: 23412

SEQ ID NO: 176598 - DNA, 601 bp, Human; identical to SEQ ID NO: 23413

SEQ ID NO: 176599 - DNA, 601 bp, Human; identical to SEQ ID NO: 23414

SEQ ID NO: 176600 - DNA, 601 bp, Human; identical to SEQ ID NO: 23415

SEQ ID NO: 176601 - DNA, 601 bp, Human; identical to SEQ ID NO: 23416

SEQ ID NO: 176602 - DNA, 601 bp, Human; identical to SEQ ID NO: 23417

SEQ ID NO: 176603 - DNA, 601 bp, Human; identical to SEQ ID NO: 23418

SEQ ID NO: 176604 - DNA, 601 bp, Human; identical to SEQ ID NO: 23419

SEQ ID NO: 176605 - DNA, 601 bp, Human; identical to SEQ ID NO: 23420

SEQ ID NO: 176606 - DNA, 601 bp, Human; identical to SEQ ID NO: 23421

SEQ ID NO: 176607 - DNA, 601 bp, Human; identical to SEQ ID NO: 23422

SEQ ID NO: 176608 - DNA, 601 bp, Human; identical to SEQ ID NO: 23423

SEQ ID NO: 176609 - DNA, 601 bp, Human; identical to SEQ ID NO: 23424

SEQ ID NO: 176610 - DNA, 601 bp, Human; identical to SEQ ID NO: 23425

SEQ ID NO: 176611 - DNA, 601 bp, Human; identical to SEQ ID NO: 23426

SEQ ID NO: 176612 - DNA, 601 bp, Human
gcggagtgactcacgcttgtaatcccagcactttaggaggccgaggtgggcagatcacctgaggtcaggagtttgagatcagactggccaatatggtgaaactccatctatactaaaagtataaaaattagccggacgtggtggcacattcctgtaatcccagctactcgggaggctgaggctggagaatagcttgaaccagggaggcaaaggttgcagtgagcccagatcgtgccactgcgctccagaccaggcgacaggtgacagagcgagacttcatctcaaaaaaaaaaaaaaaaaaggaagtaaggcactgatggcacaggtatccaaccctttcctgtgcctgcccctaagctacctcaacaccccctcagctcacctctccttttcgctgttgcagaggaaggtgccaaaagaggaggcataggcgtgcccaaacagcgccaacagtagcccttccccaaactccaatgacagtgggaaccggcagcccagctgccacacgcagtccaggaagaggagaaaggtgggtgcctcatgcttggggtgggcatgggagaaggctgaatgggcacagcgcagctggaaggggtggctg

SEQ ID NO: 176613 - DNA, 601 bp, Human
ggggcaatgctccccggggccgcgggatgagccaggtgagcgcggagacccccagcactccctgcctggtgcgcatggacgggggtggggaggcggggcgggaagcggcgtcctcggcctctgttccccggggctgtgtgaccttgggcggccccgcaccctctctgggcccagagccccagcaccggcagggcctgcggaggccgctctgagtcctggccccgcaggcaccggcctggagcgctggggaggcttcttggaggaggcggggcctggccctggccccggatcgccgagaccsgccacgctgcgccgcctggacgccgggctcctccacccacagctctgcgaccttcacgagctcgaccctttctgcgcctcagtttcctcatctataaaatggagataatgcctccgcgcgctgagcccgagcgcggtcgtgctgttacactattgctgctgctatgtcgttaatgacggcacagcccttatggaaggggggccaaggaaggcacggggaccttcccgcaggacatggggtgggcaccagccctaagccatgcacataacccactctgaggtcaggacctgggttcctttc

SEQ ID NO: 176614 - DNA, 601 bp, Human
aaaagccacacagcaaacacttaatggaccctaaatttataaaaattatcccatagagtcctatgaggcagggaatgttactgtacccatttcgcagatgaggaaacttggggcaccgacatttcccagagccaacatgtaaaccaggcatttggcctgagtgacagactggtgcaggtggccagcagcttaatttgtactgagcgcttactgggtccccacagcgatcctgaactgtgttcctgcccacagtgactcggccggtccgggcatggcagacccagtggcgggcatcgcgggytcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgc

SEQ ID NO: 176615 - DNA, 601 bp, Human
agattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagtcccccagcaccaggtgccagggacccgacagcacagccagtgcctgcaatctgtccctgaacctcccagggtccaccctgctatctgcagaacagtctgccccacaaaaagagtgcacatgttgagcaccaaaccgaggaatgtatacytgaccccaaggaaatgggtagcccacagagagggaggtgccggggagatgacgcagcccagccgggcctgggacaggatgcgggctcctggcacgatcttccctcactttgtgtgctaactgtgcctcaactgagcttgtgcattccttcttctggggggccgcatgatcggggcgcctcctctgtgccctccctgcagtcagtcttaggcagatgtacccacaacctcatggaggctcgaggttgagcgggtgctgtgatgctcggttgagacgaggcatggaaaaacctgggcaaggt

SEQ ID NO: 176616 - DNA, 601 bp, Human
ggggctgtatgtggtgcgtgctcacccggccagtggtctgtgtgtgcatgtgtccgatgtgtctgtggtacgcctccacatcagtgcccacccaggggcatggggccccctgcacctgtgtcctgtagcctgcctggccttcctgtgggccccagccttcttgtctgagaagtgggtgaagcgggagtgaggacgggctctgggccttccccaggtctaggggctgtgggatgttcgtcaccgggtctcagaccatggcctgaccacagtcccatcatctcatcctgggcagctccctggrcccagagagccaagaaaggggagccggtgaaaggtcatgtgtgggccgggcgtggtggctcgcacctgtaatccagcaatttgggaggccgaggcgggtggaactcctgagcctgaccaacatggagaaaccccatctctactaaaaatacaaaattagccgggagtggtggtgcatgcctgtaatcccagccactcaggaggctgaggcaggagaattgcttgaacctggaaggcggaggttgcggtgagacgagatcgtgctattgcactccagcctgggcaacaagagcaaaactcc

SEQ ID NO: 176617 - DNA, 601 bp, Human
gctctcgaaccctctgcaggggcctggacgctaatcctcaggccaacatcacccccatacagacctctgtgcccctcccccaagctttccgggccgtctcctcatgaccaccagggtaaaattttccaaatcgtgcctggagcctgtcagccagcctccttcatccttggtctcccctctgtttaccccgaatcttcctcttttcagctttccccaactcggctcaggccgctctcctccctagatgctctcggtgcttaccacggcctctaagactaattccaaagcccttggcccgagycccgtggtccaccacgcccccagattgtcagctgtaaccgtttatgaccgtagcgtaagcacctgctggtctttccacctggtatgtttttgccacttcctttactcagaacttcactcggtcttccaggttcagctcaaatgccactccctccaggaagccctgcttaatcctgcctgctctttcctcttcactgctctagggtcggaggtctgtcctttactttgcacaaattactaaacgagtcttcgctccaggggacaaaaatgatagggcagagaatgaacccctccaccagcc

SEQ ID NO: 176618 - DNA, 601 bp, Human
tgaggtcccagaaaggactggtcatctccaatggagcttgggacctggttgggtccaatgaggttcaaaagggggccagtcgcttaggagactgggttggagctttcctcatccaatcagggcggagacttccctgtccagtcccagtgaagttgggcgatcccgtccaatccaggtccctgattgtcccagtcacaaggtggggcccatggatggcactgtccgatcgggtcacatgaggctgcagcgcgcgggatgcagcgccccctgcaggcgcagggccgggtgtgcagggcgcgcrcgcaccagagcgcagcgcagcagctcgcggaagagacgcagcacgtgccagttgtacttggcggagcactcgaggtagccgcagcgccagcccctgcgcactagggcggccagcgcgcgccgcggtccgaagcgcagccgctgcctgtcccgcttgttgcctaccacgaggatgggcgcttcgggcgcgcccgccggcctgggggccgaatggagatgagagacgcggggaccccacggccggagaattcccccagtgggtatacacacgcaggcgcattcccttcctacggccagagac

SEQ ID NO: 176619 - DNA, 601 bp, Human
cgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacgggtgagtatggtggaactgcggtcgcgccggcggtagccggaacgcccaaactgggggtcgttcgtctctgggcttggctgggaaractgagtggagttgccgagagggggttgaggcacccgccgcggcccgacgagctcggggatccgcattcctctcccctcccccaaccgggcgggccggttctggaatcttccggcgcccgtggcgcgcggggggcttgctgcggcgggggcgcgcggggcccgccttggcctccattgtgtggcggtcctcgcgccctgagctccgggcctcccgccacgtgggcggggcctgcggccttcgaggccctgcgtgaaggggaggatttggccaggcctcaagccggtcactatgaaaccgc

SEQ ID NO: 176620 - DNA, 601 bp, Human
gcggggcccgccttggcctccattgtgtggcggtcctcgcgccctgagctccgggcctcccgccacgtgggcggggcctgcggccttcgaggccctgcgtgaaggggaggatttggccaggcctcaagccggtcactatgaaaccgccggggggcccgcaggctgctgtccctgtgaggcctccctccccgttttcagggtttcctgagaaaccaggggaaaaagcaaataaagataccgtggatttgtgggccgaggggtgccggcctatgagcgggagccccgtcatccttaagacccmgtcggctggggcgtctggcgctgccgagctgccccctctgtggcttccagccccaagccgaacttctgctcgcctgggctttagacagaatgtgcttccctcctccagggcccccagtttgccgctttcttgggcttctccatttttatcgttattaatccacgtcctcccctcccccaaaaccaattaagtggcttcccagggccctttttctgcaaacgccgagggacatccgttgtataataaggccagcctgggtcgagagacgagaaacgctaccagaaagatatttctggtctc

SEQ ID NO: 176621 - DNA, 601 bp, Human
gcggtcctcgcgccctgagctccgggcctcccgccacgtgggcggggcctgcggccttcgaggccctgcgtgaaggggaggatttggccaggcctcaagccggtcactatgaaaccgccggggggcccgcaggctgctgtccctgtgaggcctccctccccgttttcagggtttcctgagaaaccaggggaaaaagcaaataaagataccgtggatttgtgggccgaggggtgccggcctatgagcgggagccccgtcatccttaagacccagtcggctggggcgtctggcgctgccgagytgccccctctgtggcttccagccccaagccgaacttctgctcgcctgggctttagacagaatgtgcttccctcctccagggcccccagtttgccgctttcttgggcttctccatttttatcgttattaatccacgtcctcccctcccccaaaaccaattaagtggcttcccagggccctttttctgcaaacgccgagggacatccgttgtataataaggccagcctgggtcgagagacgagaaacgctaccagaaagatatttctggtctctctgacctaggaggaacaaaaggccgagc

SEQ ID NO: 176622 - DNA, 601 bp, Human
gtgctacgctaagtgctagcagttaatacacctgtgcccttattgctcttcccttgagagtgtcttgttaatctcatgtatagttaactgaggttttgcctgattatcttttttttcccccttttgagaagctgtgaatgacattgcctacttacctaatgagctttttccgtagctaactttaccataatatgagtgaaccagataagggataacattcatgatactgtgattatttgtcttgttttgttgtttttgttttgtttttttaatcttctagaaaggaatgtttttgattttsgttctccaatttagtccattttattgctaaaatacaaaagttcatgtatgaagttcttgcattcgtttttttttggagcaggcatatgggcaacaaagctatggaacctatggacagcccactgatgtcagctatacccaggctcagaccactgcaacctatgggcagaccgcctatgcaacttcttatggacagcctcccactggtaaggcctgccttggagagatttttgggtcgttctggctagggcattggctaagaagcttattagtcatgctttcggatgtatattctggtcca

SEQ ID NO: 176623 - DNA, 601 bp, Human
ctcttcccttgagagtgtcttgttaatctcatgtatagttaactgaggttttgcctgattatcttttttttcccccttttgagaagctgtgaatgacattgcctacttacctaatgagctttttccgtagctaactttaccataatatgagtgaaccagataagggataacattcatgatactgtgattatttgtcttgttttgttgtttttgttttgtttttttaatcttctagaaaggaatgtttttgattttggttctccaatttagtccattttattgctaaaatacaaaagttcaygtatgaagttcttgcattcgtttttttttggagcaggcatatgggcaacaaagctatggaacctatggacagcccactgatgtcagctatacccaggctcagaccactgcaacctatgggcagaccgcctatgcaacttcttatggacagcctcccactggtaaggcctgccttggagagatttttgggtcgttctggctagggcattggctaagaagcttattagtcatgctttcggatgtatattctggtccataccttggcatctggggaatcctttattcttaggaagaggtattt

SEQ ID NO: 176624 - DNA, 601 bp, Human
tataggcaaattaatggttctctagagccatgtatcacattgtcgttggttgagaaatccccatcatgactgtgggcctaaaaagtacaggtcattctagtttagagactagtagctttgatgagctggagattgcacttagtaataataatgtttgtataaaattcacagtttatagagtggccttcttgtctcccttaatcctcccaagaacttttggggtataaaaacaccaaaattaagcctgatgagcaaactgtgtgaacaaaacttagcaggagcctaattggtagtgcgtgggttcaagcacacatgctgcatttttccttacctcatactgcctttacacatgaaagttatcggatagtcattggagggaatacatagaaatacactgttctcttctaggatttttaaaaattaaacttcagaagaaaggggttatataaacctcaattcaatggaattcttaaaaacttcttaatttttacgttgaacaaaagttttggtttgtgtaatatttcttaccacctttttccttcaagttgtcagcacatagtaggtgtgttttctttttttgccactggtcttttgttttttt

SEQ ID NO: 176625 - DNA, 601 bp, Human
aaaaccggcagggcgcagtggctcacgcctgtaatcccagcactttgggaggccgaggcagggggatcacaaggtcaggagatcgagaccatcctggctaacacggtgaaaccccggctctgctgaaaaatacaaaaaattagccgggcatggtggtgggtgcctgtcgtcccagctactcgggaggctgaggcaggagaatgtcatgaacccgagaggcggagcttgcagtgagctgagatcgctccactgcactccagcctgggagacatagcaagactcggtctcaaaaaaaaaaaaatagaaaaattagctgggcgtggtggcgcacacctgtaatcccagctactggggaggctgaggcaggagaattacttgaacctgggagatggaggttacagtgagctaagatggcaccattgtactctagcctgggcgacagaggaagacttcacctcaaaaaaaaaaaaaagtgaaatggtgctatcgaagggtcaaaatgaggaatggcactgaataggttctctggtttcagaatgaccttttagggtaggagaaggctattgtttttaaacccagaagaagagagagagagagtgtg

SEQ ID NO: 176626 - DNA, 601 bp, Human
ttctaacctagatatatctgctctagaggtaagaaattagctctgacaaacactcgtgaaattacttttaaaatgcacagtgagtaatcggagccgcttggcaatttacccttggtagaccacctttgcagtagctaagttaaacttagtggcttattcctgaaaggcctcatttccgagtgtcatcagatgtatgaagtcccatttgatactctgatgcaacagtatatccaagccatatctggagggttttatatatgaattgggttttgataagtcatcctttttttttcttttcacwtgttaccactttaaaacagctgtctgtctcataatcagtggcaactgctttttcgactggaaaagggtatgggacctatttcagctcaggaaaagttagtacttcacaccctctctggtttttctgggttggttggttggttggttggtttttgagatggagtgttgctctgttgtccaggctggagtgcagtggcgagtgcacccaccacccaggttcaagcaattctcctggcttagcttcccgagtagctgggactacgggcatgtaccaccatgcccggctaatttttgtattttt

SEQ ID NO: 176627 - DNA, 601 bp, Human
gtatgaagtcccatttgatactctgatgcaacagtatatccaagccatatctggagggttttatatatgaattgggttttgataagtcatcctttttttttcttttcacttgttaccactttaaaacagctgtctgtctcataatcagtggcaactgctttttcgactggaaaagggtatgggacctatttcagctcaggaaaagttagtacttcacaccctctctggtttttctgggttggttggttggttggttggtttttgagatggagtgttgctctgttgtccaggctggagtgcrgtggcgagtgcacccaccacccaggttcaagcaattctcctggcttagcttcccgagtagctgggactacgggcatgtaccaccatgcccggctaatttttgtatttttagtagaggcaaggtttcactatgttggccaggctggtctcgaactcgtgacctcaagtgatccgcctgccttggcctcccaaagtgctgggattacaggtgtgagccaccgcacccggcctgcctgttgattctttggactttgcttaaaatattaatagctctaactcagtctgctgcagccttgatgta

SEQ ID NO: 176628 - DNA, 601 bp, Human
accatacctggctaatatttttctatttctgtagaggtggggtctccctatattaccaggctggtctgaaactcctgggctcaaaccatcctcctgcctcagcctcccaaagtgctgggattttttttgtttgtttgtttttgagacggagtcttgctctgtcgcccaggctggagtgcagtggcgcgatctcggctcactgccagctccgcctcctgggttcacgccattctcctgcctcagcttcctgagtagctgggactacaggcgcccaccaccatgcctggctaatttttttttytgtatttttagtagagacagggtttcactgtcttagccaggatggtctcaatctgctgacctcgtgatccgccctcctcggcctcccaaagtgctgggattataggcatgagccattctcgcctggccttgacctggtctgtttttaataaatgagaaacataaacccacaaattctctaaatttatgatgccatggacttacgtaaatgttacttcaacctaaaacttaacattattgttagtttctggtcttcagcagtcccctttgagaaaaagcatttattccctaacagatcact

SEQ ID NO: 176629 - DNA, 601 bp, Human
tcacgccattctcctgcctcagcttcctgagtagctgggactacaggcgcccaccaccatgcctggctaatttttttttttgtatttttagtagagacagggtttcactgtcttagccaggatggtctcaatctgctgacctcgtgatccgccctcctcggcctcccaaagtgctgggattataggcatgagccattctcgcctggccttgacctggtctgtttttaataaatgagaaacataaacccacaaattctctaaatttatgatgccatggacttacgtaaatgttacttcaacmtaaaacttaacattattgttagtttctggtcttcagcagtcccctttgagaaaaagcatttattccctaacagatcacttctcccggatcacctaaactggtagcacacaatatcgcaacgcacttttatagcgtttactgtgatgaatggagcatattaatgtctcttctgtggatatgattgattctcccccttccttagtgttgtcttcaagcaaatatagttggaccgacactgagtttgatgtagtttactttaggattgtatttattattgtatttatttccaggcttaatcat

SEQ ID NO: 176630 - DNA, 601 bp, Human
gagtgcagtggcacgatctccgctcactgcaacctctgcctcctagggattctcatgcctcagcctcccgagtagctgggactgcaagtgcatgccaccacacctgactaacttttctttttgttttattgttgttttgagatggagtttcgctcttgttgcccaggctggagtgcaatggcacaatctcggcttactgcagtttccacctcctgggttcaagtgattctcctgcttcagcctcctgagtagctgggattacaagtgctcactaccacacctggcaaaaatttttttttttgtatttttagtagagacagggtttcaccatgtgggccaggcttgtctggaattcctgacctcaggtgatccacccgcctccacctcccaaagtgctggggtgacaggcgcgagcccctgcgcccagccagtttgtttgtttgttttgagatggagttttgctcttgttgcccaggctggagtgcaatggcgtgatcttggctcaccgcaacctctgcctcctgggttcaagcgattctcctgcctcagcctccctagtagctgggattagatacagacgccaccacaaccggctaatttt

SEQ ID NO: 176631 - DNA, 601 bp, Human
ttaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtrtatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaatgacataa

SEQ ID NO: 176632 - DNA, 601 bp, Human
ttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaayagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcc

SEQ ID NO: 176633 - DNA, 601 bp, Human
tcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaatagaatgaacttcaaaattaaagttgatttttaacttccatrttagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaa

SEQ ID NO: 176634 - DNA, 601 bp, Human
tccatttatttgtatatttatttgcttatttatttactgagacagtcttgctgtgtcaccaggctggagtgcagtggcacgatctcggctcactgcagcctctggctcctgggttcaagcgattgtcctgcctcagcctcctgagtagctaggattacaggtgcccgccaccacacccagctaatttttgtatttttagtagagatggggtttggtgaaaccatgttggtcaggctggtcttgaactcctgacctcaggtgatctgccgcctcaactcccaaagttttgtgattgcagacrtgagccactgtgcctggcctgtctctatttattattttattttactttgagacagagtctcactccttcacccggctggattgcagtggcgcagtcttggtttactgtaacctctgcctcccgggtctccttgcctcagcctcccgagtagctggaattacaggcgcctgccagcacccctggctaatttttgtaagtagagatgggatttcaccaggttggtcaggctggtcttgaacttctgacctcacgtgatccacccacctaggcctcccaaagtgctgtgattacaggtgtgag

SEQ ID NO: 176635 - DNA, 601 bp, Human
atttcaccaggttggtcaggctggtcttgaacttctgacctcacgtgatccacccacctaggcctcccaaagtgctgtgattacaggtgtgagccaccacacccagcctatttagatcttcagtaaagactatcgatttccttaaaggtcttgcaaattttactagttttacttctaggtttcgtttattttcaagttgctgtggttaagggtcttcgttaaatgacacttttctggttattactggtgtatagaaatacagttgatttggccgggcgcggtagctcacgcctgtaatccyagcactttgggaggccgaggcgggtggatcacgaggtcaggagatcgagaccatcctggctaacacgatgaaaccccgtctctactataaatacaaaaaattagccaggcttggtggcgggcacctgtagtcccagctactcggaggctgaggcgggagaatggcatgaacctgggaggcggagcttgcagtgagctgagatggcgccactgcattccagcctgggtgactgagtgagactccgcctcaaaaaaaaaaaaaaaatacagttgattttgggcgggcgtggtggctcatgcc

SEQ ID NO: 176636 - DNA, 601 bp, Human
tcttgctctgttgcccagactggagtgcagtggcacaatttcagctcactgcaacctccgcctcctgggttcaagcctcaagcctcttgagtagctgggagtacaggcttgagcatattaaaaagactgctttttaatatgtatataacatgtagtttattgaggaatgtggagtttatcctggttaagaaagtagtatttaccatcaaaattttggaaataaagatgttaaaatagatttccaagctggatacagtggctcacatgtgtaatcccagcactttgggaggccaaggcaggwggatcccaaggattgcttgagcccaggagtttgagaccagcctggacaacagagtgagactctgtctcacaaaaaagaaaaaaatgcatttccacattattcataccacagttttgccatattttcttttcagtttttaggtatcacgttcctttttttaagtcagaggtatcaatatatatatcctgttgtaatcttttttaagtcctataaatagattgctcttgtgttactggatatatgtaaacaattacagactaaactgatcgtgtgcatatataatgcaaaaaagtacacgtg

SEQ ID NO: 176637 - DNA, 601 bp, Human
gtatattctagtcatgcctaactatgctattctttgtctagatgaacaagagaactgggcaacccatgatccacatctacctggacaaggaaacaggaaagcccaaaggcgatgccacagtgtcctatgaagacccacccactgccaaggctgccgtggaatggtttgatggtgagatgtactcactggcattcttaatctccctggctatagaatatggcatgagggagaaacttgtgaaccataggagcaagaagaccttccatctcttcctgggggaggtagatggccggtctccctkcagtagtagtagcacccagccattgaccctggatttggagatccctttattttgaggcattagtattacaaatcaaccttgcttaaagtggcaaacacttcctaagcacagattatcagaaggtacagaaaacccttcaaaagaacatcttagccagtgtacatttgcatatagataaatatatatatttaaatgaggccttgacattaatggtgggatttcacttcagacaaaaccaacttgaaagcattgaatgacttggccatgtccagtggcttgcacctgtaatcccagcacttt

SEQ ID NO: 176638 - DNA, 601 bp, Human
agtcatgcctaactatgctattctttgtctagatgaacaagagaactgggcaacccatgatccacatctacctggacaaggaaacaggaaagcccaaaggcgatgccacagtgtcctatgaagacccacccactgccaaggctgccgtggaatggtttgatggtgagatgtactcactggcattcttaatctccctggctatagaatatggcatgagggagaaacttgtgaaccataggagcaagaagaccttccatctcttcctgggggaggtagatggccggtctccctgcagtagtaktagcacccagccattgaccctggatttggagatccctttattttgaggcattagtattacaaatcaaccttgcttaaagtggcaaacacttcctaagcacagattatcagaaggtacagaaaacccttcaaaagaacatcttagccagtgtacatttgcatatagataaatatatatatttaaatgaggccttgacattaatggtgggatttcacttcagacaaaaccaacttgaaagcattgaatgacttggccatgtccagtggcttgcacctgtaatcccagcactttgggaggcca

SEQ ID NO: 176639 - DNA, 601 bp, Human
ttagagtgaagaaatataaaattgtgtgtagagtcaatactagactatcgagagctaacaatgaatgtttgttgggaataaaaggaagagaagaacatgggaggctggaagccactctgcctgtcaactccagactgccatttattcagctttggttgtgtctgtatagacatgcctattccttacagaattgtgggagttcagccaggtgcagtggctcacgcctgtaatcccagcactttgggaggctgaggtgggcggatcacctgaggtcaggagtttaagaccagcctggccaacrtggtgaaactccctctctactaaaaatacaaaaattagccgggtatggtggtgcatgcctgtaatcccagctactcgggaggctgaggcaggagaattgtttgaatctgggggggtggaggttgcagtgagcaaagatcgtgccactgcactccagcctgggcaacagtgtgagactccgtctccaaaaaaaaaaaaaaaaaattgtgggagctctgtttctgtagagcacgtggaacacgctcctcacagggaagggggctgatggcctgagccacacggaaacacgggacaggtgatg

SEQ ID NO: 176640 - DNA, 601 bp, Human
atgcctattccttacagaattgtgggagttcagccaggtgcagtggctcacgcctgtaatcccagcactttgggaggctgaggtgggcggatcacctgaggtcaggagtttaagaccagcctggccaacgtggtgaaactccctctctactaaaaatacaaaaattagccgggtatggtggtgcatgcctgtaatcccagctactcgggaggctgaggcaggagaattgtttgaatctgggggggtggaggttgcagtgagcaaagatcgtgccactgcactccagcctgggcaacagtgygagactccgtctccaaaaaaaaaaaaaaaaaattgtgggagctctgtttctgtagagcacgtggaacacgctcctcacagggaagggggctgatggcctgagccacacggaaacacgggacaggtgatggggaaatgacagcagtagtatctgtgggtttacttagtgatttttatttcctatagcaaatttggtgctacagagaaatgatttgctgtttcttgttgttcttgttgtaggtccaggaggcccaggaggtcctgggggacccatgggtcgcatgggaggccgtggaggaga

SEQ ID NO: 176641 - DNA, 601 bp, Human
aggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataagtaagtgctggtgaaaagcagctgtgggccgccaggcacagtaagaggacagcccttcccagcttggttggcgcaagtcctcatgtckctaggaagcttgtgatagtggttgggaggagccaggaaggggcacctgggggctctggaagggcttcctcaccccttcccattctaaccgaagggccctctttaccttgcagaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtga

SEQ ID NO: 176642 - DNA, 601 bp, Human; identical to SEQ ID NO: 176619

SEQ ID NO: 176643 - DNA, 601 bp, Human; identical to SEQ ID NO: 176620

SEQ ID NO: 176644 - DNA, 601 bp, Human; identical to SEQ ID NO: 176621

SEQ ID NO: 176645 - DNA, 601 bp, Human; identical to SEQ ID NO: 176622

SEQ ID NO: 176646 - DNA, 601 bp, Human; identical to SEQ ID NO: 176623

SEQ ID NO: 176647 - DNA, 601 bp, Human; identical to SEQ ID NO: 176624

SEQ ID NO: 176648 - DNA, 601 bp, Human; identical to SEQ ID NO: 176625

SEQ ID NO: 176649 - DNA, 601 bp, Human; identical to SEQ ID NO: 176626

SEQ ID NO: 176650 - DNA, 601 bp, Human; identical to SEQ ID NO: 176627

SEQ ID NO: 176651 - DNA, 601 bp, Human; identical to SEQ ID NO: 176628

SEQ ID NO: 176652 - DNA, 601 bp, Human; identical to SEQ ID NO: 176629

SEQ ID NO: 176653 - DNA, 601 bp, Human; identical to SEQ ID NO: 176630

SEQ ID NO: 176654 - DNA, 601 bp, Human; identical to SEQ ID NO: 176631

SEQ ID NO: 176655 - DNA, 601 bp, Human; identical to SEQ ID NO: 176632

SEQ ID NO: 176656 - DNA, 601 bp, Human; identical to SEQ ID NO: 176633

SEQ ID NO: 176657 - DNA, 601 bp, Human; identical to SEQ ID NO: 176634

SEQ ID NO: 176658 - DNA, 601 bp, Human; identical to SEQ ID NO: 176635

SEQ ID NO: 176659 - DNA, 601 bp, Human; identical to SEQ ID NO: 176636

SEQ ID NO: 176660 - DNA, 601 bp, Human; identical to SEQ ID NO: 176637

SEQ ID NO: 176661 - DNA, 601 bp, Human; identical to SEQ ID NO: 176638

SEQ ID NO: 176662 - DNA, 601 bp, Human; identical to SEQ ID NO: 176639

SEQ ID NO: 176663 - DNA, 601 bp, Human; identical to SEQ ID NO: 176640

SEQ ID NO: 176664 - DNA, 601 bp, Human; identical to SEQ ID NO: 176641

SEQ ID NO: 176665 - DNA, 601 bp, Human
gtgtgttagcaatcatttgagacccgggttgtgaaccaggaagggttactatgtattgtgaaaagttcttgagatttgccgcaggccatgaggagtggtaaagtcagtttaaaaatctgctgtagttctagttaacacgttcacaccttcttcagtaaagtggaatgctgttaccaaaggaagtattcgtgttttagaggggggtgtggtgaaggttcttacaagtttggaagaggtggaagaaaatgttgttacaattgtgtagagtagtgaagggctttggtaaatatcctgtcaaatsatagagtagtatttttagagttgcacccagctgtccattagaagagccagaggccttgtctgttttgttccctggtgtccccagtatccagcgcagttatccgcatattctgtgccctcagatattttttaattaagtgaatactattgatatgggaaaaagaacagttatggtggtttatagcagtgttagttattaaaagctacctgatattttgcaatggattaaagagccaatttttgatcaaatagggctctgggtaggaaagaaaatgaaaatgaagagccagctttcagtgct

SEQ ID NO: 176666 - DNA, 601 bp, Human
cactataatttggagttttaacttaatcttattttaaatttcaaaatgaaattatttctggttatgaaagctacggaacttttttttttttttttttttttagatggcgtctcgctctgtcactcaggctggaatgcagtggtgtgatctcagctcactgcaacctcagcctcctggttctagcaattctgctgccttagcctcctgagtagttgggattacaggtacctgccaccacgcctggctaatttttgtatttttagtagagacagggtttcaccatgttggccaggctggtttygaactcctgacctcaggtgatccgcctgccttcgcctcccaaagtggtgggattacaggcgtgagccactgcacctggcccagaacagttttagtgttttttaaaaaaaaaagtagagatgacctgtaatcccatctggatgtaatgtttggtatttttgttttttttcttatacatatctattgaaataattttaaaaagaacaactttccctgtaaaattgatattcccttaatgagcatttagtgtttataatatggatgcatcatagtttatagcagttctgtgttattaatggat

SEQ ID NO: 176667 - DNA, 601 bp, Human
atggcgtctcgctctgtcactcaggctggaatgcagtggtgtgatctcagctcactgcaacctcagcctcctggttctagcaattctgctgccttagcctcctgagtagttgggattacaggtacctgccaccacgcctggctaatttttgtatttttagtagagacagggtttcaccatgttggccaggctggttttgaactcctgacctcaggtgatccgcctgccttcgcctcccaaagtggtgggattacaggcgtgagccactgcacctggcccagaacagttttagtgttttttwaaaaaaaaagtagagatgacctgtaatcccatctggatgtaatgtttggtatttttgttttttttcttatacatatctattgaaataattttaaaaagaacaactttccctgtaaaattgatattcccttaatgagcatttagtgtttataatatggatgcatcatagtttatagcagttctgtgttattaatggatattgtcaatttttctcttaaagcagtactgtgatgaactcgtttggacattgaattgcattgaattgttctattattttattatttccttaggataaattctt

SEQ ID NO: 176668 - DNA, 601 bp, Human
aactttttggttgcttaccccatcactaaaaaattttgagcattaagcaggtgcggtacatggttctgtggtcccatctacttagttggctgaggcaggagaatgtttgaggccaggagttcaaggctaaagttcactgtgattgtgcttatgaatatagccgctgtactctagcctggacaacatagcgagaccatctctttagaaaaaaaaaaaagatgagatgggaagaatgaagtcagaaaaaaaaaattgataggacttcgtgttgttgctttgagaaaagagaaaaagaaaaaaattgagcatcaattcttaatccttagatatttgatttacaaataatatatgtatagtaactgattattgtggactttataaaatacgaacaaaaaatcaacaaggatgataattaaaaataaagttcagatattttccttttttaccctggggtgtcttggttactcctggaggtatgcgtgtgcgtgtgtgtatgtatgtatgtgtgtgtgtgtatatatttaatatatatgtgtatacattgtatatgtgtatacataatatataatatatatgtgtatatataacatatatatatgtg

SEQ ID NO: 176669 - DNA, 601 bp, Human
aaaattgagcatcaattcttaatccttagatatttgatttacaaataatatatgtatagtaactgattattgtggactttataaaatacgaacaaaaaatcaacaaggatgataattaaaaataaagttcagatattttccttttttaccctggggtgtcttggttactcctggaggtatgcgtgtgcgtgtgtgtatgtatgtatgtgtgtgtgtgtatatatttaatatatatgtgtatacattgtatatgtgtatacataatatataatatatatgtgtatatataacatatatataagtgtatgtataatatgtatatattttttagacaagagtctttttctgttaccgaggctggtgtgcagtggtgcgatcttggctcactgcaacctctgcctcctgggttgaagtgattcttgcgcctcagccacttgagtagttgggattacaggtgtgtgccaccatgcctggctaatttttgtattttttactagagacgggattttgccatgttggccaggctgatctggaactcctggcttcaagtgaattgcctgccttggcctcccaaagtgctggtattacaggtgtgagccac

SEQ ID NO: 176670 - DNA, 601 bp, Human
tagaacatattttaaaaaattatgttttttggaaagccgtttggctgtaatatgtatctccctgttttttaagagttaggtcctagagactgagtgaaggtatgaataattgctacttgctctcctttgctttcaaagtaccacaattaacctgtcactaactctgtttggattagcctgagcctataacaaactttccatgatgattcttagattaaaagataatttttttcttgagttagaataagttgcttttgatctgtggctgcctgccccccaacccctataaattatgacatcrggaaacaaggctttttgtattagaaaaaaatggggaaattaatttcagttatttcatgtgggtcattggcagagaaagataatactaaaatcttagagactgtgaaaagagattatattaagcaacttgagtgattacttttttgccagttaaaagaaatgagataatttatattgaagatgattgctatatacagtgctttgcacaaaaggccacatatctctttttaccttaggtaacatgatgtataagctactttcacatatatcttcttaggtcatcacaaggatttgagatcat

SEQ ID NO: 176671 - DNA, 601 bp, Human
ttctgggatttgatcacaattaaacccaagaggactgagccatctagtttttttcttcttaataagctgattgagaattataaaagacaccttaagaaaaatcagtttctatgcactctgtaaacacagaactcagcccgaactcccaagttctgtatccgtgtgtgtgtgtgtgtgtgtgtgtgtgtgtgtgttgtggtatgttttaaatatcaaatggagttgtggcaactcagatgggatatggtttatattaatacatctaatatgaattggaagatgcttaggcaaacgatttttrttatgacagtataggcttattggagttttggtgttaatatacagctgggagttgagccgttctaagtttatatagccatctggtgatattttaggaagagctgtgtcacatatcctctagagtttaagtgattagagcttgttggcttttgctgttagtttactgcacacttgtagtgttttaaatgcttctgtgaatggataacataattcaaaaaggttagatttctgggttaagacatttgttattatcggcccttactttattcttttaaagagtaagattaggctggatgcagtg

SEQ ID NO: 176672 - DNA, 601 bp, Human
ctacaggtgcacgccaccatgcccagctaatttttgtatttttagtagagacagggtttcaccatgttggccaggatggtcttgatctcttgaccttgtgattggcctgccttggcctcccaaagtgctgggattacaggcgtaagccaccatgtccagcccattcagtagatttaatagatgctgacatcttgtcagatttgcttcaaaggtgtatttaagtatgtttttatttatttatttatttatttatttttgagacgggctctcactctgttgcccatactgatgtgcagtggcrcaatctctgctcactgcaccctccatctcccaggttcaagtgattcttgtgcctcggccttttgagtagctgggattacaggagctcgtcaccatgcccggctaattttcttatttttagtagagacagggtttcactatgttggccaggctggttttgaactggcctcaagtgatctgcccatcttggccccccaaagggctgggattacaggggtgagccactgtgcctggcctgtatttgcttttaaaaattaaaatatgcatacggttggagtcccttttgtcatcctcttagatc

SEQ ID NO: 176673 - DNA, 601 bp, Human
tttcaccatgttggccaggatggtcttgatctcttgaccttgtgattggcctgccttggcctcccaaagtgctgggattacaggcgtaagccaccatgtccagcccattcagtagatttaatagatgctgacatcttgtcagatttgcttcaaaggtgtatttaagtatgtttttatttatttatttatttatttatttttgagacgggctctcactctgttgcccatactgatgtgcagtggcgcaatctctgctcactgcaccctccatctcccaggttcaagtgattcttgtgcctcrgccttttgagtagctgggattacaggagctcgtcaccatgcccggctaattttcttatttttagtagagacagggtttcactatgttggccaggctggttttgaactggcctcaagtgatctgcccatcttggccccccaaagggctgggattacaggggtgagccactgtgcctggcctgtatttgcttttaaaaattaaaatatgcatacggttggagtcccttttgtcatcctcttagatcgtattttcgtatgcagaagttatttatctttttagctcatgcacttatattcttcc

SEQ ID NO: 176674 - DNA, 601 bp, Human
gattggcctgccttggcctcccaaagtgctgggattacaggcgtaagccaccatgtccagcccattcagtagatttaatagatgctgacatcttgtcagatttgcttcaaaggtgtatttaagtatgtttttatttatttatttatttatttatttttgagacgggctctcactctgttgcccatactgatgtgcagtggcgcaatctctgctcactgcaccctccatctcccaggttcaagtgattcttgtgcctcggccttttgagtagctgggattacaggagctcgtcaccatgccmggctaattttcttatttttagtagagacagggtttcactatgttggccaggctggttttgaactggcctcaagtgatctgcccatcttggccccccaaagggctgggattacaggggtgagccactgtgcctggcctgtatttgcttttaaaaattaaaatatgcatacggttggagtcccttttgtcatcctcttagatcgtattttcgtatgcagaagttatttatctttttagctcatgcacttatattcttcctacaaatatctatatatattttatgtagtattgggtttcaaat

SEQ ID NO: 176675 - DNA, 601 bp, Human
atatattttatgtagtattgggtttcaaatttatgtgatattttagtacatactttctataatttgaaaaatgacatgttgatatatgtgtattattattattattttttgaaacacaatcttgctctgtcacccaggctgtagtacagaggcacaatcttggctcactgcaacttccgtctcccaggttcaagtgattctcgagcctcagcctctcgagtagctgggattacaagtgtgagccactgcacttgccttacttcattaattttaatagctgtatagtattcagtcatatgartgaatagtacacaattttagtcctttattgatagttgttttcaacaaatatacaaaggtaaactttttcctcaaattgggtcaagctatatatattgttctaaattagctctttttctcccaataataatagtgtgcaggtttgttacatgggtatattgcatgaggtttggggtacaattgatcacatcacccaggtggtaagcatagcacccactagatagttataagttttttgagacagggtaggtctctgtccctcaggctggagtgcaatgttgcgatcactggtcacggcagt

SEQ ID NO: 176676 - DNA, 601 bp, Human
catgattttattcttttttatggctgcagcgaacctttgggtaaagaaaatttacaaaaatttctcacatctttttttttttttttaatgaaagtaagtagtagtaatccatagttcagatctactttataagtgagtcactgataaagacagtagttacacattttataacattaccttgatgggacaaatttttcttgttttgtttttgttttacttgagttaatttggatgagactttcttgaattacttacatttatagcatttacctccagtggggttgagatgaggagccttcartccaacaaagttgtatacatgcattcatggagatgacacttaggctatttaatcaggaaacactcatacttgtccacatgtagatagtcctattctttggaaattttgctatgttgcccctgctggtcttgaactcctgagctccagtgatcctcccaccttggcctcccagagtgctgggattatagacgtgagccattgtgcccagccagaaatatgattttaattccatagtatatagtatatgttattgtgagtagaatatgtttattctgtaagtagcaaattgactccttcaac

SEQ ID NO: 176677 - DNA, 601 bp, Human
tgaactcctgagctccagtgatcctcccaccttggcctcccagagtgctgggattatagacgtgagccattgtgcccagccagaaatatgattttaattccatagtatatagtatatgttattgtgagtagaatatgtttattctgtaagtagcaaattgactccttcaacagttttaatagttttctagttgttttgtctttagtttcccaggcaaataatgctgttgtcttcaatcacagtattgattagttcatcccattcttcatattgatcattgtttttggatattaaataatastactgtaataattaagaaagatggaaagcctcaccaatttgcatgtcattcttgtgcagggaccacgctaatcttctctgtattgttccaattttagtatatgtgctgctgaagcgagcactccatttctgtaaagcttaaaaaatggacaaaactaacagatgggaatggaaatcagaataatggttatctttggtggtgaggacaggggagattgtaggtatgctgctaatgttctgtgtcttgatctggatcttgatttcatggttgtgttcagtttatgagaatcatcgagtagta

SEQ ID NO: 176678 - DNA, 601 bp, Human
tgttgtttaggagcattccattgtatggatgtacaacaacttgtgtgttcattccccagttcatttgggttgtttccagtttttggtaattacaaataaaagtgccataaaagcattgatgcatgcatacatacacatgtgcccatgtattttttttatggtttaaaaaaatatggtgcctagaacttttataactttattagagaacctgaaaaagctggtgattttcacagaacattataaattgcttggtaaactaccctaaaaaagcccactctggaatgagaagaatctgtttgtrtaaataatcttataatataaactgtaagtcattagaatttttttaaattaaagaagtacacacacatacttgttaaatgggtaaatttatatataaaactccttagtgcataatttcatattttatgtttttagtagcttttaaattgtcaatcattgacttttttgttcctctaagtagtagaatggttatataattggttatgaaagtttttttttttttttttttgagacggagtctcgctctgtcgcccaggctggagtgcagtggcgcgatctcctgtctcagcctcctgagtac

SEQ ID NO: 176679 - DNA, 601 bp, Human
aaaagcccactctggaatgagaagaatctgtttgtataaataatcttataatataaactgtaagtcattagaatttttttaaattaaagaagtacacacacatacttgttaaatgggtaaatttatatataaaactccttagtgcataatttcatattttatgtttttagtagcttttaaattgtcaatcattgacttttttgttcctctaagtagtagaatggttatataattggttatgaaagtttttttttttttttttttgagacggagtctcgctctgtcgcccaggctggagtgyagtggcgcgatctcctgtctcagcctcctgagtacctgggactacaggcgcccaccaccacgcctggctaatttttttgtatttttagtagagatggggtttcacgatattggccaggctggtcttgaactcctgaccttgtgatccgcctgtcttggcctcccaaagtgctgggattacaggcgtgagtcaccgtgcctggctggttatgaaagtttataagtaaaaaataactgggaaaaattttagcactacagaattcctttttcttctcctctcctcccctctcctcccccaaga

SEQ ID NO: 176680 - DNA, 601 bp, Human
tgaatatttagaaaactgaatattgtgtttggagccaagggatattacacttgaaatatggtcatttggtgaacaggtatctcatttgtaggctatcattatttttggtgaacaggtatctcatatgtaggctatcattaattttggcagtttcacattaaaatacctgcctggaaatacctgcccagttttgccagtaatgggaattgcaggttaaccgttggtcttctatatgtggctctatgatgtggacaagacttatagctctttactttaactgagacaacaatgttggtgatcsaagtctagaattccaggatagggttgccaaaattaacaccgtgggagtatggaggtagcaactgtgggattagtaatacaaatacaattttaattagctttatcagttgcacacttaatcttcattgctaccttgtgaagtaggcacggcaggctgtatattgttacttctactttacaagtaagtaaattgtgtttcatagctgtcaggacttacctgaggttgcactgctagtgagtagctgaaatagtacttgagtccagacatcaggttggatgctgtttccacttttgcagttca

SEQ ID NO: 176681 - DNA, 601 bp, Human
cttctactttacaagtaagtaaattgtgtttcatagctgtcaggacttacctgaggttgcactgctagtgagtagctgaaatagtacttgagtccagacatcaggttggatgctgtttccacttttgcagttcactgtcgtgaataagagctcaggcttgggtttgaattgtggttctaccacttacctgtctgtgatcttggggaagttctttaacttctctgagtctcaggtttaaaatggggctaacaataatacctcttagggctcttgtgagatttcagcaagtgcttataatatyagataaccaatagtaagcactcagtatttgctaattgtggttgtttctactgttattaaagtgataacaacactacagttacacatcctctttcccctaaggatctgtgttaagagttgaaagacaataaatgtaagaagcaaaaatattcaaagatgatagaataagtagcaaggggagttgattttagcaggaagatggacaatgttcagaggggtatgtgtgtgtgttgtgtgtgtgtgtcttggttttaaacatggtagcagttagacaatgaagttacaagtgtgttagacagtt

SEQ ID NO: 176682 - DNA, 601 bp, Human
tttacaagtaagtaaattgtgtttcatagctgtcaggacttacctgaggttgcactgctagtgagtagctgaaatagtacttgagtccagacatcaggttggatgctgtttccacttttgcagttcactgtcgtgaataagagctcaggcttgggtttgaattgtggttctaccacttacctgtctgtgatcttggggaagttctttaacttctctgagtctcaggtttaaaatggggctaacaataatacctcttagggctcttgtgagatttcagcaagtgcttataatattagataascaatagtaagcactcagtatttgctaattgtggttgtttctactgttattaaagtgataacaacactacagttacacatcctctttcccctaaggatctgtgttaagagttgaaagacaataaatgtaagaagcaaaaatattcaaagatgatagaataagtagcaaggggagttgattttagcaggaagatggacaatgttcagaggggtatgtgtgtgtgttgtgtgtgtgtgtcttggttttaaacatggtagcagttagacaatgaagttacaagtgtgttagacagttggagctt

SEQ ID NO: 176683 - DNA, 601 bp, Human
tgaaaggagtgacctgtctcaggatctcacatttcaaagcttcgtgctatgattacattggtagaaggcagccaagaaatctagatgagatcttgcttgtacctcctaagagtaatggtatataggtaggaaggacttccacagtcggatgcaagtaagattttttttcctaacaaccttgtaaaacctgggggtgggaaacaagttgaggattcagaatgggagtaaccgtggtggaagctttccttctacggacctggatgagaacagccttatagtgactgagggtaactcaagaagytcaatgccatattagttttctagagctaagggaatatacatagtttagtagtaagcacaagtatcgtgttcatgtcagacactgtagctactgcttcctactagaacagaccagaagaaaccaaagcaagaccagaatcatttcagttttgaggaacagaccctttccttactagcattgcacactttaggagtaaaaatagaatgaaagtggatttgcttcagtactctgaaatagttaactgttgattgttttggtggattagagtgattgcagctctgtttctaaattgaatttcat

SEQ ID NO: 176684 - DNA, 601 bp, Human
accagaagaaaccaaagcaagaccagaatcatttcagttttgaggaacagaccctttccttactagcattgcacactttaggagtaaaaatagaatgaaagtggatttgcttcagtactctgaaatagttaactgttgattgttttggtggattagagtgattgcagctctgtttctaaattgaatttcatggctatacgttgttctaggtggcaaattaatcttttatcagtaccacaaattgattgttggccctttgcggaaatagcaggaatatgtctttttcattttgttgaaggggagctcagagataaaacatttacataatctgaaaatatttttcagagataagactaagtgactgtgtataccacagtgatagattgatccactttgattattgtagaactttctatttctcagtaaaaagtgctaaacatggtaaaattatgaaggattgcttttagctatttgctgtattctttaaagcatatttaggaataaaaagttaatttccaaagtgctgtcatttatttaatacatgttttctccagaatgtgcttcccaaaagttaagagtgcttttatttatttaagaaata

SEQ ID NO: 176685 - DNA, 601 bp, Human
tcagagataagactaagtgactgtgtataccacagtgatagattgatccactttgattattgtagaactttctatttctcagtaaaaagtgctaaacatggtaaaattatgaaggattgcttttagctatttgctgtattctttaaagcatatttaggaataaaaagttaatttccaaagtgctgtcatttatttaatacatgttttctccagaatgtgcttcccaaaagttaagagtgcttttatttatttaagaaatatgttaatttttcttttcttttcttttctttttttttttttttgagacaaattctcactctgttgcccaggctggagtgcagtggcacagtctactgcagcctcgaccttccaggctcccacgaccttcccaggcccaagccatcctcccaatttagcctccaccatgctcagctgagtttttatttcttgtagagactgagtattgccgtattgcccagactagtctcaaactcctgggcttactgtgcctggcccacaagaaatatgttactttttttgagatttttgtataatttgagaacacagattatttgccctactcccccaacccccagtgata

SEQ ID NO: 176686 - DNA, 601 bp, Human
tgtggtggctcgcacctgtaatcacagcactttgggaggctgaggcaagacgattgcttgagcccaggagttggagaccagcctgggcaacgtagggagacttgtctctacaaaaaataaaaaaattagccaggtgtggtagcacacgcctgtggtcccagctacttgggatgctgacatgggagggtcccttgagtctggaaggtcaaggttgcagtgagccatgatcacgatactgcagtccagcctgggtgacagagtgagactgtgtctcaaaaaatttttttttaattttgtgtawattagcttgatttgggtttttttttttttacttacaactgagaattttgaccagtatatttaatgttagtctgaccatttctccagtgggctttctacgtatttaaaaaatagtttggactttaatctcagggtaaacaatatatataggtacactcagtttatatatgagataatattcaggatcagtggagtgaaaatagtaaagtatcttccatttttcaatggcttagagggaaaagtgttcataatgggtatagaattaatcagtattcctttcccattatttatgcctatacag

SEQ ID NO: 176687 - DNA, 601 bp, Human
ctttgggaggctgaggcaagacgattgcttgagcccaggagttggagaccagcctgggcaacgtagggagacttgtctctacaaaaaataaaaaaattagccaggtgtggtagcacacgcctgtggtcccagctacttgggatgctgacatgggagggtcccttgagtctggaaggtcaaggttgcagtgagccatgatcacgatactgcagtccagcctgggtgacagagtgagactgtgtctcaaaaaatttttttttaattttgtgtaaattagcttgatttgggtttttttttttttacttacaactgagaattttgaccagtatatttaatgttagtctgaccatttctccagtgggctttctacgtatttaaaaaatagtttggactttaatctcagggtaaacaatatatataggtacactcagtttatatatgagataatattcaggatcagtggagtgaaaatagtaaagtatcttccatttttcaatggcttagagggaaaagtgttcataatgggtatagaattaatcagtattcctttcccattatttatgcctatacagtgtagaagtttcccttaaagagcttatca

SEQ ID NO: 176688 - DNA, 601 bp, Human
gcttatcaccataataagtacaatagcaaagatataaagtcagtacttttcactgattaggcataaatatcctctttattgttttcttacaaagtagctatgataaacatataaaagggtcagaaagagaggggagaaaaactcggtgaaaagtcagacaagaggaaatgaagaggtgaggtatgtatagtaagcattagtgaacttgtagtaattgctttaggttccatggattgcccacttgtggattaaatgttagacttctgcaaaatgagttgatggtagagatgaagaaaagtcktaatttgttttctttatgctaaggttaaagttgatgtggctaattaggtattaagatcagttttcctgtctttttattatttatttatgtttatgaatgaatgaatgaagaaatgaatgacaaagtctcgctttgtcacccaggctggagtgcagtggcatgatcatagcacactgctgcctcaaactcctgggctcaaaggatcctcctgcctcccaagtagctgggattacaggtgtgcgctaccatgcctggctaattttaaaatttttagtagagatgggttctcgctatgttgcc

SEQ ID NO: 176689 - DNA, 601 bp, Human
ccaggcttatctagaactcaagcgatcctcctgtgtcagcctcccaaagtgctaggaggattgcaggcatgggccaccaaacctggccttgtcttgctttttaataagctgttgtcattatgttgcctttcaaagtccagttcttctttaccaccccatttgcctggaggtaatgcattaggtgagaatgaaaggtgagtacctaaaagattcagaattggaaggccttaataggatcaatgtgtaggagctgcagagaatatgaaggacttttaaatattccagtcccaaaataaacttsaccattggccaagattgtggtaagctaagtatttgagatgtctgtgctacatcatccaactcttggcctgaactgttttagctggcttgcctatgtaaattgaaacttcctttaatacttaactgtgagttaaacatagttctggagctccatcgaaagggtcttagtcagccaggcacagtggcttacacctgtaatcccagcattctgggaagccgaggcgagagaatcacttgtgaggcctggagtttgagaccagcctgggcaacattgcaagaccccctctacaaaataataata

SEQ ID NO: 176690 - DNA, 601 bp, Human
gttttagctggcttgcctatgtaaattgaaacttcctttaatacttaactgtgagttaaacatagttctggagctccatcgaaagggtcttagtcagccaggcacagtggcttacacctgtaatcccagcattctgggaagccgaggcgagagaatcacttgtgaggcctggagtttgagaccagcctgggcaacattgcaagaccccctctacaaaataataataataattattatccagctgtggtggtgctcacctatagtcccagctactcaggaagctgaggtaggagagttgctygagcccaggacatcaagacagcagtgagccatgattgcaccactgcactctagcctgggtaacagcgagactcccgtctcaaaacaaaaacagaaacaaagggtcttagttatacagatcttcttaatcattcctaaagcgtacattccaagtttatatttacagtaaagtgatctatatcccaaaacatgtttccactggttactaatttggggcaagtcattaacttctcagagccttctgtaactaagatttagggaaaatactggtcttaaccagagcacatatgtatacctttga

SEQ ID NO: 176691 - DNA, 601 bp, Human
aaaatactggtcttaaccagagcacatatgtatacctttgactctttttgctgccacatggttaaaaaatcagccttagagaggtataatttgcacaaattttgccttttttctaggatgtaatataaatgaaatcatacaggatatactattttgtgcctgtcctctttcattttagtataatgctttgagaatcattcatattgttaaaagcagtagttgttccatttaattgctaagtagtagtccattgtatggatattccacaattcctttatttactagttaatggatattgggkttttttttttttccaggttttgggtttatttatttatttatttgagacggagtctcgctctgtcgcccaggctggagtgcggtggcgagatctcggctaactgcaacctccgcctcctgggttaaagctattctcctgcctcagcctgctgaggagctgggactacaggcgcatgccaccgcactcggctaattttttgtatttttagtagagacggagtttcaccttgttagccgggttggtctgatctcttgagctcgtgatccgcccacctcaacctcccaaagtgctgggattaca

SEQ ID NO: 176692 - DNA, 601 bp, Human
ctcccaaagtgctgggattacaggcatgagccaccacgcccggcccagtttttggctattacgaataaatctcctctgaatatttgcaacatagatctttgtgtggacatatattttcatttctcttggttaaaaatccaggagtagaaattgcaggattgtagggtaagtgtgtttatagtttttaaagtaacggcctattttgcattcccactggcaatgcatgagaattccagggctccaaatccttgttgatgcttggtattgtcattcttactaacttaagtcattctagtgggtstgtagcaatacatcatcatggttttagtttgtaatttccagatgactaatgatgattatcttttcatgtgcttatttgccatttatatgtctttggtgaagtgtctgttcaaatcttttgctcattaaaataggttgttttttgtttattgtgagttcataatgtattctgaatatgagtccttcataacaggttttgtaaattacatgttttgcaaatatgttcttgtaatttgtggcttgccttttcattcttaacagtgtctttcagagagcaaaaacttaatctttatgtagtcag

SEQ ID NO: 176693 - DNA, 601 bp, Human
tgtaatttgtggcttgccttttcattcttaacagtgtctttcagagagcaaaaacttaatctttatgtagtcagttattttttttttctttttgagttaatgatctttttaaaagcctatctaaggaattgtctctaaacctaaggtcactaatattttcttaaattttattctggaagtttatagctttgtttgacatttgggtctgtgaaacacttcaaattaatactgagagaagtaagtgtagggttgcctttttgtatatactgtgaatatctgagttttcctctgagcagtgctycagttgcagctcacaaaatgacatattgtgtactactattcagtttgaatattttctaatttctcttttaatgtcttttttggcctatgaattataaaagtttgatgtttaacttcctgtagatattttactgttactaatttaattccattgtggtcagagaacatactctataggatttcagtctttttcaggatttcagaatttgagatttgttttgtggtaaggcatatggtctattgtggtgaatgttttgtgtctttgaaaagacaaatatttggttctaccagttctgtctca

SEQ ID NO: 176694 - DNA, 601 bp, Human
taccattttgccatttgttttctattcatcccgtctattcttttctgtcattttttgaatgaaagattttgtaatatttcatcttatcccctcttttagtggagatatacttatttgttctatttttctctgtggctgctctatagtagatacctttaacttacgacattctgccttcaaattatataccacttaatgtataagaatcctatggcgttatgtctccattttcctatcttctgttctttttgctattgtcatacattttacttttggatatgttagaaaatccataattcarcgttaggcttgtttttatttaaagctttgttcatctgggcctgtagaggagcctttgccctcgggctagttgagctgtgtttataaaggtttcagctgaatggcctgagtttagtaaggtctctttaatcagtcagaaggagaatgcctgtgtaaactctggtagttgtgtttatagttcccaagtagttgcttgttacccagtggttgttctttgcctaccctcgtgaaatctcacctaatacatgtgcagctaatttagtaaagatgtagtagtgcctcacaaattacagctgcttca

SEQ ID NO: 176695 - DNA, 601 bp, Human
tttccttttatacttgtcaaaagtcatttatacataaattgacatactgtgtccatgatatgtatggataagtaagatctttttgtagcttgaatatcttatgagtaaatagcatttcctaactattaaatgggatttgaatagctgtcaagggattacttgatacagagaagttgctaatttattttgaaattgtaaaatacattttcccctctgaaatcacgaaatgcctcatattgctaatgcagtgagtttaagtgtttaatttagaaaaaattagtaactgctggttgcctcataktgctaatgcggtgagtttaagtgtttaatttagaaaaaattagtaactgctggtgttatttggcatgagatgaacctggaagggaagtgttgaggggcatcatctgtacttggcactgtttagaactttctttagaggtgtatagtgctttcttacactaatattccagtgtatgcctgaatagcacttttcttcttgtactgaaaaataagtccatggtgttaagcaggcatctctaaagtggccatctgatttaaaatagcttccataagttttaattaattttgcatgttttagttt

SEQ ID NO: 176696 - DNA, 601 bp, Human
cactgttaggttataggctctgtagatgtagtggtgaacaagatctccgttgttactcagtttgtagactatgaaggaaaaggagtaagggttggagaattactcatgtattaaatatatgttgctttttggaggcaaatgaataaaatatttagaatggttaagatagtcttctgctttctttggattcactaggggttttatcataatctgtctcatatcatttcatatgttaaaagggaattttaatgaaatacgttactactggttgtggattctaaaaggtagaaggacaaaatawtatttgcctttaagaatacaaagaaaggattgtctgtttgtatggttagttgaattgtcttatttcctatttatttattttttattgctgagatctcactttgttgctcagggtgatttttaactcatggcctcaagtgatctcctgccttggcctcccaaaatgctggaattacaggcctgagccatttcaccccagcctatttcttattctccctacaagggacattttagtgtaaggcaaaaatataaaattatcactcataatgttttttcggaaaatatatgactgcatggtttt

SEQ ID NO: 176697 - DNA, 601 bp, Human
gctgatgacttacatgcttttattattaagatttaggttcccagcactttgggaggctgaggcgggcagatcatgaggtcaagagatcgagaccatcctggccaacatggtgaaaccctgtctttactaaaaatatgaaaattagctgggcatgttggcacgtgcctgtagtcccagctactcgggaggctgaggcaggagaatcgcttgaacctgggaggcagaggttgcagttagctgagatcgcgccactgcactgcagcctgggcgacagagcaagactctgtctcaaaaaaaaaaacaaaaaacccaaaaaaaattaggcaatttgctttaaaaattagataactcatgaactcgttggttattccttattagctaaaaaaaattattagaccactgtatattatgctaattaaatgactcatttctgctagttaaaccatctgtaataggctacagaacacattttgctggagtatgtaaaactaagcccaccaggaaacttatggctaaaattaaacagaatcctgctaaccttgtgtgtgtattcaattttggtacctgaaagaatttgtggtatttagaatatttgaatgtt

SEQ ID NO: 176698 - DNA, 601 bp, Human
catctcggctcactgcaagctccgcctcctgggttcacgccattctcctgcctcagcctcctgagtagctgggactacaggtgcgtgtcaccactcccagctaattttttgtagtttttttttttatttttattttttattttttttttagtggagacggggtttcaccatgttagccaggatggtctcaatctcctggccttgtgatccaccctcctcggcctctcaaagtgctgggattacaggtgtgagccactgtgcccagcttgtattttttttatgtagacatagggttttgccrtgtttcccaggctggtcccaaactcctgggcttaagtgatctgccaccttggcctcccaaagtgctgggactgcaggggtgagccattgcacttggccaactagggatgttgagtatcttttcttgtatgtattggccttttgtgcttctttggaacaatgtctgttcaagtctttattagttttctcaggctaccataacaaaatatcacactctgggtggcttaaacaacagaaataagtctggcagggtttgatttttggtgatggctctcttcctagagtgaggtctctggtgtct

SEQ ID NO: 176699 - DNA, 601 bp, Human
gattgtgccctttaaagcacaaaaatgtttaattttgatgaaatcccatttatttcatttttctttagccactaaatgcttttggttttatatctcagaaaccattgcctaatctaaggttatgaagatttactcctgtgttttcatatagaagtttaatagtttttgcacttacatttaggtctgtgtctattttgagttaatttttgtatatggtgtgaggtagagttcttatttaattctttggtagatggatattcagttgtcccaccaccgtttgttgaaaactgttctttcctcrttgagttgttctagcatctttgttaaataacatagatgttaaataaatgttaaataaattaaccatctatgtaagagtttatttcttgactttaaattctattccattgatctgtgtgtctttatgctagtaccacattttcttgataatttcaaaacttactacaaagatatacttgagaagtgtgagttattcagctttgtccttttttcatggttgttttggttattctgggtcccttgtatttgcacatgaattttaggatcagcttgttgatgtatgcaaaaagctcactgatag

SEQ ID NO: 176700 - DNA, 601 bp, Human
tctaaagcagtgtgcatgcaataaggtgcatgcattgggcacagcaacacttgtgagaaatgatagtaacattccttggatggagactctttaagggaggaaaatgtattatattagtttcttgtttgcatcagcacctcctggaattaattttcagtatacaagtaggtgaagaaatgctccttttaaaatacctttttctttttttaaaatttttaccacaatcatgactacatatccttgtaaaatattaaaatgtaatgctaaaatctctagcctttgtttttttttttttttttttgagacgacgtcttgctttgtcgcccccacagaagtacagtggcatgatctcaggtcactgcaaactccacctcctgggttcaagcgattctcctgcctcagccacccaagtagctgggactacaggcgcaaaccaccacgcctgtctagccatcatttttaatcccgttcttttctcatcgtctgtacgggtaatcactacattttttttttctttttttttttttttttttagacaaagtcttgctcttgtcccccaggctggagtacgatggcatgatctctctggtcactgccgcct

SEQ ID NO: 176701 - DNA, 601 bp, Human
catagaaggtttttaaaatggaaatgctcaactctttttagattattattctaacacttactgggaaggtctgaattttgactgaactgtttatagcattggacaagtgtttgagaggtgtgaggggtgtgtggagagtacagcaggtaagaagagccctagtaactgtggacagcacatagattgggttccagacacatagtctttgaatttttgtctttcagttgaatcagttcagtgaattcctttcatactatttgatttccagataattttttaaagccttaggagtgtgtttgtrtaatatttttgcttttgaaagtcaattaaggtaaattgtctacaacaaaattcacttcgtatattttggaaaatatatacagttataaaatcaccacctgattaatatgtagaatatttccattactgcaaaaagaattccaggtaccctttggccattaattctctctactgctcagtgaaccactgatcatatctccatcactataggttagttttgcctcttgtaggatttaatataaatggtcatcccagatcttttatgtagacttccaaacctagcattatattcacattaata

SEQ ID NO: 176702 - DNA, 601 bp, Human
ttccgcctcctgggttcaagcgattcttctgcctcagcctcccaagtagctgggactatgggcgcgtgccctcatgcccagctaacttttgtatttttagtagagatggggttccaccatattgaccaggctgttcttgaactcctgacctcgtgatccgcctgccttggccttccaaagtgttgggattacaggcatgagccaccacacctggctgccaaagctatgttttaaaaaaataattttctatttccgtagtcctcctagaaggggagagagaatcctttttttttttttttttaaagcagattaagaccattggagggaaggagtatgtctaacctgatttttagcccttttttgtaagacagcaatgtcacggatttatcaagatttcatgttatttggtaggaactcctgacagccagctctttattcttctttgcacatgtgcattgatttcactgtacaccttctcaaaattctggaatggtttattcttttgaaaaaattcccatctcagagatacactaatgttgatcaggattataaggacaggttataaatctgaatgctattgtaatttgtttcagtctattac

SEQ ID NO: 176703 - DNA, 601 bp, Human
tttttttttttttttttaaagcagattaagaccattggagggaaggagtatgtctaacctgatttttagcccttttttgtaagacagcaatgtcacggatttatcaagatttcatgttatttggtaggaactcctgacagccagctctttattcttctttgcacatgtgcattgatttcactgtacaccttctcaaaattctggaatggtttattcttttgaaaaaattcccatctcagagatacactaatgttgatcaggattataaggacaggttataaatctgaatgctattgtaatytgtttcagtctattacattgtagatttttgacttgaaccagtgagttctctaagtgcttctcttttgttctcttaattataaaaattgagatgtaatacacgtataaggtatagtaaccctaaattaaagcctggcagctttttagatatgtatagacccatgtaactacacccatattaatatacagaacatttatagctctctccctactaaggttcccttccatcctttcttaggcactacatactgtgagataatcactgtcttgtcatctgtccccagagtgctttcatttttgt

SEQ ID NO: 176704 - DNA, 601 bp, Human
aaagttataatcaaagattgctgggaaggcacggaagtgatcaagactaattatgattcagatgattaatagtatcattcagagatagtcttatgcagcattcctcatggtcagagtactttacctgggactagagtacaacattttttaaaaaaatgtggattttgccataaggaaaataatgaaaaagcaaaaggataatgaactgatgtgatgaatgttcatgtacctacgacctaatttaacaaatatttatccctgtcatagttcagattttaaaaactaactttgctatgttatrtgaaaataataatagttatagaaataatataaggaactctcaatgttcttcaccaattgtttacattttgtttcatgtgctttattatttctccctttctccatattttttccctgaatcattttagagtaagttggaagcactgtgcccctttgcctctaaatacttgagagtttatttctttttataaaattttaaaatttttattttttgagatggcgtcttgctctgttgctcaggctggagtgcagtggtgcgatctcagttcactgccacctctgcctcctgggttcaagcgat

SEQ ID NO: 176705 - DNA, 601 bp, Human
tgtcccattatggtgagttgtttgtcctaccctgttatattagaatctagaaacatactagctttgaccttggacaagttattgaatccttgggaaccttgaagtcctcactgttaagtgggttaagtggcacctccttcaacaactatgaagattgaataagatagtgcgtaaaaagtacatagcccagtgattggcacatagttcagtaaataatagctttaaagtatgaaaataatggtatttattcagagtttggtttcgcttaacaaagtaatttatccatttagactacttttawtaagcatatatttttctattatagtatttaagcagagctttgtgtgtaatatattttaactataggtgtcttgtgaattaagaaatggatacttctgtaatgaagacgttttaagagcttttaagttgtacattagtttgttctttgataaacccatgagattgttttgtcaggggagataattctatttcttttgagaggtaaatacagcttgtactatagtatttgatcaatttacaataggacattagtggtagagctaatatgtatgtgattactaaatggcatgtacagttcgaa

SEQ ID NO: 176706 - DNA, 601 bp, Human
tagtgtatgttttcagttcttaccttacacactagtattccttttgaaagccttgtttaaaacagcagaaactgaaatgatacggcagagtaaaacgagacgtcatatttctccactaggtcaaagaggtaaagaatagaagtaacactgccacaaattgtagagaatagaataaaagaaggaaagcaggagatctattcctcagttatgacttttacaaaataatttccatatctgatgcggtttactgtctgattgaatgatctcttctctccatgcccacttttttttttttttttttgagacggagtcatgctgtgtctcactctgtcgcccaggctggagtgcagtggtgcaatctcggctcactgcaggctctgcctcccaggttcacgccattctcctgcctcagcctcccgagtagctgggactataggcgcccgccaccacgcctggctaatttttagtatttttagtagagacggggtttcaccgtattagccagggtggtctggatctcctgacctcatgatccgccctctttggcctcccaaagtgctgggtttacaggcgtgagtcactgtgcccggcctccatgccc

SEQ ID NO: 176707 - DNA, 601 bp, Human
ctagtaatgttaagcttcattttgtcttgtacttacttggatttgcagctttaagatgcttatcattagggctgaatcttatttctctggaggatactgactctttaaatggctgtaaaaatcattgagcgcctactcgataccaagacattctcttctaagaagagacttctttctttaccatatactgtctacctttggtcacagcagttttgaggcttgggagctatttgttctattcctttttttgtgcttgttcacttttttctttcaaaaaactttgcagattttttttttttttgagtcagggtcttgctctgttgcccaggatgaagtgcaagcagcacaatcatagcttactgcaggcttgagctcctggggttaagtgatcctcctgcctcagcctcccgagtagcggggactataggctacaggtgccgccgcacccaaactttatttgttttataaaacactagtttttagaatataaaacttggtgaatagtatcactatgtataattcttgagtctcaagtgtaaacacatcaaaatgcgtttcgtagggagtatatattcagggcaacttgaatctatgctcctga

SEQ ID NO: 176708 - DNA, 601 bp, Human
acctaggatctcattatatgctcattaacatactaaatcacatacccaccagcaccatgcagttccaggaacacccatatttggtgtagaaatgggtggcactacagttctgagaaatcgtaactgttttcctggaatcttcctgaatattccatgctttgcgtaaagaaacccataaagatggaagtaccaacccgcttggtacaaccttctcttgagtatacccacacccccctttcttgagtttataattttcgctttgtcataaatctccgtactttcactgtttctgactcattcytgaatttctccttgtgatagtgtcaagagcctggacaccagctgagggagaggtctcactgctctttggggacttcccccagcccgctggtattcagacctttccaaaatctgagtgtctgttgtggaatcatatagagagaaatttttcttggtcattagagtaaagtatatgcaaattcttttcttcttttccatagctcactgctatttggggacttccctcagcccactggtattcagacctttccgaaatctgagtctctgatgtggaaccatatagagataaatttttcttggt

SEQ ID NO: 176709 - DNA, 601 bp, Human
cccggctaatttttgtatttttagtagaggcggggtttcaccatattggccaggctggtctcgaactcctgacctcaaatgatatacccgcctcggcctcccaaagtgctgggattacagaagtgagtcactgtgcctaactgaaaactatacgttttctaattgtgctgcataattgtatattttgtgatttgtatttgatgaaaatatgtccacgctggaatttaaaataaactgttttacaatggtatttttgtgtcctaacttaaggtctggttaaggagtgtcatggttcaaactrtttttattataggtttaaataaaataaaaacaaaacaccgtggggccaaaagatgggaaagggactttgttggagctgatagttttattattttcaaacattgaaatcttgtagagatagacttttcaaattaatcctgagttgttaattttaaactttgtgattatctcactcttgagataatcctataaaccttttcagacataatcattgaggttagctaaaactacttttagcaaaagccatatgcttgttttcccagtgggtgaaattgagcactgacttttagagtcactaatg

SEQ ID NO: 176710 - DNA, 601 bp, Human
actttgctgaggttgaaaacactggtgacctccctttggttataagagagaccaggagttcatatgcattccttcagaaaaatatttgaaaaatataacactgaccttgggagattagtgcatatgatcttgattttatgatcttttctagagacactgcaccactgcagccactgcctcaatcatgatacagaacttttacatcacatgagaaagttcctttatgcaccgcttctagttagtctttctctgccctaatccaaactactattctctttcctatcactaaaaattagtttcrtccttgaacttcatgtaaatggaatcatacaatattcttttctaacttgttgctttgagtcaacatcatgcttttgagacttatccaggttgtatcagtaagtagtttgttcatttttattgctgagtatggcaatccattatagaaatataccacaatttgtttatctgatcacttactggatatttggggttgtttccagtttggggctgttatgagtaaggttgctgtgaacatttgtgtccagacctttttgtgataatgtgctttcatttctcttgggtaatacccaggagtaga

SEQ ID NO: 176711 - DNA, 601 bp, Human
tcatacaatattcttttctaacttgttgctttgagtcaacatcatgcttttgagacttatccaggttgtatcagtaagtagtttgttcatttttattgctgagtatggcaatccattatagaaatataccacaatttgtttatctgatcacttactggatatttggggttgtttccagtttggggctgttatgagtaaggttgctgtgaacatttgtgtccagacctttttgtgataatgtgctttcatttctcttgggtaatacccaggagtagaattgttggatcataggataaatgtrtgcttaacctcataagcagttgccaaactgtcctccaaagtggtaatgccattttacactttacgagccgtgtatgaattccagttactcgatgtcctcaccaacatttgctcttgccagtttctttaattttagttagttcagtggatgtaaaagggtatctcattgtggttttcattttttgtctccctgatgactgatttgagaatacttctcctacatgactttccttttcattttcttaatggtgtcttttgataagtagagatttttaaaataaaattttaattgtgggaaaat

SEQ ID NO: 176712 - DNA, 601 bp, Human
atgttccttgctgagaaaaagaattcagcgatatttctcccatttgcttttgaaagaaaaatatggctctgttccatccggctcaccggcagtcagagtttaaggttatctctcttgttccctgaacattgctgttatcctgttcttttttcaaggtgcccagatttcatattgttcaaacacacatgctctacaaacaacttgtgcaattaatgcaatcatcacagggtcctgaggtgacatacatcctcctcagcttacgaagatgacaggattaaaagattaaagtaaagacaggcayaggaaatcacaagggtattggttggggaagtaataagtgtctgtgaaatcttcataatttatgttcagagattgcagtaaagacaggtgtaagaaattataaaagtattaatttggggaactaataaatgtccatgaaatcttcacaatttatgttctgtcatggcttcagctggtccctccgttcggggtccctgactttccgcaacaatgatgtgtgtatttttctttttttcttttttttttgagacagagtctcactctgtcacccaggctggagtgcagtggcgccatctcggct

SEQ ID NO: 176713 - DNA, 601 bp, Human
ttcagctggtccctccgttcggggtccctgactttccgcaacaatgatgtgtgtatttttctttttttcttttttttttgagacagagtctcactctgtcacccaggctggagtgcagtggcgccatctcggctcactgcaagctctgcctcccaggttcatgccattctcctgcctcagcctcctgagtagctgggactacaggcacctgccaccacgcccggctaatttttttgtatttttagtagagatagggtttcaccatgttagccaggatggtctcgatctgacctcgtgatcygcccgtctcggcctcccaaagtgctgggattacaggcgtgagccaccgcgcctggccttgatgtgtgtatttttcttgtctacgtttgccactcttttagtatataagtttataagttcatagaaattttagctgaagtttttggagaaggtgtgttgggtaaggtgagcttgtcagggaaggaaggaattggtatgttatgactattccagatctactttgaatctgtatcctatgacttaaaggattattttgctatgtctcatatagcaaaatgaggctcttatagtcttagaacat

SEQ ID NO: 176714 - DNA, 601 bp, Human
ccttggcatcccaaagtggtgggattacaggtgtgagccactgcatccggcctccgtgtggacaacttaaggcaagagctagcggggtcttaaagcccagaagagtgagaacagtgtttcgtggttccttttgagacattaatatcttttagattggtgcaaaagtaattgtggtttttgccattaaaaatgatggcaaaaactgtaattacttttgcaccaatctaatacttatctccactgcttttatctaccccaagaacttgtcattgtcctaggggagaattaacttttacttctwtctgacttacgtgttagttttgtgatgttttattctagattaagtatcctcacataaagtcatgtttttgataataggggaaaaagtcagacttttacttttgtcttttcttcctacccccacaagaagacaggaagtagatagagatcaaattgagttggaggaggatagtatttgtggacttccaaacaaattcttttatcctcaggacatatgtagcttggtatgcagaggcagcatgacttttggaaattaggtgctgttctttttcttatttctgttacattttaaagttttgca

SEQ ID NO: 176715 - DNA, 601 bp, Human
cgtgtggacaacttaaggcaagagctagcggggtcttaaagcccagaagagtgagaacagtgtttcgtggttccttttgagacattaatatcttttagattggtgcaaaagtaattgtggtttttgccattaaaaatgatggcaaaaactgtaattacttttgcaccaatctaatacttatctccactgcttttatctaccccaagaacttgtcattgtcctaggggagaattaacttttacttctatctgacttacgtgttagttttgtgatgttttattctagattaagtatcctcacwtaaagtcatgtttttgataataggggaaaaagtcagacttttacttttgtcttttcttcctacccccacaagaagacaggaagtagatagagatcaaattgagttggaggaggatagtatttgtggacttccaaacaaattcttttatcctcaggacatatgtagcttggtatgcagaggcagcatgacttttggaaattaggtgctgttctttttcttatttctgttacattttaaagttttgcaagctactttgctcggttatctttaatgttgtatgttagccagttgattagtgac

SEQ ID NO: 176716 - DNA, 601 bp, Human
tcaaagtaaatacaatatccacattttatttctggaaatgaattgtttaaatattattttttagacagggtctcctctgtcacccaggctggagtgcagagggatgatcaccactcactgcatcctcagcctcctggactcgagtgattctctagcctcagccttctaagtagctggggccacaggcacgtgccatgaggcctggcgaatttttcatagaggtgggattttgccgtgttgcccaggctggtctcgaactcctaggctccagcagttctcctgcctcgccctcttaaagtgktggaattacagttgtgagccactgcacccagcctggaaatgtaaataattataatgacatgtagtaagcattataaataagaataactatattgaaatggcacagtgaactctgcagggaagcttttgcagtaaaaatgttttcaagctggccaggtgcggtggcttacatctgtaatctcaacactttgagaggccaaggtgggaggatagcttgaagctagtttgacaccagcctgggtaaagcgagatccctgtctctataaaaaattaaaaaaaaaaaatgtagccaggcatggtg

SEQ ID NO: 176717 - DNA, 601 bp, Human
gaatttttcatagaggtgggattttgccgtgttgcccaggctggtctcgaactcctaggctccagcagttctcctgcctcgccctcttaaagtggtggaattacagttgtgagccactgcacccagcctggaaatgtaaataattataatgacatgtagtaagcattataaataagaataactatattgaaatggcacagtgaactctgcagggaagcttttgcagtaaaaatgttttcaagctggccaggtgcggtggcttacatctgtaatctcaacactttgagaggccaaggtgggaggatagcttgaagctagtttgacaccagcctgggtaaagcgagatccctgtctctataaaaaattaaaaaaaaaaaatgtagccaggcatggtggtatatgtctgtggtcccagctacttgggaggctgagacagtaggattgcttgagtctgggatcctgaggctgcagtaagctgtgatcgtgccactgcattccagcctgggcaacagagtgagactccagtctttaaaatgaaaaagaaaaaaaaaaaaaaaatttcgagccaagaattgaaggacacatgggccttgtccagatg

SEQ ID NO: 176718 - DNA, 601 bp, Human
gggaaggactgatcctgttgcatgtgcaccaggtcaggcctgttcatgaatggtttcagactgttaatggattagaaaaatgtcttatgaagaaaaatgagggaacaaggaatccggaggaaatgatttttgtagcagtttctctatatgaagaatttgtattagtattagggcaatatcattcaaacctctcattaatgtactacctgcatattttttttgcagtatctgtataccaaatgggagtgcatcttaaagacaatggcatgttatggttgaattggaaaagttttttttttttctagtggtatgtaaattaatagtgtgtcttgaatttgatggcatctcagactgaataaaaggtaaaattttaaaaatgctcagtagcgcaaatatagttcttaaaaagatacttgtttatgttctgtttaatctcagatatcaccaatgataatatataccacggcatggaaatactggtaatagagtactcccattgaaaaaataactatatgctttagaatatagggtttaggttagattgtaaggaaactgttgaagatgtaaatcattagaaaagaaaaagtgtaagttctttcca

SEQ ID NO: 176719 - DNA, 601 bp, Human
tggacagttttcaattgtgatgacagcagttaaaaattcaaatctgttccttttcattgttgagttgtatgcttaaagaatgcatctgcattttcattcagctttctggtccttgtcgatttttgatgtctgttattctgcataaaactgtgtggcaggcgccagaacttttaagaatctttttgtttacagatggggagacaataacattaacattcattaacattcaaaataaaacattcttatactgataagcagtatgcaggttagctaggtttgggatactgatagatattttttkagtgtagtttacttccaaatgtcttctagaatttatgtttaatatctcaaatacctacacagaataggaatggcatgcttatttatacatgggcgtactcttgagttctaatggcaagccagccttcaaattaagttgtcttcctggaaaagaaacctcttaggcaactgtgaagggagagggataatataaaaaggatggagtttagaaatttgtctttttgtggtaagatctagaaacaaagcatattagaataagcagtgtaaattttgcacctttcaaaaagatactgatgttttt

SEQ ID NO: 176720 - DNA, 601 bp, Human
ttaatttaagccttattaaaaaaaaactttttgagaacctgtttttaaaactactcctcttcgtggagattgattattttgggtctttttgtccaagaaaatgaaattaagattttattctttgattggtatgagggaggaaggagagtcgtcagtctagtgttaaagataaaattatgtatgtttaagaggggcagaagtcatcacaagattataattaggaaaatttaagtttccatacttccaaggaagtatgaatttctagaatatcttttatttccatttgatttaggcattgctrttgaagacactgatttggggcaaggtgtcggggagaacaggaggaattgtagttaacttctttcctcttcaccagaggttaactgagagcaagaagcaggacatgaatgagtgtgcaagaatttgccttctgttaatttcccaaaggtagaccttggaaatagtcaaaagaacaaaagtcaggaaacctttttccgaggctggagctagtctttctgatctttccaaagcagttataaatattgaagtacctctggcacttagataaaatgattctgcgtggctttaaactcagttaatt

SEQ ID NO: 176721 - DNA, 601 bp, Human
atttcccaaaggtagaccttggaaatagtcaaaagaacaaaagtcaggaaacctttttccgaggctggagctagtctttctgatctttccaaagcagttataaatattgaagtacctctggcacttagataaaatgattctgcgtggctttaaactcagttaatttctaatgcttgaatgtctggattttctatgatttctgaacaactcagatttaagtatgtcttttgttttctgtgaaattataagggttttttccttaggagatagggaacatttctgttttttatttttttatttwtttttttattttttgagatggaatttcactctgtcgcccaggctggagtgcagtggcgtgatctcagctcactgcaacctccgcctcctgggttcaagcaattctgctgcctcagcctcctgagtagctgggattacagatgcacaccaccatgcccagataatttttgtatttttagtagagacggggtttcaccatgttagtcaggccggtctcaaactcctcaccgcgtgatctgcccatctcagcctcccagagtactgggattataggcatgggccaccaccacgactggctggg

SEQ ID NO: 176722 - DNA, 601 bp, Human
aaatgaagacgagtgatttttaagcattaatcactaacctactgtttcagattctgtctattgcagaacttcttttgaagaatgtatttagaacctttcccacattaaaaaggtcaatttatgtaaatgaagaataaacaacatactctgtacctcgtatgtagttacatacttacacatgattgatcttttggtcattatctattgaaacagagttttcacttgttaatagtggaaattatcttaagtgttgctggttcaagtgatttattacaagtaaaggttttttttttttttttttgagacagtctctcactctatcaagtggagtgtcgtgtagtggctcgatcatggctcactgcaacctctgcctcctgggctgaagtaatccgcccacctcagcctcctagtagctgggactacaagcatgtgccaccacgcccagctaatttttgtgggtttttttgtagatgatggtttcatcatgttgccgaggctggtctcgaactcctaggctgaagccatctacccgccttgagtaaaggttttttgatacaagaaatgattataacttggagttcagcttggattctgacaactt

SEQ ID NO: 176723 - DNA, 601 bp, Human
gtttccaaagagatagaaaagacacatagcttctggtgtgtgtgtgtgtttttttttttaaaatcatgttagttggaggtctcattgaaccaggacaatgacagaattttatatttatatttgttttatctttttcaatgcatggtcatcaatagggaaaaagtcacactaggagcgttgagccctgtgaggatatcacacctgaccctggaatggcagttgtgtaagggtaggaactttgttttgttcattgctgtatttctagttcctagaatagtgcccatcactcagaaaaacacgwtgaatgaacatccaccacttaccacagtagctgaatgtagccatgcttttaactctctgctcgtctgttttcatttatagttgacttcaacaacagaggttttagaaaatttgagcagggagtaagactaacctatagtagttttacacagtgggttttggttaatgctcatgattaatttctcttcccaccatagaatggtcttacccaacatgctacagaattctagtttctgatatgtgaaaagttaatagacataagaaaggaaacactaacaagctgaaaaaaatcacctaaaat

SEQ ID NO: 176724 - DNA, 601 bp, Human
tcgtctgttttcatttatagttgacttcaacaacagaggttttagaaaatttgagcagggagtaagactaacctatagtagttttacacagtgggttttggttaatgctcatgattaatttctcttcccaccatagaatggtcttacccaacatgctacagaattctagtttctgatatgtgaaaagttaatagacataagaaaggaaacactaacaagctgaaaaaaatcacctaaaattgtggcggttgtaaatctacttcttaaaattttgcacctcttgaatttttaaaatactgcstctacactcaaatttttctctggatctgtttcttaatattaaatgcatgtgtaaaaaaatctattttaacagcgaaagtgaaaagattgttttaaaattattcagtgttgccttcttaaggttttgactcttaattatcgttcatttgaaagacaagactatgtagaaagtattctgttgttcttttgaagttaaagtgtatctcagccaaaaaagtgctgctttagtccccagtacccctcaacattttaggaggcctggccagagcctcttagttttccctcatgaatttggttcaga

SEQ ID NO: 176725 - DNA, 601 bp, Human
ggctaattaaaaaattttattttattttatttttattttttgtagagatgggggtatttctttgttgtataggctggtctcaagcagtcctcccacttcggcctcccagagtgctaagattataggcatgagccaccacgccctgtctacatggcccttatctgacaaatagtcctaagaggcatgagcagtttttaatttgctcgcaatgtttcacaatgacacactgtttctaaccaagcagatgtttgactgtggttactgggaagaatagtctttgccagcattaagcccacctacycgaaccttttctgttgaatctctcgtttggtccatctcttggaagttaatcagcacctgtggaaactttacacaaacacttctgtattactgaagatacctcatctttttgacagaataaattatcacgtgatttttagaacatgtcagatagcttttacagcagatatagtgattttcctgaattaaatctagcaccatcaattcattcttgcccttcgacttgacctgtctcttgaaccatttctcccccaatttacctgttggacgtacatctacttgggaggtcactgttaaagcc

SEQ ID NO: 176726 - DNA, 601 bp, Human
tttcagttatttttaacaacttgctctgcttcctttttttccattattttgttggttgttgttgttcttgtgacaatctagggtcttactttgttggccaggctggagtgcagtggcaccattgtggctcactgcagccttgacctcccgggcccaagccatcctcccatctcagccttctgagtagctaggaccacaggtgtgtactgctatgcccagctttttaaatttttatagagatgaggtcttcccatgttgcctggactggtcttgagctcctggctccagtgatcctcctgcstcagcctcccaaagtgttgggattagaggtatgagtcattgcacccggccagacataatttttaaaaagcaatataatgtccttgctctaataaaaaggaaaaataaaaaggaaaataatttgtaatagtatatatttcatgcaaatactcaggtagaattatactcttgcaggaaaaggttctacagatttacaaatccctcaactttcctgctgtactatgttgtatttaatacttagttaagcaacttaatagcaagactggtcttcatactaaatacttaatagcaagactggtct

SEQ ID NO: 176727 - DNA, 601 bp, Human
ggggagatctaagtggcttaacttgattcttaggatatttgtcattataaaataactgttttttcttttgcagacttccttgtgaaacctcctagtagaaaaagttcttgggacaaacttcatttggtaagtttgtttctcccctcctgccacccccgcccccctccaatactctctctgtgctgtttcgaggcaaggaaaaattaatttacaggttgatttttggggatctgtttgtcaatgtccatgattatttagatgagtttttctatgttcactttaatgtccttacatgtgattwtttttttttttcactaggactcataccaggtcactttttctatatataattgcactgtaatagtgtactggaaaacttgtatttaagttgagattttgagttgcagcactaatcatttgtctaaaataaatagatttatcaatctccagttgtatttatttatttatttatttatttatttatttatttatttattgatatattttttgagacagtcttgctgtgtttcccaggctggagtacagttaggtgattatagctcactgcagccttgaacccctgggctacagcaatcctcct

SEQ ID NO: 176728 - DNA, 601 bp, Human
tgttggtttgcttctgtaaagatttctgagaagtcatatcatggggtggtactgatgatggagctgagagaagcatgcaggttccagctgtcaaattctcatatattaaggaaagaaaggttatttcaccttcaggcttggaataggaatcttaatcttcatttagccaggggggtgggggagtgttgcagattagatctgtagtgaaggaaatgtaatcctttttattttatttacgtatttatttttgagacagagtcttgttctgtcacccaggctggagtgtggtggcgcgacctcrgctcactgcagcctccacctgctgggttcaagcaattctcctgcctcagcttcctgagtagctgggattacaggcatgctccaccactcctggctaatttttgtgtttttagtagagacggggtttcactatgttggccaggctggtctcgaactcctgatttccagtgatccatctgtctcagactcccaaagtgctgggattacagatgtgtgccactgtgctggccagaaacgtagtaacatattacttggctctgtagcatttaatatttgtattgccataataatgtaaatttgt

SEQ ID NO: 176729 - DNA, 601 bp, Human
atttatttttgagacagagtcttgttctgtcacccaggctggagtgtggtggcgcgacctcggctcactgcagcctccacctgctgggttcaagcaattctcctgcctcagcttcctgagtagctgggattacaggcatgctccaccactcctggctaatttttgtgtttttagtagagacggggtttcactatgttggccaggctggtctcgaactcctgatttccagtgatccatctgtctcagactcccaaagtgctgggattacagatgtgtgccactgtgctggccagaaacgtartaacatattacttggctctgtagcatttaatatttgtattgccataataatgtaaatttgtaaaagtgttaatttttttttttttttttttgacacaaggtctcactcttgcccatgttggaatgcagtggtgtgatcatgggtcactgcagcctcgatctcctgggctcaagtgatcctcccacctcagcctcctgagtaggtgggactatgggcatgtaccaccttgctaggctaatttgtttttatttttatttttgtggagactagggtctcattatgttgctcagggtggtcttg

SEQ ID NO: 176730 - DNA, 601 bp, Human
aagcaattctcctgcctcagcttcctgagtagctgggattacaggcatgctccaccactcctggctaatttttgtgtttttagtagagacggggtttcactatgttggccaggctggtctcgaactcctgatttccagtgatccatctgtctcagactcccaaagtgctgggattacagatgtgtgccactgtgctggccagaaacgtagtaacatattacttggctctgtagcatttaatatttgtattgccataataatgtaaatttgtaaaagtgttaatttttttttttttttttttgacacaaggtctcactcttgcccatgttggaatgcagtggtgtgatcatgggtcactgcagcctcgatctcctgggctcaagtgatcctcccacctcagcctcctgagtaggtgggactatgggcatgtaccaccttgctaggctaatttgtttttatttttatttttgtggagactagggtctcattatgttgctcagggtggtcttgaactcctgggcccaagtgatcctcctgcctcagcctctcatagtgttggtcttacaggtgtgagccactgcccctggccacgttcttatct

SEQ ID NO: 176731 - DNA, 601 bp, Human
actcatgtgccacataatgatgttttggttagcaacagacccaagatacgatggtagcctcatgagattaaaatggaactgaaaaataactatcacctagtggagttgtagttgtcataatgtcttggtacaattactttttaaaaataaacttagtgtagcctagttgtatagtgtttataaagtctgtagaagtgtacagtaatgtcctaggccttcacacattcactcactactcactgacatacccagagcaacttccagtcctacaagcaccattcatggtaagtgttgtcctatrcaagtgtaccattttaatcttttgtatcatttttactgtatcttctctgtttatgtatgtttagatatacaaatagggagcactgtgttacagttacctacagtattcagtacagtaacatgctgtgcaggtttgtagcctaggaacaacaggctataccatatagcctaggtgtgtagtagactgtcccatctaggtttgtataaatacctctgtgatgtttgcacaacagctaaatctgctaatgatgcatttctcaaaacatgtctccattgttaagcgaagcttgactgtatgtgc

SEQ ID NO: 176732 - DNA, 601 bp, Human
aggctgaggcaggaagatcgctggagcccaggaggttgaggccgccgtgaaccatgatcctgtgattacagcactgcaactccagcctgggcagcagagcaagaccctgtctccaaaacaaaacagaacttcatagctgtcaacctctcttaccgtcggtctttcccagctcctggcacccactaatctgctttctaagattttcctgttctggacatttcatataaatgatatcataacaatatgtggtcttttgtgactcgcttcatcatttagcataatgtttttaaggttcattcaygttgaagcatgtatcagtacttcattcctttctctcttttttcttttttttttttttttgagacagggtctcactctgttgcctaggcttctggtgtgccgtggcatgaagatctgggctcactgaaacctcgccactgcatcctgggctcaagtgatcctcccactttcagcctcccgagtagctgggactacaggcacatgccagcacgtccagctagtttttgtattttttatctttttttcttttattattattttatagagatggtgttttgccatgttgcccgggctggtcccg

SEQ ID NO: 176733 - DNA, 601 bp, Human
cagcacctcttactttgaactattttaactatttcttgtctcctctggactgtaagttctttaatctccctttgctgccacatctaggcctctacctaaacctgtgagttacacaccaggatatctttcacatacttaggcttttatccgtactgcctccattctaaatcaagccactagtctcttactgtaattgtctcctggttctcttctttattctttttctcttttaatccattcaccccacatcaaccagggtgatcttaaaatcaaatcacgtcactctgctatttaaaacctrtcaatggctccctgttgtatttggactgtattttaaacttactactattcacatgatcttttcctttacatttctccaacttcaagttgtgccactcttctttctgattcggtacagtttagctacaatggtttcctccttttagttcttcaaaattatcaaggtctttcctgtctgaggaacacatgcacttccgtatattagaaactggccttgccccaccaagtagtcttttctgatcactttatctaaagtaggtcttcggtacccccaaaccccagtccctgtctcagcatcccg

SEQ ID NO: 176734 - DNA, 601 bp, Human
atctccctttgctgccacatctaggcctctacctaaacctgtgagttacacaccaggatatctttcacatacttaggcttttatccgtactgcctccattctaaatcaagccactagtctcttactgtaattgtctcctggttctcttctttattctttttctcttttaatccattcaccccacatcaaccagggtgatcttaaaatcaaatcacgtcactctgctatttaaaacctgtcaatggctccctgttgtatttggactgtattttaaacttactactattcacatgatcttttsctttacatttctccaacttcaagttgtgccactcttctttctgattcggtacagtttagctacaatggtttcctccttttagttcttcaaaattatcaaggtctttcctgtctgaggaacacatgcacttccgtatattagaaactggccttgccccaccaagtagtcttttctgatcactttatctaaagtaggtcttcggtacccccaaaccccagtccctgtctcagcatcccgtttgtttcctttatcacatttagcacaatttgtaattattaccatctttttctgtcttctgcg

SEQ ID NO: 176735 - DNA, 601 bp, Human
ttactgtaattgtctcctggttctcttctttattctttttctcttttaatccattcaccccacatcaaccagggtgatcttaaaatcaaatcacgtcactctgctatttaaaacctgtcaatggctccctgttgtatttggactgtattttaaacttactactattcacatgatcttttcctttacatttctccaacttcaagttgtgccactcttctttctgattcggtacagtttagctacaatggtttcctccttttagttcttcaaaattatcaaggtctttcctgtctgaggaacmcatgcacttccgtatattagaaactggccttgccccaccaagtagtcttttctgatcactttatctaaagtaggtcttcggtacccccaaaccccagtccctgtctcagcatcccgtttgtttcctttatcacatttagcacaatttgtaattattaccatctttttctgtcttctgcgatggtatataagttgtattaatgcagagctaacagtgtcatactgtctaacacatactagattattggtaaattttgactgactgcagtgcagaaagaacatcattttacagaatctattt

SEQ ID NO: 176736 - DNA, 601 bp, Human
tatgtcggtcttttgtcttgctatttaaagaataggggttattttcctgtagttttccatagactagattattatttgcatcttgtatttcattagcagttgtaaaatagtattatcaaattcttttctttgtatattaggtagaattcttccctcatcaactacttcattctatactagttcattttgtgtaagaaaggcgggatagatacttgattctttccccttacttgctagttttcaaaaataaaaggttagttccttaacatcttccactggtgacctgtaggggtgtgcgtgygtgtgtgtgtgtgtgtgtgtgtgtgtgtgtgtctgtctctgtgtgtgtgtgagagagagaatgtttctttatgaactcatatttaaacatcctgaaacccaatccattgcatttaaccattttgctcaaattatttcatttttagctagtgagtctcttcaaattgactcccaattatttctgacttaccctcagtagtcttttatatgtttcttacattccagtttaatatgatgtttcagaatcaaattgtacattttcttttctagacctggaattggttatattttctttcaggtg

SEQ ID NO: 176737 - DNA, 601 bp, Human
gtgtgtgtgtgtattttttgtttgtttatccattcacattttgtttgtccattcattgattgatgcatatttgggttgtttgcacttttggccatcatgaataatgctgttacgaaaatttgtgtagaagtttttatgtggacataccttgtcagttctcttaggtatatacccaggagtggaactgatgggacatatgatgactctaaacttttttgggaactgccacacttttcctcagaggttgtaccactttacattcctgccggcagtgtatgggggtttcaccttcacattccayctacatctgacattagtatcttcctcactggagttatattttgttatttaatagttttgcaaaatgcattaaattcacttccatttaaattgtttaagatacagcagtttgaatgtgtcaatgatgctatctttagaaattttattctaaaacacaaatatcttttgtgtaatattaggacagttttttaaaagtaattcagtatgtttcttttttgaaaaggttctttataacagtatcccgttcttttaataagttcataccctcaaattttctctgcctttgcccttctccttttta

SEQ ID NO: 176738 - DNA, 601 bp, Human
attttgtttgtccattcattgattgatgcatatttgggttgtttgcacttttggccatcatgaataatgctgttacgaaaatttgtgtagaagtttttatgtggacataccttgtcagttctcttaggtatatacccaggagtggaactgatgggacatatgatgactctaaacttttttgggaactgccacacttttcctcagaggttgtaccactttacattcctgccggcagtgtatgggggtttcaccttcacattccatctacatctgacattagtatcttcctcactggagttayattttgttatttaatagttttgcaaaatgcattaaattcacttccatttaaattgtttaagatacagcagtttgaatgtgtcaatgatgctatctttagaaattttattctaaaacacaaatatcttttgtgtaatattaggacagttttttaaaagtaattcagtatgtttcttttttgaaaaggttctttataacagtatcccgttcttttaataagttcataccctcaaattttctctgcctttgcccttctcctttttaattccaataagtgcctttttgcacatctttaccttcc

SEQ ID NO: 176739 - DNA, 601 bp, Human
gaaaagaatgaataaatgagataattttacattagtttcagttcttgagctaggccaaatcacaaaagtttggcttggtttgaagagtggttaagaatgatgactccaacttggtctgttactgaaccataaggttcttcctcatccttccagcctctaaaaaatggtgcacccaaaacccctgtccttagtcatcttagcctctccatttatacttgctcctgcatttggctttaatgccattcacacactgatgtctcccacatttatgtttatatctctaggctccatcttcttgatmtctagtctggtttaactagcactttacttggcatctttgtttggatatgtgataggttttcaaacataatgtgtctaaaatggaaactttaatttcttgttccttgtccgttgagctgtctctgcatggcacgagaagaatagatttttcttacaatgctcttcatcaataaatagaaaatccttgcttccggttgctgacacaaaaagcttgacttctctttttctatcctatttaattaatccactcaaatcctatgggcagtattttcaaagtatatccagaatcagtaacatccca

SEQ ID NO: 176740 - DNA, 601 bp, Human
tgagtctcacactgtcacctgggctggatgtgcaatggcgtgatctcggctcactgcaacctctgcctcccaggttcacgttattctcctgtcttagcctcccgagtagctgggactacaggcacacacccccatgccctgctaattttttgtatttttagtagagatggggtttcactatgttggccaggctggtctcgaactcctgacctcgtgatctgcctgccttggcctcccagaatgctgggattacaggcgtgagccaccacacccggccaaaatgattctttagagtaagtcrtctcctaccattcctctgctcaaaatgcctcaacacaatctgggccttgctactgcttttatgttctcttgttcccttgcttacattgcccttaaaagagttttatgctgcacattgaagcccagactccctgaaatatcctgtgttacagaagcttagcaaactagaaatgttggttttgcatgagactgttcaaagaaaagagcaacttacttactctttgtataagcctatttttgggtttctagttggatattctttcccccttttttgttcttataaaaccaggtaaaggtatta

SEQ ID NO: 176741 - DNA, 601 bp, Human
ctcgtaagtcagtttggtttcctcagatgggggatccattttgaatttagagataaccacaaaaacatcctaaaatactacaagaataatgattttgcatttgcaggttgatgttatttatttttttgagacagagtcttgctctgttgcccagactagagtgcagtggtgtaatcacagcatactacagccccaaccttccaggctcagttgatcctcccacctcatcctcctgagtaactgggactacaggcatgtgctgccatgaccagcttttttttttttttttttttttttttttgagacagagtttcactctgttgcccaggctggtctcaaacttctgagctcaggctatctgcctcagccttcgaaagtgctgggattataggcattaagccaccttgcctggcctgtaggttgattttaattgttgctttattcatccaagttttatgatattttttgttttactacgaacattaggaatgttagcctttgatactgtttttgcagaaacaggttaagactaacaggagttttacaaaggaactgtcaaattgggatttgactagtgggaattggctgggtgataatcaac

SEQ ID NO: 176742 - DNA, 601 bp, Human
ttgattttaattgttgctttattcatccaagttttatgatattttttgttttactacgaacattaggaatgttagcctttgatactgtttttgcagaaacaggttaagactaacaggagttttacaaaggaactgtcaaattgggatttgactagtgggaattggctgggtgataatcaactttttcttggctgactctgatcagcttcttaggcctgtgtatatacaatacctttgtgaggatatggccgattaggggaaaaactattgccaattttgcctcccctcctcttttttttttcttcttccccctcttcccccccacccccagacttcaccataagggaaagaagagagccttgttggacactgaagaagggacggggatttctcctcctaatctgggcctcttgtcatggtaagtacaaggaaataagagtaaaaaaaaaaacaaaaaaccctgtgtcctgacaattaagtgaacactaataaattcatacttacccatttttgtttttgtaagaaattatttctttttctttcccagatctcttgtgtcttttcttttcttgtttacttagtagtaatagagtactccaat

SEQ ID NO: 176743 - DNA, 601 bp, Human; identical to SEQ ID NO: 39927

SEQ ID NO: 176744 - DNA, 601 bp, Human; identical to SEQ ID NO: 39928

SEQ ID NO: 176745 - DNA, 601 bp, Human; identical to SEQ ID NO: 39929

SEQ ID NO: 176746 - DNA, 601 bp, Human; identical to SEQ ID NO: 39930

SEQ ID NO: 176747 - DNA, 601 bp, Human; identical to SEQ ID NO: 39931

SEQ ID NO: 176748 - DNA, 601 bp, Human; identical to SEQ ID NO: 39932

SEQ ID NO: 176749 - DNA, 601 bp, Human; identical to SEQ ID NO: 39933

SEQ ID NO: 176750 - DNA, 601 bp, Human; identical to SEQ ID NO: 39934

SEQ ID NO: 176751 - DNA, 601 bp, Human; identical to SEQ ID NO: 39935

SEQ ID NO: 176752 - DNA, 601 bp, Human; identical to SEQ ID NO: 39936

SEQ ID NO: 176753 - DNA, 601 bp, Human; identical to SEQ ID NO: 39937

SEQ ID NO: 176754 - DNA, 601 bp, Human; identical to SEQ ID NO: 39938

SEQ ID NO: 176755 - DNA, 601 bp, Human; identical to SEQ ID NO: 39939

SEQ ID NO: 176756 - DNA, 601 bp, Human; identical to SEQ ID NO: 39940

SEQ ID NO: 176757 - DNA, 601 bp, Human; identical to SEQ ID NO: 39941

SEQ ID NO: 176758 - DNA, 601 bp, Human; identical to SEQ ID NO: 39942

SEQ ID NO: 176759 - DNA, 601 bp, Human; identical to SEQ ID NO: 39943

SEQ ID NO: 176760 - DNA, 601 bp, Human; identical to SEQ ID NO: 39944

SEQ ID NO: 176761 - DNA, 601 bp, Human; identical to SEQ ID NO: 39945

SEQ ID NO: 176762 - DNA, 601 bp, Human; identical to SEQ ID NO: 39946

SEQ ID NO: 176763 - DNA, 601 bp, Human; identical to SEQ ID NO: 39947

SEQ ID NO: 176764 - DNA, 601 bp, Human; identical to SEQ ID NO: 39948

SEQ ID NO: 176765 - DNA, 601 bp, Human; identical to SEQ ID NO: 39949

SEQ ID NO: 176766 - DNA, 601 bp, Human; identical to SEQ ID NO: 39950

SEQ ID NO: 176767 - DNA, 601 bp, Human; identical to SEQ ID NO: 39951

SEQ ID NO: 176768 - DNA, 601 bp, Human; identical to SEQ ID NO: 39952

SEQ ID NO: 176769 - DNA, 601 bp, Human; identical to SEQ ID NO: 39953

SEQ ID NO: 176770 - DNA, 601 bp, Human; identical to SEQ ID NO: 39954

SEQ ID NO: 176771 - DNA, 601 bp, Human; identical to SEQ ID NO: 39955

SEQ ID NO: 176772 - DNA, 601 bp, Human; identical to SEQ ID NO: 39956

SEQ ID NO: 176773 - DNA, 601 bp, Human; identical to SEQ ID NO: 39957

SEQ ID NO: 176774 - DNA, 601 bp, Human; identical to SEQ ID NO: 39958

SEQ ID NO: 176775 - DNA, 601 bp, Human; identical to SEQ ID NO: 39959

SEQ ID NO: 176776 - DNA, 601 bp, Human; identical to SEQ ID NO: 39960

SEQ ID NO: 176777 - DNA, 601 bp, Human; identical to SEQ ID NO: 39961

SEQ ID NO: 176778 - DNA, 601 bp, Human; identical to SEQ ID NO: 39962

SEQ ID NO: 176779 - DNA, 601 bp, Human; identical to SEQ ID NO: 39963

SEQ ID NO: 176780 - DNA, 601 bp, Human; identical to SEQ ID NO: 39964

SEQ ID NO: 176781 - DNA, 601 bp, Human; identical to SEQ ID NO: 39965

SEQ ID NO: 176782 - DNA, 601 bp, Human; identical to SEQ ID NO: 39966

SEQ ID NO: 176783 - DNA, 601 bp, Human; identical to SEQ ID NO: 39967

SEQ ID NO: 176784 - DNA, 601 bp, Human; identical to SEQ ID NO: 39968

SEQ ID NO: 176785 - DNA, 601 bp, Human; identical to SEQ ID NO: 39969

SEQ ID NO: 176786 - DNA, 601 bp, Human; identical to SEQ ID NO: 39970

SEQ ID NO: 176787 - DNA, 601 bp, Human; identical to SEQ ID NO: 39971

SEQ ID NO: 176788 - DNA, 601 bp, Human; identical to SEQ ID NO: 39972

SEQ ID NO: 176789 - DNA, 601 bp, Human; identical to SEQ ID NO: 39973

SEQ ID NO: 176790 - DNA, 601 bp, Human; identical to SEQ ID NO: 39974

SEQ ID NO: 176791 - DNA, 601 bp, Human; identical to SEQ ID NO: 39975

SEQ ID NO: 176792 - DNA, 601 bp, Human; identical to SEQ ID NO: 39976

SEQ ID NO: 176793 - DNA, 601 bp, Human; identical to SEQ ID NO: 39977

SEQ ID NO: 176794 - DNA, 601 bp, Human
ccgcagattgaaacctcggttgctcttcctggaataagagagaaaaaaaaaaatagaaaatatagaagttatttttacacttaacattcaataataagaaagaaaatgccggcggcagaggaagcggagggtggggagtcagcccgacaccccttcctccctccccaccccttgcccccacccttccaccctcggcgggatccggtagcagggtagaggggtcccgagcgccgcccctccttccgggatccgacctgggccagaggggtcccgagcactgtctcctccctgcagacccagytcgggcatctaggcacccccaacccctctccgcccttccccggcccccaggatccgcgggtcacgggaggagaggatcgcagtccgaaggggcaggtcctgaacgccgtccccttcccctggatccggacaatgggatcccgggcgccccccatccttgtcccccggatcctgagccggggaaggtgggagcgggaggccgcagcaccctcccgcaagggaggaggtgggggtcccagaagccgcgtgtcttcccccaacctccagtcccaggaggccgctccggccaggagccggaggg

SEQ ID NO: 176795 - DNA, 601 bp, Human
ctgacccttcactcctactaacaaaccactggagttcagtagtgctgactttttagaagaggcactgctctccagtacccaagccctcacctcttccttctttattctttatggccctcatgggcatttgaactttttacccccattctatacatttcttactgctcccaactatcaaatattagacactctgatatacttatttctcttcccctcgctgattctgatttattctgtgtgtattcttttttccctcaaatctattcatgaaacatccatattactgtctcagactccaaakacatggaattagtgcttatctaaatccacagaaccatctactgagaacattaatatcaaaaccctaagaaattattgataacactatatggtctcatccatcacctttcagcaaagctgtctctgcaatgccacttttcttcagctattttttaattttctttataccttttcttcaaatacagagaatcagaccataataactttatgtgacactttgatgatgtaacgtttggctcctctacatttccaatttttgcattagaataccatgttgtgctagattctacgggtctatagc

SEQ ID NO: 176796 - DNA, 601 bp, Human
tacacagacccaaaaatctcatccgaaaagatctatttcttacttctgatagataagaacaagataggataaagctcaatttctaagcaacttaaaatattcattttaatcaacccaaaaattataacataaaataataggcaggtaggatgggataaactcaccaagctccctaagagaaagacatggatttcaattttccaatacctgtcctgcttgtagctgattgcctggtatacatttccaacattatctaatgtatgtatttgttttcaaacttttttcttttggtgcctaaaakaactggcaaatgctataatccaaacagggcctcatactatagccatttcagagaaggatgccttggtcaggaaattttaattaaaaaccaagctgaattctttgaccaactatttcaccgttactggcatcttggaaaaattcttttagacacaagaacaacttttaccctaacacaggcacatttaggaactaactctggcatttgttatcactgtaagcatcactgtcaacactctaagcagagaaaaagtacatgcattgtgcagcacttttgccatgcaactgactgcaggtaaaa

SEQ ID NO: 176797 - DNA, 601 bp, Human
agactcccagtgtaaggcatctaatatcctcccccaaatgcaaaactggttttaaaaaacaagcccaaacaattgtcttgaacaaataaaactctactcagatgagcctgtactgagaatgatgttcagtaatgaaaacaaatggtacggaaaacccccttgtggaattaattaggccctattctaggagaccacagaggtattcttggactgtacagcaggctcccaaacatctcccctacacatcctatggttacagtggctggatgctgcccactcttctagtacgctggatttgtaygtctggatgtctgccagaaaacccttcctccagggcatccctaacagaaatactaaggggctatgcagtggtccacagatgctcaacagaaactcccgcaccaaatcacttccagctttgacatctctgccaaagtttttattcagcctctcagttatatttctacccaactttccacactggtagacagaataaaaatcttcacctacaatttgtccatctttgacactaccaagcacgtgtatcttaagtgttgttagatgttgaagacaaacattattttgttagccaagaagttgc

SEQ ID NO: 176798 - DNA, 601 bp, Human
taaatctctcagagacaatggcaaggatgtatttttctcttccccaagcttgatttgaaagaacaagttaaaaacatgcagaactaacaagcctaattccaggcaactgtgaattaaatgttatcactaatgttttgaaagagcacatgaaaaacagaaaaacctttacacaaggctgagaattctctgtgggaaacatttccaaaccacagatccacccagaccgataacactgcccgcgcctcatccccacccccattggaggactagtttgcaggctttatcactgccttgttaactktctttgcttgctggcaaccctttttgagagggccaagatttcagagttgaagaagaaaaactgggtgaagactcccagtgtaaggcatctaatatcctcccccaaatgcaaaactggttttaaaaaacaagcccaaacaattgtcttgaacaaataaaactctactcagatgagcctgtactgagaatgatgttcagtaatgaaaacaaatggtacggaaaacccccttgtggaattaattaggccctattctaggagaccacagaggtattcttggactgtacagcaggctcccaaaca

SEQ ID NO: 176799 - DNA, 601 bp, Human
atgcctggagcacttctaaagttgtcctaatcttgttaagtctggattcactgtaaaatgaatgtttactgaactatagtgacatgaaatatgaagctgagaggacagtcaagtttggaacaccacataacctgagggtagaggtaggtactctgtatcatacaactttagcgcaaaattatagatgccttctaacagtagcatgaaatagtgcgacagaattgaacctatttaagtatctagtccttttgaacttactgttgttccctctgatcatctacataaagataagttgggctgsgactatacctaaggagcttaaaggccaagagacaatatttggcatgtgtctgcggctcctgtttgctatatactacctaaggtggtttatttacatgcaaattaattgcccatctttggtctccagagcagcccaagatactcctgtctactaaatcaccctgattcttggccctcctcccagctaagagctgtgcaccagaattacccacaatccctcttgttgatacaaataaaattctaattgtctgttttctttctgggagagccctgcaaatctcaaacagctagaatgaagttg

SEQ ID NO: 176800 - DNA, 601 bp, Human
aatacctcacctacagctctgttgaactggacatgtggttcccatgacaaccatggttctccatagcatatctctctttttggggcagatgcctggagcacttctaaagttgtcctaatcttgttaagtctggattcactgtaaaatgaatgtttactgaactatagtgacatgaaatatgaagctgagaggacagtcaagtttggaacaccacataacctgagggtagaggtaggtactctgtatcatacaactttagcgcaaaattatagatgccttctaacagtagcatgaaatagtscgacagaattgaacctatttaagtatctagtccttttgaacttactgttgttccctctgatcatctacataaagataagttgggctgcgactatacctaaggagcttaaaggccaagagacaatatttggcatgtgtctgcggctcctgtttgctatatactacctaaggtggtttatttacatgcaaattaattgcccatctttggtctccagagcagcccaagatactcctgtctactaaatcaccctgattcttggccctcctcccagctaagagctgtgcaccagaattacccaca

SEQ ID NO: 176801 - DNA, 601 bp, Human
tacttagtgttgtacccaggaaggttgttattccaggtaagtaccttggtttaaggtcattaaatcaagtccacactaagtaggcttaacccatggcaaattctggttttgcaataccaggtatgtacatggcctgttttgttctttataaaggtcagaacttctccatgtttacgccacatggaaagccacaccttagataaagtatagaggccataacttaccagagtgacaatataaaaaatgaaagcataagggttccaaatttgatcttggataaccaaacaaatccaggaccccyaccacagaactaaatcaaagtgcacccaaaagcaaagattgttcttaacagaatagttccttctttataaaacactggatcactaaagcaaaaacacaggtcctcttcccagcttgccagttattccaatgaattgctacagacaactacactctctgtcaaggatggaactagccatgcagatgttttctccaaattccagggagtgaccctaacccataggcttttactcaaagcttctaattttgtttttcaaatgtagaaacagctggtgcctagccctccagggaaaacactagg

SEQ ID NO: 176802 - DNA, 601 bp, Human
ctccctgccttcatggtacttattgtagtgtagtgccagcagacagtcatttaataatcacacaaatatatataaaacctcatatattaagtataatatataaatgtgtgtacataaaagtataaatgctatgagagcctttatccttaagaatcatgttccctgccataagggaactattatatttggtttcaacatctacctgttaagaaaaccagattttaatggaaatgaaactgagattaactcaatgtaaagctcttatctgatgctcagcatgttatctcattattgttaattrttagatgtaatcctctttcccaacaacagagcaagaccctcaagggtagacaccatctattatgtcttttaacctctacagcactcacaaggtcttacttatatagttgagcacataatattgactgttgctgttttctttaatggctgagcaagcctgctgtttcctctggctctctctctccaccacaatttactaactgagaacctactatgtgccagaatctgtgataggaactgacagaggcagtgccctcaaattctcacctcaaaatcaagaaattctgtttttctttatttt

SEQ ID NO: 176803 - DNA, 601 bp, Human
ctatgtgcaggcactgagggaagaaatataaccaaaaggagacattctccctgccttcatggtacttattgtagtgtagtgccagcagacagtcatttaataatcacacaaatatatataaaacctcatatattaagtataatatataaatgtgtgtacataaaagtataaatgctatgagagcctttatccttaagaatcatgttccctgccataagggaactattatatttggtttcaacatctacctgttaagaaaaccagattttaatggaaatgaaactgagattaactcaatgtraagctcttatctgatgctcagcatgttatctcattattgttaattgttagatgtaatcctctttcccaacaacagagcaagaccctcaagggtagacaccatctattatgtcttttaacctctacagcactcacaaggtcttacttatatagttgagcacataatattgactgttgctgttttctttaatggctgagcaagcctgctgtttcctctggctctctctctccaccacaatttactaactgagaacctactatgtgccagaatctgtgataggaactgacagaggcagtgccc

SEQ ID NO: 176804 - DNA, 601 bp, Human
ccctactatgtgcaggcactgagggaagaaatataaccaaaaggagacattctccctgccttcatggtacttattgtagtgtagtgccagcagacagtcatttaataatcacacaaatatatataaaacctcatatattaagtataatatataaatgtgtgtacataaaagtataaatgctatgagagcctttatccttaagaatcatgttccctgccataagggaactattatatttggtttcaacatctacctgttaagaaaaccagattttaatggaaatgaaactgagattaactcmatgtaaagctcttatctgatgctcagcatgttatctcattattgttaattgttagatgtaatcctctttcccaacaacagagcaagaccctcaagggtagacaccatctattatgtcttttaacctctacagcactcacaaggtcttacttatatagttgagcacataatattgactgttgctgttttctttaatggctgagcaagcctgctgtttcctctggctctctctctccaccacaatttactaactgagaacctactatgtgccagaatctgtgataggaactgacagaggcag

SEQ ID NO: 176805 - DNA, 601 bp, Human
gttggagtctgactagctaatataaccttaatgagtaatgaggagaagtggatagggctatagtttacatttcatttaaacgacaatccctctagcagctcagatatgctatagacataggttaccgaatgaactgtcagccttaaacgcatcaacaggaatgagccatctcccaaaataatgtggccaggttgatgggggattcctcccctcagttaataaatattcactatgctccctactatgtgcaggcactgagggaagaaatataaccaaaaggagacattctccctgccttcayggtacttattgtagtgtagtgccagcagacagtcatttaataatcacacaaatatatataaaacctcatatattaagtataatatataaatgtgtgtacataaaagtataaatgctatgagagcctttatccttaagaatcatgttccctgccataagggaactattatatttggtttcaacatctacctgttaagaaaaccagattttaatggaaatgaaactgagattaactcaatgtaaagctcttatctgatgctcagcatgttatctcattattgttaattgttagatgtaatcc

SEQ ID NO: 176806 - DNA, 601 bp, Human
gtaatcaatctctatccttccgaatctcaagatgtgaaaaatgttaggtgaagagctctctagtactcttgggggagtgagacctctctcattctgtatgacagtctcccagaaggaataattagatttctgccctacaggagcataccatttaattaggtgataagttaatcacagaaattagggagactgaggagaggtcccacaaaaggccacagaggttcaagggagagttctaagggaggggcagtatttgatattggcctctaaggcaaggagctggagactgagggaaggggggaactcaggaaatagaggacaggctgcaggtaggccttgtgagcagggctcatcaatatggaacccccaagtcacctgggcagtgtggctggggttggaccttgagaaaagcaaagcactcagataagctgagaatgaaattcctgggcaaacagaagaggggttgatatggtttggctgtgtccctacccaaatctcatcttgaatttaactcccacaattcccatgtgtcgggggaggaacctagtgagcagtaattgaatcatgggggttggtctttcccatgttgttcttgtgatag

SEQ ID NO: 176807 - DNA, 601 bp, Human
tattaggctaaataaattatattattcaaattttcacctgtttaactttttaattggttctactcgaaaatttaattgtatttaagttatatttaaaatgcaattgtgactcatgctaaatttctgttgggcagcatttgtcatagccaaagggaaggctgtagttgtgttagaggaaggagggattcatgttttttcttcttcccatttttctaaagtttttgcaattttgttggagaaaacaaaaatgctaaaggcaaggcctagtaatcaatctctatccttccgaatctcaagatgygaaaaatgttaggtgaagagctctctagtactcttgggggagtgagacctctctcattctgtatgacagtctcccagaaggaataattagatttctgccctacaggagcataccatttaattaggtgataagttaatcacagaaattagggagactgaggagaggtcccacaaaaggccacagaggttcaagggagagttctaagggaggggcagtatttgatattggcctctaaggcaaggagctggagactgagggaaggggggaactcaggaaatagaggacaggctgcaggtaggc

SEQ ID NO: 176808 - DNA, 601 bp, Human
catttattttctgaaacctgtgtaagcttttacacatatgaaggtaaagggagggcccagggctaaactggtgtacatttccatgtgaataagccatcttttgaaaaccaaaacgaaagaatatgcacaataaatttggatccacattaaactagttcattcaaaaatggaaccccatcaatgccagcaaaggaggctggaaggttgtaaggccagagtcagcacagacccatggctccttgaaggcttcctgctgccagggcctccccagccacaggaccattttgctgattaccagggwaaggcagagctatcagccctcaagcagcttaattaaagccaggagtaagacatttgtgtaaggggtcaaaacaatcattttttaaatcttgcattcttttttcttgtgcacttggtagcttgaaatgaaggtgtggcatttctgcatcaaactttgacgatgaaggacaggagtacacaatttccaaaagaggaaatagagctagtaaataaacatgtggaaaagcaattaatttcacaagtaataaatagaatacaaaattactaacttttgtttactgaattagttaccctcttccaa

SEQ ID NO: 176809 - DNA, 601 bp, Human
atgttttccctattttataaatgaggaaaccgagacacagagctgtaatttacccaatgttatgtaaactaataggaagttgagtcaggatttgaatccaagcctccaggacactcatactttgggaacacaggggaagctatggaactaatttaaaaagatcaatagaattgcagggacactgttgtcatggaggggaaagttggaggaggaaaaggactacgaaagtcacctgatttgcctacaaggacgtcaaatggaagaccctagtgaaggtggttttcttggaggagtgacagcygaagcccaatggtaaattgtctctgcaccggtaacaggcataagaattgagttgcaagtgaggcaatgatgaagactagtcttcagaatttggttgaaaagtaagaagtaggccaggtgcagtggctcatgcctgtaatcccagcaccctgggaggctgaggtgggaggatcactagggctcaggtgttggggaccagcctagaaaacacagcaagacacttgggctctataaaaaaatcaaaagattagctgggcatggtggtacacgaatgtggtcccagctacttgggaggcaaagg

SEQ ID NO: 176810 - DNA, 601 bp, Human
ggggcagggccttccttgtctttatgagtttataatatgtgaccagcaaacacgaaaccagcaagaaaccctgggatttatggcatggactatggaataaccctggactttcagtttctgttttctgaaaattgctctaagtcagctgagtcaactgcctatcttcatgtgagtgtgactgatcagatagaacttggtaagtcaacatgtccacagagcaagtgctgccttgggtactcagtaaaagcctgaaaatttttttcctgatagtttttataattagcagaatcataattttgaktctgtctttgtgaacagaaatggctctttaaatggcttggatggagccctgagacagggtggatggtggctgaagggactgaagaggtagccaggcctcccatgtagccatgtaagcaaacgcaaagggctcagcaggcctctctctcacctctgggagccacacaaagggatactgggcagccttgcgagatcttgctccaaagccatggctgcacatagcaacacaagtgacaatgatgatgggggtggtaacaatggcagcactaacacttactgagtacttactaagtgtcaggca

SEQ ID NO: 176811 - DNA, 601 bp, Human
catgtacaccgtggctagcaaaaccagatctactcatattaaatcctaacaatctcaatttataggcctcagtttgggctgagtttcagaaaggtttgtaaggcccgtgcttattcataagtcctcacaagtactagaatttccaggctttcctctttagcacccttaaggtaatttcctcaaggaaattgttcataatcaaccatttttatcaggtgcaaattacgtacaagatactaggcagatactgtggggaaacaaaatgtattagtcatggcttctttgccccaaagcttacttmctatctagttgaggagataaatatgtctatacatggaaatatcacagggcagtgctgacaagcgtaacctgactagcagagactagagacaccacgggaaagatggcttctggctggggtgattacctactgtgtgctacgcattggccttggtgctgcatgtgtgcatgcaacacgctcctatctgaaatggtgagccctgtgttagaccaaggtggcgtttggaatagcacagtcaagatgggatggggaaaaagtgagatgcgtttctttagttgagtcagtcagcttatgcagaag

SEQ ID NO: 176812 - DNA, 601 bp, Human
cacaggggacaaaataaaaacccaatccaggcagtgagggaacctggcctgcagcaactgcttgggtggctggaaacgagagggtaaggtgggaaaaggctgaagaaatacaataatggctactgtaggctttatttatttatttatttttttatttttttgagacagagtttcgctcttgttgcccaagctggagtgcaacagcgtgatcttggctgacagcaacctccgcctcctgggttcaagtgattctcctgcctcagcctcctgagtagctaggattataggtgtgcgccaccaygcccatctaatttttttgtatttttagtagaaatgcggtttcaccatgttagccaggctggtctcaaactcctggcctcaggtgatctgcccaccttggcctcccaaaatgctgggattataggtcacaggtgtgagccactgcgcccagcctgttgttgttgttgttgttgttttttttttttttttggagacgtagtctcgctctgttgcccaggctggagtagagtggtgtgatctcagctcactgcaacctccacctcccaggttcaagtgattcttctgcctcagcctccagagt

SEQ ID NO: 176813 - DNA, 601 bp, Human
tggttgtaggaaaaggcgggtgtgagcattgagaacagcatgggcctagcccataggctgccctgattggactaccattgacaatggggagggctcactgtccctgaacacctggagtctctggtacttacacagcacattccactccaaggacctcaaagctcttttcagacacctgatgccaggtgtgatccctactgcaggcagagcacctgagccccaagaaggggagaggtcaggccagaaaagatacaagtctccagatgtccaacttcctagcttccactgtctcctcactggygcctcaggtccttcctcaggacggctctaacactcagttactcaggccccaagaagcaggaccaagcctgctactgagcacatactccatgactggctctgactctgcaggcccaggtgccaaagcctgacctggctggagcacagcagggccagctgccccacgagctcgggtgctcaccttgctgctccagaagagcattctgccgcttgaggtcgtcaatatcttgctggtgtgtgtggtttttccttcgcatatactggatatattctgtggctttgtctaggatttgggcccggg

SEQ ID NO: 176814 - DNA, 601 bp, Human
cttttacttgcatcttccatgagggaggaagagaagtgaattccccaggaacaaagaacttgatcagctctcgctttcccctgtggttgtaggaaaaggcgggtgtgagcattgagaacagcatgggcctagcccataggctgccctgattggactaccattgacaatggggagggctcactgtccctgaacacctggagtctctggtacttacacagcacattccactccaaggacctcaaagctcttttcagacacctgatgccaggtgtgatccctactgcaggcagagcacctgagmcccaagaaggggagaggtcaggccagaaaagatacaagtctccagatgtccaacttcctagcttccactgtctcctcactggcgcctcaggtccttcctcaggacggctctaacactcagttactcaggccccaagaagcaggaccaagcctgctactgagcacatactccatgactggctctgactctgcaggcccaggtgccaaagcctgacctggctggagcacagcagggccagctgccccacgagctcgggtgctcaccttgctgctccagaagagcattctgccgcttgaggtc

SEQ ID NO: 176815 - DNA, 601 bp, Human
actatactgaattcatctctgtggttcccctctcccctttcatggttggccaggggtttagctttaaacatagtaggagtacaacaagcaactgttaaaatagaatttaccttggtttcttaaaaaagataaaagaatctctgcacaaaggccagtccccactcttaccttgctttggcaaatcttacggaatatggtacccctctccctccacctggatcgccagggtcattgcagctagatccagccagcacagagatataagaaggtaaaaccagactgacgacaaagccaatggttycaagtttggttggcttaaattaacatacacaaaagcaatgggtcaccgttatggtccgtccccaagggaaaccaagggagaattttgtggggtcaaggagggtgagaaggagataaagaaagaagaaagagagtttcctgtaaagagcaaggacaccaggggtaatgactgagacccaagtggattccttgtcatgacaagggagatgagacaccgcagcattcctttcccggcatgagaagcccagacactcccaagatgtgaggtcattatggtcccagaggggtccagggccctgct

SEQ ID NO: 176816 - DNA, 601 bp, Human
atagtcttatggagagagagagacctgcatggcatggggcttcatctcatgggcatcaggtctgggggaaggggaaagagcccagagctccaagcacaaacattagcctggtttccttggtccctggcttttccttccaactcagaacttccaaggcaaaggagggtgggggttaagaaggaagaaacaggtcctggaacaggccaaggtacaacaggcaaggaaaaagaccaagctcatgatcttgaatgtctgaagttgggaaaagagaaaggacagaaaacaccgatgggaaattttyttagtactaacattatctaacattcacctagcattttattataaataaaaacttccgtaaactttatcttatttgctcttcacaacaaccttgagaaaatactatcatccccattttataaaaatggaaaaggagtcagtgatcctccactgcggtggcattagaggcagaatcaggacttgaatctggatcttgtgacatgttcctcctcaccccaggaccttcagtttcagaagaagacgccaggccagtctccccaaccttgccacatatacctatgaagtagatcactgctatctt

SEQ ID NO: 176817 - DNA, 601 bp, Human
cacgcagcgggcggcacatgggatgccggatgccaagctgtgtgcatgggtaaggcaggggagtggaaggagggaggggagggaagagagaaaggggaatgaggctcatgcacagggcttctctttttggggcatctttctgtggggttcctccactccctgctctcccttctgggccacatctaccctgaggcagcatcctcactggagtcactggagtctgtacccaggtgcagggaaggggaggagtgtgcaggcaggcagatgcctcctctggggtgaggagagggagacagaggaygggcattctgactggtaagttccctgcagcctgcagtgtttcattcttcatccagacggccacaaatgctcatctggcagctcccagtatgaaaaggggaaggagaagaaatggggctgtgtgacaattagggggactctaggagatggggggagcctttctattgaaacatgaaggctggaaccttttggaaggataggaacttgggcttttcagctgctgctcttcctgtaatccctgaaaacaggtccagaaagtaggaaggtgccagaggcagtcatcaaaagagagaagcatggt

SEQ ID NO: 176818 - DNA, 601 bp, Human
agtctgaaggccaaagggtttggaggcaaaatgctcccagagactcggctgctactagcctccttgtcactctgtctcagtgacatgttataaagggaaaatggaaaattgctacagatgctctgcaaacaccacccttggcacctcctcagccaagaagcatgtgggggacacatggggcagggagaatgggtgctggcttttcctgagagccataaacacagacaaggcctggggtcagagcttgcccttgggaacaaatcccacagaaatgtcccaaagatggaggaggctattaacrtggttcactcagactgcactgcccggggagagaacagagtcttattattaacctcagtgtattaatatttgataaagcatcttcacaatgatagatagcagtcacccatagaagggaagcagccttggttctgtaaagagttctgagagaggaagaatagcttttatcaagagtggtaaggggacaatggaaggcattatgtcctgggcaggggaaacctgccccgggccacacagtgcaggggcatgctgacatctcttgcaggtttatctgcacaggtagctggcaggtttatctaca

SEQ ID NO: 176819 - DNA, 601 bp, Human
ctgaactgagagctgcagtttatgttacaaactttatagttcccagcaaatcttcatagcaaatttgtcataatttgctatgcacgtgtgtctatgcacatagacacgtgtgggattatttgatctacctctgtctcactagactgtaagattctctggttgatctactttcccaagtctgaaggccaaagggtttggaggcaaaatgctcccagagactcggctgctactagcctccttgtcactctgtctcagtgacatgttataaagggaaaatggaaaattgctacagatgctctgmaaacaccacccttggcacctcctcagccaagaagcatgtgggggacacatggggcagggagaatgggtgctggcttttcctgagagccataaacacagacaaggcctggggtcagagcttgcccttgggaacaaatcccacagaaatgtcccaaagatggaggaggctattaacgtggttcactcagactgcactgcccggggagagaacagagtcttattattaacctcagtgtattaatatttgataaagcatcttcacaatgatagatagcagtcacccatagaagggaagcagcct

SEQ ID NO: 176820 - DNA, 601 bp, Human
agtaattatcttattgcttatttatttatttatttttgaggcagagtctcccactgtcgctcaggctggagtgcagttgtgtgatctcagctcactgtaacctttgcctcctgggttcaagcaaatcttgtgcctcagcctcccgagtagctgggatcacaggcatgtgccaccacacccagctaattttttgtatttttagtagagaaagggtttcgccatgttggccaggctggtctcgagctcctggcctccccgctcagcctcccaaagtgctgggattacaggcatgagccactgygtccagctcctattgcatttttagataaaataggatctttatatattattgcaaaagaaaacaagttattgtagaccagtttaaatcaaaaagtttttttttatttttgaagaaggctagttttcatctggagtttgaagatgataatggttttagaatggcagggaagaaaaaggaggtcatattcacagcccctcaggtggcaactggcaaggtgtgtatgtgtgtgtgtgcatgtaagcaggttttgggagtgggggtgagaagcagtgaatttatccagagcaaggcagctgcagg

SEQ ID NO: 176821 - DNA, 601 bp, Human
ttaaatatatattcttgttaataaaatgttaaaaagatatcaaagtaattatcttattgcttatttatttatttatttttgaggcagagtctcccactgtcgctcaggctggagtgcagttgtgtgatctcagctcactgtaacctttgcctcctgggttcaagcaaatcttgtgcctcagcctcccgagtagctgggatcacaggcatgtgccaccacacccagctaattttttgtatttttagtagagaaagggtttcgccatgttggccaggctggtctcgagctcctggcctccccsctcagcctcccaaagtgctgggattacaggcatgagccactgcgtccagctcctattgcatttttagataaaataggatctttatatattattgcaaaagaaaacaagttattgtagaccagtttaaatcaaaaagtttttttttatttttgaagaaggctagttttcatctggagtttgaagatgataatggttttagaatggcagggaagaaaaaggaggtcatattcacagcccctcaggtggcaactggcaaggtgtgtatgtgtgtgtgtgcatgtaagcaggttttgggagtgg

SEQ ID NO: 176822 - DNA, 601 bp, Human
taccttaaaatgcaaatgcaagaataaaacccataagactgattttaaagtggtcagaagccgggcatggtagtgcatgcctatagtcccagctacttgggaggctgagcttggggtatagtaattcaaagggagacaatatagccattaaaataatttgcatgtttgctgacatgaaaagatattcatagcatattgttacatgaaagagggtctaagattatattatagataacacttaatatatacacagacctatacagtcatacatctatagacattaaagtgtctatatgagacwttaacaaaatctctggtttcctttatctgtttttctcatattttctatattaaatatatattcttgttaataaaatgttaaaaagatatcaaagtaattatcttattgcttatttatttatttatttttgaggcagagtctcccactgtcgctcaggctggagtgcagttgtgtgatctcagctcactgtaacctttgcctcctgggttcaagcaaatcttgtgcctcagcctcccgagtagctgggatcacaggcatgtgccaccacacccagctaattttttgtatttttagtagaga

SEQ ID NO: 176823 - DNA, 601 bp, Human
gattttcaaacctatatcctaatgctgggtgttgttatagctggatggtaagattgtgggtaattttttcttcttttttgcttttctctgttttctaaaatatttgcagtgggcatatattggttttataatatgaaacaacagatgtcataaagaaaaataggatatgaagttcataaaccctggggactaatagatgaaaagtcaaaaaagtttctttcttgaggaagtctgcattttcagtcgctcacagccttaagctacaggtaaaactaggaggtcagaaagataagtaggagcmaaggcaccatgggaggcccatggaccatgagccttctgaaaacaatcatttcatggtgagctctttgcaggttcacaatttgggatttctctccttctcatgccaggaagccaagagcttggggaaccagagtgagccatgctttgttttgttgttgttgttttctgtttgtttgtttttcgagatggagtctccctctgtcgcccagaccggagtgcagtggtgcgatcttggctcactgcaacctctgcctcctgggttcaagcaattctcctgcctcagcctccccaggtagctggg

SEQ ID NO: 176824 - DNA, 601 bp, Human
cttctccgtggctcctccctcctcccttctcggtgagcagcacaccagctgccagccccacccactgcagcacctgcttcacctcctgacgtcacgggcatctgggaagttcaccatcaaaagtccctagtggggctgttttaaaaataggagctgtccttaaaccaaactgtaaagttgaagtatcttatctttggaagcttcatctcccatttctgggtccacctatttattgcttccatggctttctattacattccttgagggctttgtgcctctccctccttttctgttaaaaaamtttgctttcaacaatagaaaatagcaacttaaataatcaaaaacaagggatgatttaatattttggtatattaatgaggatactattaaggttgttgaataaatttcaatgacaggaaaggatattgtaatgcattttgggggaaaattcagattttcaaacctatatcctaatgctgggtgttgttatagctggatggtaagattgtgggtaattttttcttcttttttgcttttctctgttttctaaaatatttgcagtgggcatatattggttttataatatgaaacaacagatgtc

SEQ ID NO: 176825 - DNA, 601 bp, Human
tccaggcttctccgtggctcctccctcctcccttctcggtgagcagcacaccagctgccagccccacccactgcagcacctgcttcacctcctgacgtcacgggcatctgggaagttcaccatcaaaagtccctagtggggctgttttaaaaataggagctgtccttaaaccaaactgtaaagttgaagtatcttatctttggaagcttcatctcccatttctgggtccacctatttattgcttccatggctttctattacattccttgagggctttgtgcctctccctccttttctgttraaaaaatttgctttcaacaatagaaaatagcaacttaaataatcaaaaacaagggatgatttaatattttggtatattaatgaggatactattaaggttgttgaataaatttcaatgacaggaaaggatattgtaatgcattttgggggaaaattcagattttcaaacctatatcctaatgctgggtgttgttatagctggatggtaagattgtgggtaattttttcttcttttttgcttttctctgttttctaaaatatttgcagtgggcatatattggttttataatatgaaacaaca

SEQ ID NO: 176826 - DNA, 601 bp, Human
acctcctcgacacccacacagctacttctgaggttctgccctctgaatactccctatgggggtttaaagcataaatgcctccccacagggtcacggcgcagtctctttcttgtgttactccttctccaggcttctccgtggctcctccctcctcccttctcggtgagcagcacaccagctgccagccccacccactgcagcacctgcttcacctcctgacgtcacgggcatctgggaagttcaccatcaaaagtccctagtggggctgttttaaaaataggagctgtccttaaaccaaacygtaaagttgaagtatcttatctttggaagcttcatctcccatttctgggtccacctatttattgcttccatggctttctattacattccttgagggctttgtgcctctccctccttttctgttaaaaaaatttgctttcaacaatagaaaatagcaacttaaataatcaaaaacaagggatgatttaatattttggtatattaatgaggatactattaaggttgttgaataaatttcaatgacaggaaaggatattgtaatgcattttgggggaaaattcagattttcaaacctatatcc

SEQ ID NO: 176827 - DNA, 601 bp, Human
caacacacccagctaatttttgtatttttagtagagacagtgtttcacaatgttggccaggctggtctcaaactcctcacctcaggtgatctgcctgcctcggcctcccaaggtgctgggattacaggcgtgagccaacgcgcccagcctaaagaaaatattaacatgtttttattttcttcctttttccaagatagcctaattcctttcatgtgctttcctgccttagggatttttcaccaggccaaaatcataagcatctttaaccacctgagcccataagagaagtgaaaaggagagmgcaaggctgatggcaggagcattggcccctggatgcaaaaggggagtgaggtctgtaaggagcaaggaacgctctacctcctcgacacccacacagctacttctgaggttctgccctctgaatactccctatgggggtttaaagcataaatgcctccccacagggtcacggcgcagtctctttcttgtgttactccttctccaggcttctccgtggctcctccctcctcccttctcggtgagcagcacaccagctgccagccccacccactgcagcacctgcttcacctcctgacgtcac

SEQ ID NO: 176828 - DNA, 601 bp, Human
ttgggaggccaaggtaggaggatcacttgaggccaggagtttgagactagcctggcaatataacaaggttgcatctctacaaaaaaatttaaaaattagaggggtgtggtggcatgcacctgtaatcctagctattcaggaggctgaggtaggaggatcacttgagctcagtttgaggctgtcgtgagctatgattgtgccaccgcactccagcctgggtgaaagattgagacccacctcgaaaaaaaaaagtttatattggataaaacaccataagcaaagtcaaacaaatgagcaaaartatatctaacatacattataaagggctaatttacttaatatacaaaaagcacctacatattaacaaggaaaaagaccagtaatgtgaacaaagagttaacagaaaaaattataagcatctcttaaatgtataaaaaattgtacaagtcactcataatagaagtccaaattaaaagcccacgtgcatgcacacacgcacatgcaaacacacaatctaataatggtccttaatttgtttgaacaaactaatcataaagacatttttaagacaacttggaaaatctgaatatcaagtgtatat

SEQ ID NO: 176829 - DNA, 601 bp, Human
cactgtgctccagcctgggtgacagaatgagaccctgtctcaaaacaacaataacaacaacaacaacaaatcaatcatggtaaatgctttctacaatgttagtgtagggaagggctttcaaaatatgacacaaaatccaaaagctataaaataaaaaattgaaagttcaactacattaaaataatgtttgtgttggaccaggcattgtggctcacacctataatcccagagctttgggaggccaaggtaggaggatcacttgaggccaggagtttgagactagcctggcaatataacaagrttgcatctctacaaaaaaatttaaaaattagaggggtgtggtggcatgcacctgtaatcctagctattcaggaggctgaggtaggaggatcacttgagctcagtttgaggctgtcgtgagctatgattgtgccaccgcactccagcctgggtgaaagattgagacccacctcgaaaaaaaaaagtttatattggataaaacaccataagcaaagtcaaacaaatgagcaaaaatatatctaacatacattataaagggctaatttacttaatatacaaaaagcacctacatattaacaag

SEQ ID NO: 176830 - DNA, 601 bp, Human
ttgaacttgggagttgaaggttgcagtgagccgagatcccaccactgtgctccagcctgggtgacagaatgagaccctgtctcaaaacaacaataacaacaacaacaacaaatcaatcatggtaaatgctttctacaatgttagtgtagggaagggctttcaaaatatgacacaaaatccaaaagctataaaataaaaaattgaaagttcaactacattaaaataatgtttgtgttggaccaggcattgtggctcacacctataatcccagagctttgggaggccaaggtaggaggatcayttgaggccaggagtttgagactagcctggcaatataacaaggttgcatctctacaaaaaaatttaaaaattagaggggtgtggtggcatgcacctgtaatcctagctattcaggaggctgaggtaggaggatcacttgagctcagtttgaggctgtcgtgagctatgattgtgccaccgcactccagcctgggtgaaagattgagacccacctcgaaaaaaaaaagtttatattggataaaacaccataagcaaagtcaaacaaatgagcaaaaatatatctaacatacattataaaggg

SEQ ID NO: 176831 - DNA, 601 bp, Human
gatccacccaccttggcctcccaaagtgctaggattacaggggaaagcaggttttaaacaggatgtggaaagctttgaatgagaggctaagaagtttagatttaatcctagaggcaaaaggaagcactgaaggtgtggcagggtcatttcctgaaatatgaatttgtaaggcccccaatgttaataaagacacaaaatgtttcagattacatctcaaaggaagtatgcaaaatgcatacgaagaaaaccttaaaaggctcctgaggcaggcacaagaaaatctggacaaatggaaaggcaygctgaggtcttgaataaaaaactcaacatcatcaagatatcaatttaccctaaatcaatatatatttaatagtgttttaaatatatttaaattatacaatttgaatttgtgggaaaaaagacaaatgattaaaaacttcattgaaaaaacatgcaaccacaaataggaatattccaaaaaataagagtaataaagggctaccaacctttccagatgttttgtctatcaaagaatagtgtaaacttatagtaaaactgtgttgtactagcatatgaaaagatggatataccaatgggacag

SEQ ID NO: 176832 - DNA, 601 bp, Human
caacagcgaaactttgtatcaaaaaaaaaaaaaaaaaaaaaggccaaagcttattcaggggctagggaatagctacaggttagagaaaagcaggtttttggtttatttatttgtttattttgagatggagtctcgctctgttgcctaggctggagtgcagtggtgtgatctcggctcactgcaacctccgcctcccgagttcaagcgattctcttgcctcagcctcccaagtagctgggactacaggcgtgcaccaccatacccagctaattttttatatttttattagagatggggtttygccatattggccaggctggtcttgaactcctgacctcgtgatccacccaccttggcctcccaaagtgctaggattacaggggaaagcaggttttaaacaggatgtggaaagctttgaatgagaggctaagaagtttagatttaatcctagaggcaaaaggaagcactgaaggtgtggcagggtcatttcctgaaatatgaatttgtaaggcccccaatgttaataaagacacaaaatgtttcagattacatctcaaaggaagtatgcaaaatgcatacgaagaaaaccttaaaaggctcc

SEQ ID NO: 176833 - DNA, 601 bp, Human
tgacctcatgatccacctgtcttgacctctcaaagtgctgggattataggcatgagccaccgtgcatggccctctctgttcctttctttccctttccttcccgggttgtggccatcctcattccctgctatgtgttaggtctttgcctagaaaactcatcttcctccctgatcagctctgacccagaattattgtctgaatattgggactgggtgacctgaaacccttcaaaggtttagtttcaggtcaaatacacccatgacactaaaaccctcaaatatatccagtaataagtgagttygtacatggaacgggctggcacagagaaagcttgccatcatgtgaactctcattgttatcgtcattactactgctgctattactagtgggccctgtcctaggtgctgcaggggcgttgggcagctcactctccccaaggccttaagatacagttaaggaaacaatactcaaacccaccaattaacttttgcaagcacataataaataagtggcagttcactttaataacacaaaagccatcacagggtaatactgaattccatatcaggtacatgacacatatggtcaatgctcgagggtt

SEQ ID NO: 176834 - DNA, 601 bp, Human
ctaatgatgattggaaggggagaaaaggccccaaggtgagaggcatttccatgagctggctggctccagccgcctggcattggcatgctcagcacattcactcccgcacagcccagatgctcatcccaagccttccaagggcaggagaggcggtggcctggagccagctaggctgggaaccctggtagtgtggacaggaagagaggtggctgtacactgggcctgctgtccccaggggacccaggccatcctactgggacccaccatgggaaggaggcctcagcacagccctgccaggagscaggccttatttccagagccctaaccctgccagtgcaggaagggggtgagtccaccagcatggactggctgacagcctctgctgccatcaaaccccggcatctcattcctctctgttcctcttttcttttcaacggagtctcgctctgttgccaggctggagtgcagcggcgcaatcttggctcactgcaacctccgccttctgggttcaagcaattctcttgcctcagcctcctgagtagctgggactacaggtgtgtgccaccacgcctggatattttttgtattttttagtacagac

SEQ ID NO: 176835 - DNA, 601 bp, Human
ctggaccctcaaacgtgggagccacaggttttgagcacaggcaggtggcctcctagctgccttttatttgaaggctggagtgaaatcacccagaatccccagagccccaaaacgctttgcaatgttgagacacagaaagatttcgagaggctaatgatgattggaaggggagaaaaggccccaaggtgagaggcatttccatgagctggctggctccagccgcctggcattggcatgctcagcacattcactcccgcacagcccagatgctcatcccaagccttccaagggcaggagaggyggtggcctggagccagctaggctgggaaccctggtagtgtggacaggaagagaggtggctgtacactgggcctgctgtccccaggggacccaggccatcctactgggacccaccatgggaaggaggcctcagcacagccctgccaggagccaggccttatttccagagccctaaccctgccagtgcaggaagggggtgagtccaccagcatggactggctgacagcctctgctgccatcaaaccccggcatctcattcctctctgttcctcttttcttttcaacggagtctcgctctgtt

SEQ ID NO: 176836 - DNA, 601 bp, Human
agcacccttagatctccccagtttttaccacatgaatgatgccccctggaccctcaaacgtgggagccacaggttttgagcacaggcaggtggcctcctagctgccttttatttgaaggctggagtgaaatcacccagaatccccagagccccaaaacgctttgcaatgttgagacacagaaagatttcgagaggctaatgatgattggaaggggagaaaaggccccaaggtgagaggcatttccatgagctggctggctccagccgcctggcattggcatgctcagcacattcactcccrcacagcccagatgctcatcccaagccttccaagggcaggagaggcggtggcctggagccagctaggctgggaaccctggtagtgtggacaggaagagaggtggctgtacactgggcctgctgtccccaggggacccaggccatcctactgggacccaccatgggaaggaggcctcagcacagccctgccaggagccaggccttatttccagagccctaaccctgccagtgcaggaagggggtgagtccaccagcatggactggctgacagcctctgctgccatcaaaccccggcatctca

SEQ ID NO: 176837 - DNA, 601 bp, Human
gtgaaagtatttcttcctccttttcctgtctttaagaatgcaaacatttcattacgtgggtgctgagaactatttatctgtgcttggcaaagggtaagggagtgattctagctgggaacatggattaattctaggccactgggctggtgcatttattggtgcagaaatatcagaaagcacccttagatctccccagtttttaccacatgaatgatgccccctggaccctcaaacgtgggagccacaggttttgagcacaggcaggtggcctcctagctgccttttatttgaaggctggagygaaatcacccagaatccccagagccccaaaacgctttgcaatgttgagacacagaaagatttcgagaggctaatgatgattggaaggggagaaaaggccccaaggtgagaggcatttccatgagctggctggctccagccgcctggcattggcatgctcagcacattcactcccgcacagcccagatgctcatcccaagccttccaagggcaggagaggcggtggcctggagccagctaggctgggaaccctggtagtgtggacaggaagagaggtggctgtacactgggcctgctgtcc

SEQ ID NO: 176838 - DNA, 601 bp, Human
gcaataaggagatcactcgcactgccaccatattctatgcacagtatcaggacacctctaattcagcatctgtttccctgtatcagtcagactactctgtactgttgtgccattgaattcagatttcagtgccaggcttacccatcaacccatcaaatattcgctctgcctagaatgctgtctctcaacccctccactctaccccacctccttcacttaacactaattcatcctttaagagccagtataaatggcgcttgggttgggtctcccttcatgtgccctgctccctgcatttacrtttccttctctctcctagatgctccctgagcccagggaaatctgtcttggtcacttctctgtctccagggcctggagcctggtgcaccatcagtactccatagctgtattgtggctgtctgtacaaacattgattctgttcctattatgtggcagcgctgtgctaggcctgaggacacacagaggtaaaacaaatttcctgccctcaaggagttcctgatagggggaggaaaatgatgagcaagggaacaggatatgtagaatgtatgactcatgtgggggtaaggataatgaaggtttg

SEQ ID NO: 176839 - DNA, 601 bp, Human
atggggagatgagggccaggccatcacaggccagctacagatgcccagagcccaaagtcaggagctctgcatggcttctgggagaagcatgaaggggtgggagtggtcagaggaggcaagaagttctgggaggaattcagagagaccagtcagccacacggatgcttcccattctaagtattagagcctcccaaaggagcagagagaaaactgggaaggccaggagaacttgagatgcccccaaaccatgcctttgctgaagaggggccgatggcagcagccccggggcccacagaagggrctttaccagcatctctccagagagcacctccagcagcttgatgagcatgcgcccatcccgcaggtccttgtagagatcggtgatgcggcaggacactcgagccaggtgcgagttcacccatttcgtgaaggtctttttctgaacaacttcccgctcatctaggtggagagaagaaccttggtgaggtgcctgaggttggcagggtcagtgtgacatggggccaaggggttttaccttaagcccagggtacccccatgcttggcagaggaagtcgatgtattcattccactcccttccttg

SEQ ID NO: 176840 - DNA, 601 bp, Human
gatgcatcttagcccgatggggagatgagggccaggccatcacaggccagctacagatgcccagagcccaaagtcaggagctctgcatggcttctgggagaagcatgaaggggtgggagtggtcagaggaggcaagaagttctgggaggaattcagagagaccagtcagccacacggatgcttcccattctaagtattagagcctcccaaaggagcagagagaaaactgggaaggccaggagaacttgagatgcccccaaaccatgcctttgctgaagaggggccgatggcagcagccccrgggcccacagaagggactttaccagcatctctccagagagcacctccagcagcttgatgagcatgcgcccatcccgcaggtccttgtagagatcggtgatgcggcaggacactcgagccaggtgcgagttcacccatttcgtgaaggtctttttctgaacaacttcccgctcatctaggtggagagaagaaccttggtgaggtgcctgaggttggcagggtcagtgtgacatggggccaaggggttttaccttaagcccagggtacccccatgcttggcagaggaagtcgatgtattcat

SEQ ID NO: 176841 - DNA, 601 bp, Human
tgattgataatgggttcatccctgccaatcaaccttctcctctcccccagtgataactgcatcatctgatgggttccccatgggtaactctctctagtggaatttcaatgcagggtgagaggcagaacttcagcatggagttgaaaaggcaatatttcattcaagccttttcattcaaactctgaggatctcagaataacttcatcaggtacaggtatcattgccctcattttacacatgggggaaatggaggaaaagagggtcctgcctgataggcccaaggacacaaagcttactctgkgctgagcaaaacataaaccttcatctacttcttctttggggtcaacagtattgccggtgggttacaactgagacagcctctaataaatttccacttgcaagggtggtaaaacacacagtaaaatggcttccacactttcctcttggttccaagagggatgcatcttagcccgatggggagatgagggccaggccatcacaggccagctacagatgcccagagcccaaagtcaggagctctgcatggcttctgggagaagcatgaaggggtgggagtggtcagaggaggcaagaagttctg

SEQ ID NO: 176842 - DNA, 601 bp, Human
tcttctccctgaaaagaccatactactgagtgagcagctccccctgagcttcagtgacttggggtgatacagaagatggttactccttcctacaagcactgtcccatgtggcagatttacagccttcccagaatgtgcactaacacccacactctgttcagcattttataagattctaaggccctgggcagccttgagggctccctcgacttcctctaccccccaggaacccacctggaagcggaggatgatggtccagatgaggcccaggaccaggcggtggttgccatctacaatgtcrtgggagcccatgttctccaggtgtacacgctgctccttgaggaactggagagccttgtccacattctccaggcagtggatgcgcatcttccccttggtgggctttggctgggggacagcagtggcccccgtgggcatggagggactgcacagtcatcccagaggctgcagcgtggaccagctcctgtcataagcacccaccctccaccctcttggccaaacaccaagtcccatggtcattcattgacactattcaatgctttccttttagcaaagctcagaggttccctccaacaagcac

SEQ ID NO: 176843 - DNA, 601 bp, Human
actgcccctcactgtgcccacagcttgcccagcacctgggccggcctccagaagtcctggcggctgagctcctctagcacagcgagtgcatcccccactgctgcagcaaaggctggcaggggtgggtgtggctcaccttcggggtcgaggagcgggatgatgcccagctggcgctcagccacattgaatgcgtgctccaggttgtgccgggcattggagtccttcagcttatcaaagtcgatcaggtcgggcctggggacaaaactggactgtgaaaagggagtagccacagcatccccaycaggagggcagccctagcatgaagcagacattgtacagaggcagggaggtggtcaggcaggaggagtgaaaggaggagatgggagcagaggagagggggcaggtgtgagccttggcatatgagggaagtgggcggcaggcatgctgggatttaaggaaagtgaaggtgctatgggctgctgaaggggagaggagaaggaacagcagaggtcacatttctgtgactccatgttaagtgcaatgtgtccaaatattcccagggaggctgtctcagtcagtccccacggctgtcccctccctc

SEQ ID NO: 176844 - DNA, 601 bp, Human
ggtgtactctcaggaccaaactggaagtcgggaaagtcaggctcagagggtttattccccattcctccagcatcaagttcaactacaggcagcaagtgacaaccaacagagcaagaatggaagagtgtgatgaaatccattttagaaccacacattacaaaagaagaaaagaagaaggatccaaagtccatctccaaacagaccaggcaggcatgggaaccagcatggagcagagaagcaggcccagatcagagcctggcctggccactgcccctcactgtgcccacagcttgcccagcayctgggccggcctccagaagtcctggcggctgagctcctctagcacagcgagtgcatcccccactgctgcagcaaaggctggcaggggtgggtgtggctcaccttcggggtcgaggagcgggatgatgcccagctggcgctcagccacattgaatgcgtgctccaggttgtgccgggcattggagtccttcagcttatcaaagtcgatcaggtcgggcctggggacaaaactggactgtgaaaagggagtagccacagcatccccaccaggagggcagccctagcatgaagcagacattgt

SEQ ID NO: 176845 - DNA, 601 bp, Human
aattcagctcaggagccatcaatgttgccaaggtcagctttagaggaagttggggggtgggtgagctgtactcttcaccctttctttggttggaaagagggccactctgtctggacctgacaaacaggggaagagtgacactttggttccaaaacagcttgtaccttgccgacacgcttgccctccactgccagcaccttcatcttggagaagtagtggtaaaaggccaccacataggtgatgatggatttctcatcagggttttccgtaaagacatctgttagggaaaagggtgtactctcaggaccaaactggaagtcgggaaagtcaggctcagagggtttattccccattcctccagcatcaagttcaactacaggcagcaagtgacaaccaacagagcaagaatggaagagtgtgatgaaatccattttagaaccacacattacaaaagaagaaaagaagaaggatccaaagtccatctccaaacagaccaggcaggcatgggaaccagcatggagcagagaagcaggcccagatcagagcctggcctggccactgcccctcactgtgcccacagcttgcccagcacctgggccgg

SEQ ID NO: 176846 - DNA, 601 bp, Human
gtacctttcaggacagaccatcaacctgctttggaattcagctcaggagccatcaatgttgccaaggtcagctttagaggaagttggggggtgggtgagctgtactcttcaccctttctttggttggaaagagggccactctgtctggacctgacaaacaggggaagagtgacactttggttccaaaacagcttgtaccttgccgacacgcttgccctccactgccagcaccttcatcttggagaagtagtggtaaaaggccaccacataggtgatgatggatttctcatcagggttttcygtaaagacatctgttagggaaaagggtgtactctcaggaccaaactggaagtcgggaaagtcaggctcagagggtttattccccattcctccagcatcaagttcaactacaggcagcaagtgacaaccaacagagcaagaatggaagagtgtgatgaaatccattttagaaccacacattacaaaagaagaaaagaagaaggatccaaagtccatctccaaacagaccaggcaggcatgggaaccagcatggagcagagaagcaggcccagatcagagcctggcctggccactgcccctc

SEQ ID NO: 176847 - DNA, 601 bp, Human
acaataaacaaaccacataaaagcctggagggttcctgtggggatgtccatgagacatgggtctcaggtggaccaggtgttcgccaggtacagagcagccagctgtggtacctttcaggacagaccatcaacctgctttggaattcagctcaggagccatcaatgttgccaaggtcagctttagaggaagttggggggtgggtgagctgtactcttcaccctttctttggttggaaagagggccactctgtctggacctgacaaacaggggaagagtgacactttggttccaaaacagctygtaccttgccgacacgcttgccctccactgccagcaccttcatcttggagaagtagtggtaaaaggccaccacataggtgatgatggatttctcatcagggttttccgtaaagacatctgttagggaaaagggtgtactctcaggaccaaactggaagtcgggaaagtcaggctcagagggtttattccccattcctccagcatcaagttcaactacaggcagcaagtgacaaccaacagagcaagaatggaagagtgtgatgaaatccattttagaaccacacattacaaaagaagaaa

SEQ ID NO: 176848 - DNA, 601 bp, Human
acggaactgtggcatcttgaagcgtagatagcaaagcatatttcccttaaaaacacagaaaaactaaagagaatctgtaggtctgcttacctgttaaaacatctatccttttcaccaactgagatctattaggggtttgggtctttacaatataaaccagagaaaacacaatggccaccacagcatttatcatttgcctctacatgggaagctgaggtattctggtaattcctgtaaatatcaagttgtacggatcaatacaaaaaaaattttaaaaaaccttctctgtgctgcaagtgaygagggcttcttactagctctctggtcagttccttattaagtgagtcaataaaaccccagaagcagcatattccgtgggagagcatcctgcactgaaaacagctttcacccaggtcctaatgagccagatctcctgacaagtcctacaggccagatgcttcccagaaggcaggaaaggctgggctctgagaggcttgtaggtgtaggagacaagaattgtcagcaggatcggtgtctagcatatggggtacaggctccaggtatcaggtacttccacatttctgcatgtacctaagtgtcc

SEQ ID NO: 176849 - DNA, 601 bp, Human
tcgagcctctggcgccgggactgcagcagctcctgcaggtagctccataggcgcagtatattgtccttgcgggccgtgatgcgcttctggtcatggtagttctctttctccagctcctgagccaggtcctccagggctctcacccgctcctcgtaggcagccgtgtcggtctcgatggcctcatgcttcttcttggcggcctccacagctgccaggtcatacccaaagttatcctgccccaccgggagaaaaacaggcagctcagtcagacacccaggggctcatccccaaactcagggamagggcagctcccttcagaaccagtgctagatgggaaagcacattcccaagaagcagctagttctgccttacttttgcagcctgtcttatcagacccaagttccaaaaattaatgtctcacaagagactctaagagaagttcatgattttactccccgtgccacccgcgtgggagatgcagcctgcgtgttactaatggagccccttggcagcctgctggcactccccacatgcctcgagtggacctgttggatttggggcaggaaggggctgcttctcactcggaaacccatgcaccagc

SEQ ID NO: 176850 - DNA, 601 bp, Human
atctggggaatcccgaaactcttcggggaatccctgggcctgctgctccaggtgctccatcaccccacggctctcctccagctcctccaggaagtccttgtgctttttccccagggcccgcgtggccccttcgtcctgccccacatcttcaccagagagcagccggtgggcgtcttgcagccaagccttcaggtcatccgcatcgccctggaactggaaaaagttctcagcatcctggaggttcttcttgcagaaggcagccaggtccttcagctggtcccactgtgccgacacctccttkatgcgggcctcgatctgcgggtgcccaaactgcttgcgcgcaaccatgccatgagcctcctggaagatctgctccaggtgagcatccagcccacggagctcatcctcaaaggccttgtgcttgcgctgtaagatgagcacactggtcaggtctttgccatagtccagggaagaatagatctgctccttctccttgatccagctctcagcctcatccatctcccagaagaacttccagagtcgtttggactgctccagttgggccttccgcccagctgccatgttgctcagctcctcaaag

SEQ ID NO: 176851 - DNA, 601 bp, Human
cccaaagggtgaagtaccccaggccacagagccagaatagaacttatgactcctaatgccaggactttgcaacaaaggacatcccagggcctctcaaagagacctttgctgatccagagactattaccaaactaggtgggagatggtgcccaggcctgggtacagggacgtgaggaaaagatgagttaactctgacctgtgctgcacgacctccaggtcctccagggtgtctggcatttccatctcggccagccacttctccttctctcccatccacagctcacaggcgtctgtctccccraacaccgtgtacaggtccagggcttcctgcagcctctgctgacgcaggtccgcctgggccaccacctgttggtagagctcccgcagggcctgcagccgatgggtcacatctggggaatcccgaaactcttcggggaatccctgggcctgctgctccaggtgctccatcaccccacggctctcctccagctcctccaggaagtccttgtgctttttccccagggcccgcgtggccccttcgtcctgccccacatcttcaccagagagcagccggtgggcgtcttgcagccaagccttcagg

SEQ ID NO: 176852 - DNA, 601 bp, Human
agataccctttccagccaggtgctccattcctgggtaagataaggaaaagctgctggggcggtggtcggggggaatttgtggttctgaaggccgatccttctagggtaagagcccaggactctccagcatcagtgcagcaccaccttggcactgttccagagagcggcctctccttctcctgactgcctgaattctgtgcttcagctgctgagatgctgcacagactggggcatgcctcatcatctggggtgctgacaaaatcagaacaccaggggtgagagtggccttgcagacaggggktttgcaaattctctctgtggcccctcagagtctcctggcttaaggactgccacagaaagctagagctggcagggtcctggcctctcaacctccttctccagagtagctccatttttcctctgtgtgacctgggggttccatacacaattcatctgagcaaagactgctattgctgaaaagtaattgaataactggactagataaattccctttgtttgaggaacacaaggccccaaagggtgaagtaccccaggccacagagccagaatagaacttatgactcctaatgccaggactttg

SEQ ID NO: 176853 - DNA, 601 bp, Human
ttgcccaggtgaggcaggaggaagaaaacagatatgctggccctcctttctggttcatgggtttgatttcatgagttagcattgcctggaacaggccgggagagagccagttacttcctacacgggcttctggctcaagagagacatatgaaggggagggagggctgaagagaggttactgtgtatttgtgtgggggatgtcaattgtcacaagggccaccttccaggcctctgcttttccggctgttgcttttggactctgagtccaatgccttgacatcttaacccaaaagataccctytccagccaggtgctccattcctgggtaagataaggaaaagctgctggggcggtggtcggggggaatttgtggttctgaaggccgatccttctagggtaagagcccaggactctccagcatcagtgcagcaccaccttggcactgttccagagagcggcctctccttctcctgactgcctgaattctgtgcttcagctgctgagatgctgcacagactggggcatgcctcatcatctggggtgctgacaaaatcagaacaccaggggtgagagtggccttgcagacagggggtttgcaaat

SEQ ID NO: 176854 - DNA, 601 bp, Human
atactaggtggactaaattttgggcccggcccccagcagtgtgtcagatgttgagagacaatgcccccgccccatgccctacccacaccccacctggtgttcagatggtcctggtactgcttcacctccctgctgcgtgggtggccactctctaccaagctgttggcagcgaggttcacaccatcaatctgagtcatcaaggtcttcatctcctggtccaggatgtcgaacctgatatgggcaaaggaaaatatgaggatgggtgaggcggcagcagacatttccttgccagtggcacccscagtctccagaacatgtagctcttgctttctccttccactgcctaaaccatttgcccaggtgaggcaggaggaagaaaacagatatgctggccctcctttctggttcatgggtttgatttcatgagttagcattgcctggaacaggccgggagagagccagttacttcctacacgggcttctggctcaagagagacatatgaaggggagggagggctgaagagaggttactgtgtatttgtgtgggggatgtcaattgtcacaagggccaccttccaggcctctgcttttccggctgttg

SEQ ID NO: 176855 - DNA, 601 bp, Human
gtgagacctcatctctacaaaaaaaacaaaaaattagctgggtatagtagtgtgcatctgtagcattagctacacaggagactgagatgggagaatcacttgagcctgggaggctgaggctgcagtgagccaaaattgtaccactgcactccagcctgggtaatggagtgagattctgtctctataaaaaattaattaattaattaataaagagtaatgcaaagtccttgctttcattcaagtggatagagacataaacaagtctataatccatcaagtggtgataagcgcaaagaaaaartaaaagaaggtaacaatatagaggccaagtgggtcagtgagaggaaggatgtgctgctttccatggggcggtcagcgggggccatgccagtaagctgacatttgagctgagacctgaataaaaagagtaagccaagggcatagctaggaaaataatactctaaacagcaggaaccccaaaaatgtattaggtgtgcaaagcccttgggcaatataaatagatacaggtcttcatttgtttacatagtctagcaggaaagtccttggggacaaaaataattagaatgtaagataggatatg

SEQ ID NO: 176856 - DNA, 601 bp, Human
ttggcctttgggagaatatagacataaccagaccatgccctgtggggtgtatgatttagagaaatattcagacaagctcacaaataacatagcataaagtttcatgtgcacagcacctaacaggcagagaggaggattaaggcagctggaaggagcaatggggtgacagttgctcacgtgacctccacacaacccatcactggacacaaagccccagtcagtgaacacacccccagtgcctccactggagtgaccaattaaaggatgggaccaagtgtctcattcatctttgtaccctgcytcaggggatggaggctgagggactaggagatggactggacagagagcgctgttgtgcattcccaaggtgtgacaacagcagccagtatgatttgaaaggtctgcagagagatataagagacaggctgggagagaccagggatacgagagaggagagagagcctgcagatttctcggctcccatcctagaccatgaagaccccgtgctctgggaattccgtgcctgtctggcacacagatggtgctctgaggctaggaaatcaaggggttttctccaagtttgtttgaaagccctggaatc

SEQ ID NO: 176857 - DNA, 601 bp, Human
ttaattatgtgactccaaccataagtaaaggaacatgaaagcaaagtctatgcatgtagttggagttcaggcaaatatacaatttccccagagtttatgaaatatcaaaataattaaaaggctcacattaacttcaagaatgcttcaggacatagggtccccagctgccctagaggaaccaagtaaatgcccaaggccacatgcaacgtctcctagggcctgaaagagatcaccttggatctaagagaaaagatgccctggtgaaaaagaagaggaagaagaggacagggaagaagagaayggggaggaataagttgtgatgataatttaagtgactagcataatcttaaccttcgagtgcagtgttgctatgaaatacggaaatgtgctaaggtctggcggatgcctgggggcctggggtcagtctgcagtacacgataagcctctttcaaagagctgcccatcagccaggccagaccactagggacactgcccttgggcctaggttcactcattctgcatcactgtaatatgcaggctgaatgctcattctctaatcgaacccatctttctcgaacacccacaggggtataagccattt

SEQ ID NO: 176858 - DNA, 601 bp, Human
gctggagccctggtgaaggcaatggaaagcaaacattaataactgctgtcctggcactggacactgaagctctaactagatgtcctcagtgtcctgggctgtccccagattcaggtgacccagaagaggcactgattctgaccaggtgtactaagactgactacatcaggagctctgaaggtttagctactatttagaaaagttgttcgctgccacgttctgtactgtcagcaagctttaggacagggtccacaccctgggtgaagcccatccaggcaagcctatctgagcagagcacccrcccgccgcccaatcactttacttaccgcatcgatgttctctagccacccttcatgggaagccagctctgccacaaacgcctggtgctttagccatttattgtgaaggtttcgtgcttcatcataggagacatcctgagatgtcagcagcttgtcgttgatccagagagtgagctgtgtgcataaagagtgggctgactatccctgagtatatttctttggcagagcagaacctgctgcccatccctggctgcagaaggagaaggccatggggaggaagtgcaagcacagaagagaaccca

SEQ ID NO: 176859 - DNA, 601 bp, Human
tggctcactgcaacctccgccccccagtttaagcccttttgtgtctcagtctcctgagtagctgggattacaggcgtatgccaccatgcccagataatttttgtatttttagtagagatgggatttcgccatgttggctaggctggtctcgaactccagacctcaggtgatccgcccacctcagcctcccaaagtgctgggattacagctgtgagccaccgtgcctggcctaatagttaatatttattgagtgtctcataattgccaagtactatgctaaatgtttcatttgtctttaagyatttagtgctcacaactccactgggaaggtcctattattactctcatttcatagagggagaaactgaggcacagggaggttaagaagtcagtctgatcctagggctgctttttcatggacagccatggtagagatgagcaaaggtagtgatttccacatctaattccagccacatttggacttgtccactgggcaaactcactacagaggggtcccttggttcgccatctataaggagtggaaacgaccactccccagtggttctgtccatccaaatgatgaggattaatggctcccctg

SEQ ID NO: 176860 - DNA, 601 bp, Human
gggagagcagtgctgggggcaatgactcagggagaccgcagcatgggagttgcagacaagggtcagctgctgtgagaaaaaggattccagacccatccaggtacagtcagtgcagaaactgccccgtgagttcctgaggttgtgcactaaccttcgctgacctccttcggttactgaggttgccttacctggttttcatctgcatagatgtatcatttttgggtgggcacagtgtgatataaattggacttaggaatctatatcactaataatagttaatttttttttttttgagacagcrtctctctctgttgcccaagctggaatgtagtggcacaatcttggctcactgcaacctccgccccccagtttaagcccttttgtgtctcagtctcctgagtagctgggattacaggcgtatgccaccatgcccagataatttttgtatttttagtagagatgggatttcgccatgttggctaggctggtctcgaactccagacctcaggtgatccgcccacctcagcctcccaaagtgctgggattacagctgtgagccaccgtgcctggcctaatagttaatatttattgagtgtctcat

SEQ ID NO: 176861 - DNA, 601 bp, Human
aagggctcagagtccaaagttagtggcttcctaatggaatttgagccccacaagtatcctcatatgtcgagagaaatggggcctacttaccccaaggacaccacacatgccaagctcagccctggaagaggggcaaggcagtgttgtgggagagagatcaggagttactgccctcctctcaggcagaccactggatacaccgaatacacagctactgaagcacatcaacctccaggccaggcccccgagatcctgcattcacctgtgcctgatggaggctgaatggccctgaatccccaastacctcccctcctctgtgatcctcccagaatttgctctgtaatcacaaaaacctgctctttctgctataagattaccaatacggtttggagaccccaaagctaccaacaagaacaataatctgctgttgctagccttctgcaggtcagggctgggcctacccccgtggggccaggtgggggtgaggaggggtgggtggggctggtgaggtgacgcaggactcacctggttcttcttcatgaacagttgcacagtttgcagattagtgccatagtcggctgactgggccagaggcagcctc

SEQ ID NO: 176862 - DNA, 601 bp, Human
gacccagagagcatgcagagggagggtctctctgtccaagaagggtctgtggccattcccctggccgctgcgaccccacacagccagcttccttacatgattcaggctcccactgcagccctgacccaagagggagtgcttggcatctgctcacatccaggatcctgaccagggccacaggagttcccaatcagggctaagcgagtgccaaaaagcagagggatgtttgctccaagggctcagagtccaaagttagtggcttcctaatggaatttgagccccacaagtatcctcatatgtygagagaaatggggcctacttaccccaaggacaccacacatgccaagctcagccctggaagaggggcaaggcagtgttgtgggagagagatcaggagttactgccctcctctcaggcagaccactggatacaccgaatacacagctactgaagcacatcaacctccaggccaggcccccgagatcctgcattcacctgtgcctgatggaggctgaatggccctgaatccccaactacctcccctcctctgtgatcctcccagaatttgctctgtaatcacaaaaacctgctctttctgcta

SEQ ID NO: 176863 - DNA, 601 bp, Human
cagaccctggtctaggtaatagggacaatatagaaacaagagaaatgaaaatccctgcactttaaagcttacaacctggtagaggaaatagaaggtaaacatgcaaataaatgaataaacaaaggctgggccttcctccctgggggctacgaggaaaagacaacagtgggatggagaatgtctgctgcgatgtggcaggagccactttagctaagggagtcagggagggcctctctgaggatacgaaacttgaccatgacatgaatgacgggagggaggcaaccacacagagatctggggktgagtgttcctggcaagaggactgaacaagtgcaaaggctctggggtggacatgagctgggaccgtctgaggccacagagagggccagaagagctggaatactgtgaaggagggcaaagtgagaagagctgagtttcagaagcaggcaggggtcaggtcaggcaagagtggttcttaatcctgattgcccactgaataatccagggaaacagatgcagctaggggcctacccccagagatcctaattgatctgaggtgagacctgggcattcatctgtctaaaagttccctaggtgatgt

SEQ ID NO: 176864 - DNA, 601 bp, Human
tttaagatagggtctcactctagtcacccaggctggagtgcagtggcacaatcagctcactgagcctcaacttcccaggctcagatgattctcccacctcagcctcccaagtagcttggactacaggtatgtaccaccacatctggctaattttttgtattttttgtagagatgggcttttgccatgttgcccaggctggtctcaaactcctgggctcaggcgatccacccgcttcggcctcccaaagtgctgggattacgggtgtgaaccactgcgcccggcctaaaagggtatttcttyctttttaaccaattactttctagtatctgtgcagggtacttacatttaaagtcttcttccctgtcttcattcattcaacaactatgtattaagttcttttctatgtaccagaccctggtctaggtaatagggacaatatagaaacaagagaaatgaaaatccctgcactttaaagcttacaacctggtagaggaaatagaaggtaaacatgcaaataaatgaataaacaaaggctgggccttcctccctgggggctacgaggaaaagacaacagtgggatggagaatgtctgctgcgatg

SEQ ID NO: 176865 - DNA, 601 bp, Human
atttttacaatttcctatagtctctgcagttgcattcaaacaacccatgttttcagctccatttgcttgtttactctgagatcttatgacctctgcatggtgccctaaaaattaatttcttttttttaagatagggtctcactctagtcacccaggctggagtgcagtggcacaatcagctcactgagcctcaacttcccaggctcagatgattctcccacctcagcctcccaagtagcttggactacaggtatgtaccaccacatctggctaattttttgtattttttgtagagatgggsttttgccatgttgcccaggctggtctcaaactcctgggctcaggcgatccacccgcttcggcctcccaaagtgctgggattacgggtgtgaaccactgcgcccggcctaaaagggtatttcttcctttttaaccaattactttctagtatctgtgcagggtacttacatttaaagtcttcttccctgtcttcattcattcaacaactatgtattaagttcttttctatgtaccagaccctggtctaggtaatagggacaatatagaaacaagagaaatgaaaatccctgcactttaaagc

SEQ ID NO: 176866 - DNA, 601 bp, Human
gtgattcacacaaaaccaaggcataaaatgaaattggatccatcaccagtcccgcagcaattttctccagccctatttgatgggaaaactctttccattttccttttaaatctgaagggacgttggctggtgggcccctggctcaatccccatctcctgaccgagtcaccacagggggcgcacgcacccctcagggtggcctgcagacagcaggccctgggcccggctggccagctgcttgatgttccggccgtagtcctccaccgcacgctgctgccgcaaatgtcgcttcagcatcacratggcgccctcttcatcctaggaggcagcagacggtcagcgccagagctcagtctggccatgatccctcccttggcaagttgtgcccccactcctggaggtgcccgagggaggaggggagtaggcttgtgggacacccgcaggagagccacacatgcttccttcctgcccttctgatttcccagcaatgcccgtgccctaccttcctctctggactcccctgattcgtatccgacatatacccttccttttgtgctctaacccctgtccccatgaaaacatcctatatcattccagcttt

SEQ ID NO: 176867 - DNA, 601 bp, Human
ctgtggcccagtgggcttccatttatgcaggatccacaaaacctcgcagcccatgtgggcacaggtttccacctgcactcctacatcatggttctgtctggactgtgaagtcctggagaccttctggaccataaaaataaaagctaaagtagtcttcagtgtcccttagcatattgtaacccttcggaaaattggtgctctcaggtcaccaagagggtagttttgctaaccccttctctgatcatttcgaaaaccagggcctcgatggcccagctggaagtgattcacacaaaaccaaggyataaaatgaaattggatccatcaccagtcccgcagcaattttctccagccctatttgatgggaaaactctttccattttccttttaaatctgaagggacgttggctggtgggcccctggctcaatccccatctcctgaccgagtcaccacagggggcgcacgcacccctcagggtggcctgcagacagcaggccctgggcccggctggccagctgcttgatgttccggccgtagtcctccaccgcacgctgctgccgcaaatgtcgcttcagcatcacgatggcgccctcttcatcctag

SEQ ID NO: 176868 - DNA, 601 bp, Human
cccgcagcaacagctctgctcagccctccagggagggaaaagacatactaggggcccagacaatgtggctcccagggaaacctctggggtggctgctgaggacccacagtggtgggcaccctaatggcagctgaggacagggccatggctgggggcagtgtgtggtctgtggcccagtgggcttccatttatgcaggatccacaaaacctcgcagcccatgtgggcacaggtttccacctgcactcctacatcatggttctgtctggactgtgaagtcctggagaccttctggaccataamaataaaagctaaagtagtcttcagtgtcccttagcatattgtaacccttcggaaaattggtgctctcaggtcaccaagagggtagttttgctaaccccttctctgatcatttcgaaaaccagggcctcgatggcccagctggaagtgattcacacaaaaccaaggcataaaatgaaattggatccatcaccagtcccgcagcaattttctccagccctatttgatgggaaaactctttccattttccttttaaatctgaagggacgttggctggtgggcccctggctcaatccccatctc

SEQ ID NO: 176869 - DNA, 601 bp, Human
ccattgttcttccagagaggctgggggagcagcactacctgagtggggctcccgcagcaacagctctgctcagccctccagggagggaaaagacatactaggggcccagacaatgtggctcccagggaaacctctggggtggctgctgaggacccacagtggtgggcaccctaatggcagctgaggacagggccatggctgggggcagtgtgtggtctgtggcccagtgggcttccatttatgcaggatccacaaaacctcgcagcccatgtgggcacaggtttccacctgcactcctacmtcatggttctgtctggactgtgaagtcctggagaccttctggaccataaaaataaaagctaaagtagtcttcagtgtcccttagcatattgtaacccttcggaaaattggtgctctcaggtcaccaagagggtagttttgctaaccccttctctgatcatttcgaaaaccagggcctcgatggcccagctggaagtgattcacacaaaaccaaggcataaaatgaaattggatccatcaccagtcccgcagcaattttctccagccctatttgatgggaaaactctttccattttccttt

SEQ ID NO: 176870 - DNA, 601 bp, Human
gaacccagagccgtggctccagggagccaacatatgccaaccacagccccctggcagggataggtagggagtgaagctctggagaaatgacaggggctttgccggggaagagctggggagagaaggggccacaccctagcctcaggggatgacacactgtgtcctggaattctgtcctggaggggtgcttcccatggtgcccctcactctggcaagcttacagggacaagtgcaaatggggaacgcctccattgttcttccagagaggctgggggagcagcactacctgagtggggctccygcagcaacagctctgctcagccctccagggagggaaaagacatactaggggcccagacaatgtggctcccagggaaacctctggggtggctgctgaggacccacagtggtgggcaccctaatggcagctgaggacagggccatggctgggggcagtgtgtggtctgtggcccagtgggcttccatttatgcaggatccacaaaacctcgcagcccatgtgggcacaggtttccacctgcactcctacatcatggttctgtctggactgtgaagtcctggagaccttctggaccataaaaa

SEQ ID NO: 176871 - DNA, 601 bp, Human
ccaaaaaggccctcagagacggcagccacgaacccagagccgtggctccagggagccaacatatgccaaccacagccccctggcagggataggtagggagtgaagctctggagaaatgacaggggctttgccggggaagagctggggagagaaggggccacaccctagcctcaggggatgacacactgtgtcctggaattctgtcctggaggggtgcttcccatggtgcccctcactctggcaagcttacagggacaagtgcaaatggggaacgcctccattgttcttccagagaggctgrgggagcagcactacctgagtggggctcccgcagcaacagctctgctcagccctccagggagggaaaagacatactaggggcccagacaatgtggctcccagggaaacctctggggtggctgctgaggacccacagtggtgggcaccctaatggcagctgaggacagggccatggctgggggcagtgtgtggtctgtggcccagtgggcttccatttatgcaggatccacaaaacctcgcagcccatgtgggcacaggtttccacctgcactcctacatcatggttctgtctggactgtga

SEQ ID NO: 176872 - DNA, 601 bp, Human
cccatttccggggaagaggccactagctccttttctgaaatccactgctccaggtcgtcggtctcccgcttgagctggaacaggtggtacatgttctccagcttgcgcttgcgctcttccgccacgtccttcagccctgcgtagtgcttgtccacttgcccctgaagtctgatgatctgttccctggaattcaaaaccaaaaaggccctcagagacggcagccacgaacccagagccgtggctccagggagccaacatatgccaaccacagccccctggcagggataggtagggagtgaarctctggagaaatgacaggggctttgccggggaagagctggggagagaaggggccacaccctagcctcaggggatgacacactgtgtcctggaattctgtcctggaggggtgcttcccatggtgcccctcactctggcaagcttacagggacaagtgcaaatggggaacgcctccattgttcttccagagaggctgggggagcagcactacctgagtggggctcccgcagcaacagctctgctcagccctccagggagggaaaagacatactaggggcccagacaatgtggctcccaggga

SEQ ID NO: 176873 - DNA, 601 bp, Human
tccctgctgcactggaagctgggggagccctcagcaacaggggcccccttgcatttgccctttctatcacaccaagctctggggcaccctacggatctgcggagggcactccagtgatggggcaggggtctgaacagtagaacttgggggctctccagctcccatgtggaaaggctgaagtgcccggtggctaagtatgtggggtctatagctacactgccagggtctgagccctggctccacttcgtacctacatgttcctgggaaacttatgggtcttctacctctcccttttctcatytacaaagtgcagggaatattagtagctgcctcagaggactgccatgagggtccagcggctacatacattgctcagaagagcacctggtgctagaaaagtgctgtgcgtgtgtccactaatagtactgcacaactggagaaactgcaaccgtatagtattgtatgcattggccttttgtgaggattcagtttaaagaatgacttctgaagctaaggaacatctgaaagccactgctcccagccctgagctcctggctgtctaaggaggcaaaacctcctggcacttatcctagaggttttc

SEQ ID NO: 176874 - DNA, 601 bp, Human
tggatgaaccaggggcccagccaaccctggtgttctgtccccaagccctgcagggctggcctgggattgcgcagccagcctacctctccctgctgcactggaagctgggggagccctcagcaacaggggcccccttgcatttgccctttctatcacaccaagctctggggcaccctacggatctgcggagggcactccagtgatggggcaggggtctgaacagtagaacttgggggctctccagctcccatgtggaaaggctgaagtgcccggtggctaagtatgtggggtctatagctasactgccagggtctgagccctggctccacttcgtacctacatgttcctgggaaacttatgggtcttctacctctcccttttctcatctacaaagtgcagggaatattagtagctgcctcagaggactgccatgagggtccagcggctacatacattgctcagaagagcacctggtgctagaaaagtgctgtgcgtgtgtccactaatagtactgcacaactggagaaactgcaaccgtatagtattgtatgcattggccttttgtgaggattcagtttaaagaatgacttctgaagctaag

SEQ ID NO: 176875 - DNA, 601 bp, Human
ttgttccctggacattgctccctaggtgctgtgggcctaggactggaagggcagctacctcctcctggcctccctgcccagggcactgctggaaggtaggatcttcagcctccacccagtgggtgctgtaggagaagactccttgctttaacacctctgcctacccaagatacctcttgaactttgtgaaggtttgggagtgagaggaaatcctgccctttgatctcctcaacaatacactaatgagaggaactacataccaggcactgttctaaacactttctactgatgaactctcttygtctttccaacaaacccaggaaggaggtactattactattgctgtttctgagatggggaaaacgaggcacaaggaagctaagtaactggtccagggtccttcacactagtaaaggggtacagctgggatttgcaccgtgctcctgagtccccgttcttaaccattctgtgtgctgcctctccaaggaagtggttgcaccagatcccctgattgaggctggccctggggacagtgaaacctcactcctaagacctcagtggggctacacctatctcaggggccctggcatccccaaatgca

SEQ ID NO: 176876 - DNA, 601 bp, Human
gctgcacctgtggtcaggcaaaatcagacattgttccctggacattgctccctaggtgctgtgggcctaggactggaagggcagctacctcctcctggcctccctgcccagggcactgctggaaggtaggatcttcagcctccacccagtgggtgctgtaggagaagactccttgctttaacacctctgcctacccaagatacctcttgaactttgtgaaggtttgggagtgagaggaaatcctgccctttgatctcctcaacaatacactaatgagaggaactacataccaggcactgtyctaaacactttctactgatgaactctcttcgtctttccaacaaacccaggaaggaggtactattactattgctgtttctgagatggggaaaacgaggcacaaggaagctaagtaactggtccagggtccttcacactagtaaaggggtacagctgggatttgcaccgtgctcctgagtccccgttcttaaccattctgtgtgctgcctctccaaggaagtggttgcaccagatcccctgattgaggctggccctggggacagtgaaacctcactcctaagacctcagtggggctacacct

SEQ ID NO: 176877 - DNA, 601 bp, Human
tgtggcctggggcaagttatttaacctctctgaggcccatgcgcctctcctattaaaggaggtcaccagctccaaagtgtgtgcacctgtgggtgttaggccggttatgaggctgctctccgttactgagtggccagctccttaaggcagggagtgcgcttgctggggctccaatccccgggcctgtgtgtagccccgatctccatgagtgagagcaagacaagctcctcagaaaagctgcagctctcatctccctcccaggaggctgcctggctggcacagtggggacggagacggaggrgctcgcctccatccttgcagtcccctcacctcctctgaggcctggtgctgccgctgcagcagggactcgccaagctccaggcaggcactgaagttcttgctccgggtttcaatctctgcattgatgccctggtgatacttcatgagcagttccacagaggagacatccctgggggacaggaggacaagggaagaagggaactctgggtcactctggcctgcctctgtgtcccaaccagaggggcccacctccccctgcctgtgggagtgtgaccgtgctccctcctctctctctggccag

SEQ ID NO: 176878 - DNA, 601 bp, Human
cccacttctcattcatctctttcctcctggacatcacctgctgcagtttctcgcggatctatggggaggaaagggagaaaagctcaggcttggctcacccttcaccatctgaggcagtgcgcagatgggtcctgcaaagaatgccaggtttggtcctacagccctggcttcaagtcttggcccagctgcttgccagctgtgtggcctggggcaagttatttaacctctctgaggcccatgcgcctctcctattaaaggaggtcaccagctccaaagtgtgtgcacctgtgggtgttaggcmggttatgaggctgctctccgttactgagtggccagctccttaaggcagggagtgcgcttgctggggctccaatccccgggcctgtgtgtagccccgatctccatgagtgagagcaagacaagctcctcagaaaagctgcagctctcatctccctcccaggaggctgcctggctggcacagtggggacggagacggaggagctcgcctccatccttgcagtcccctcacctcctctgaggcctggtgctgccgctgcagcagggactcgccaagctccaggcaggcactgaagttcttgct

SEQ ID NO: 176879 - DNA, 601 bp, Human
ggaagcaaaaggtcctctgcgctcatgctcaggcactctgggccttcctgacgagggtgcccagtgtgagaagtcaaatgcaactggtcccaatgtcaggtttctgatgaaaggcaccccctactcccacttggcagagcattcagctccctggacacacggccaccactcacccagtctcctctgcgggtctctctgcaatctggcgttctttcagctcaagctagaggaggagaaggcccaggggtcagagcagccacagaggcgagttgtgttctcagacgatctccctctggatgcrgccctgcacccccacatgccctgacacttgttccttctagagtcagccccttctgtcctttgcattcggaggtcagtacttcctgccacttgtctttccttcccattgtcgctgctggccaagcctgtcacaccattctaagtacctaacaactggcctggagtccttacatgagacccctgggggcacagttgccaccctcctgagcctcccagcactgttccctgctcaccgtggtgggcttctccagggcagcaaagcgctctgcccagctggccgtggacttctcaaaagcctcat

SEQ ID NO: 176880 - DNA, 601 bp, Human
tcccagccccctcctcccgcaccaggccttcagcccgcctgtgactggggaagcaaaaggtcctctgcgctcatgctcaggcactctgggccttcctgacgagggtgcccagtgtgagaagtcaaatgcaactggtcccaatgtcaggtttctgatgaaaggcaccccctactcccacttggcagagcattcagctccctggacacacggccaccactcacccagtctcctctgcgggtctctctgcaatctggcgttctttcagctcaagctagaggaggagaaggcccaggggtcagarcagccacagaggcgagttgtgttctcagacgatctccctctggatgcggccctgcacccccacatgccctgacacttgttccttctagagtcagccccttctgtcctttgcattcggaggtcagtacttcctgccacttgtctttccttcccattgtcgctgctggccaagcctgtcacaccattctaagtacctaacaactggcctggagtccttacatgagacccctgggggcacagttgccaccctcctgagcctcccagcactgttccctgctcaccgtggtgggcttctccaggg

SEQ ID NO: 176881 - DNA, 601 bp, Human
tcttcagaagggagccaggttccaggcagaacagcctgtggggccccgtgttcaggtggctccgaggtggggcctcgcctggcagccactgctcccagccccctcctcccgcaccaggccttcagcccgcctgtgactggggaagcaaaaggtcctctgcgctcatgctcaggcactctgggccttcctgacgagggtgcccagtgtgagaagtcaaatgcaactggtcccaatgtcaggtttctgatgaaaggcaccccctactcccacttggcagagcattcagctccctggacacacrgccaccactcacccagtctcctctgcgggtctctctgcaatctggcgttctttcagctcaagctagaggaggagaaggcccaggggtcagagcagccacagaggcgagttgtgttctcagacgatctccctctggatgcggccctgcacccccacatgccctgacacttgttccttctagagtcagccccttctgtcctttgcattcggaggtcagtacttcctgccacttgtctttccttcccattgtcgctgctggccaagcctgtcacaccattctaagtacctaacaactggcctg

SEQ ID NO: 176882 - DNA, 601 bp, Human
tgaccggggacgttctctcggtggccgcatggtgggaaactggagcctcccctgctgtctcgccttcctcctcttgaggcctaaggaagacacagtctctctttagaaacaagcacccctctgaggccagtgcctcctgcgaggcctggcttttcacctgcgcccacagggaggagcaccaaatagctccccctccagtcagccggcagcctggatggtgcttggcaaggagccgcccagcgacttcttcggaaaagccaaggcagattcttcagaagggagccaggttccaggcagaacrgcctgtggggccccgtgttcaggtggctccgaggtggggcctcgcctggcagccactgctcccagccccctcctcccgcaccaggccttcagcccgcctgtgactggggaagcaaaaggtcctctgcgctcatgctcaggcactctgggccttcctgacgagggtgcccagtgtgagaagtcaaatgcaactggtcccaatgtcaggtttctgatgaaaggcaccccctactcccacttggcagagcattcagctccctggacacacggccaccactcacccagtctcctctgcgggtct

SEQ ID NO: 176883 - DNA, 601 bp, Human
tagaacaggtgaggtggcaggactgggcgaggcgcccgcgcgatgtgttctgggagcgcgagtcccgttcgtagggccgcccgggtgcggaactcaccggggaactacgactcccacagcgcaccgcggtgcctttcctctgggaagctccgggcgcccaggcttgggcttcgtcgtggagcgtttgcgcggccagcttggggaagggtcgtttcaaggttgggcttggaggagagggcagtagccgagtcccctctgccctaaagaacgagaagaatcgtgttctatgcctggaggacaraggcagcccgtgcgggtcggacagcccactctgttctgccagtacttcgggaggttctggggtgcatagtgcacttttcccaacctgccctcagcttctggaggcagagagcagggccaggctgctgtcatgccgtttcacgatctgtttaatttttgacctacagtgccaggtttgggggcccgcctcgtgggtgggcattttggtagtcattcagccatttgagcaccagctacgtgtcggacacaatattaaacgatggaagtacaaggaaataaaacagctcctgaccaggagcct

SEQ ID NO: 176884 - DNA, 601 bp, Human
ccctatcagggtattaagaggcaggtgatgtgctggcttcaggttcgggcagtgggccaccacatatcctaaggagggaccagcggaacagaatcctgacctgctgttgacttatttcagcttataggatccaaaatattagtaaatggaggtggaacaaatcactaaatatgataaaacttcccaactttttatgcctctgatagaagggactggagctctgcttggttaggtggtcagtaggctagctttctgaatccattttattttattgaaattcagcatataccatattgcccawgtgtaaagtaatcctgcatatcaaaatttccccattaaaaagtccaaaaggttgtttttggtcaagttgaaaatacatgtacttttaggtatataagtgaaaaatacctgcttacaaaatttacatttaaatttgggtccatatacctacttaaaatcacctactttataaagtaacactaatttagaaatgctggttttcctcctcttcttatttataaaatgtttcttttcagactcttcacatgcatctttgacttcactatttttatcatcactggagccactttttgagtcagcc

SEQ ID NO: 176885 - DNA, 601 bp, Human
taaataatgggagagctggccttggaacctaacagttaggtataacattgtgttgatgggaaaacaaataaggtctaaaaaccaatgaactttgagaacacagcttctgcgtatgttgtggcctgcctatctaagtaggtgtaggggatgaggtatcacaaaactaagcactttgaaatccttttcctttatttttctaagaaatttatggttaacaaaagtataataatgtaattaagagccatttttctataactgagaattaacatttgctaacatctttttttttttttttttttttgcttctggttatttgtttaaaggaaaagcaattagaaatatagccaaagcctcctttaaccctatccccagttcagtgtgcctgccacccttcccagaagcagcccttatcataagttgtgtgtgcatccttccacttcacttttaatccttttatgcattcataaacaactggatttgtgtttttaaaaattcacataaattgtcacactgtcattttgccttttttcatttcacagtaaaaaaaaaaatagaaacagagtcttgcttgatcagttggagtcttgtcagatttctctga

SEQ ID NO: 176886 - DNA, 601 bp, Human
gcatttctgactggctgactccacacagacaggtcctgtggccccacccacaggctgactcagtgccggaggaccatcttccttccacatccctatgatttcatccccaaccagtcaacattcccattccctaaccccctgcccaccaaactatccttgaaaaacctccaaacctttgggaaaattgatttgagtaataactctgtctccagtgtggtgttgccagctgcatgtcagttaaagtcattctttattgcaaggctgtggtcttagtgaattgattgtgtctgtgcagcaagcyggaagaacccgttgggcggttacaaaatgagtaaatctcaaagaggtggcatagacttcaggtttaactacagtgttcaactgaaacaaagaaggatgttggggaggcccggaatggggaggtgaccgggaaaagcacagtaaacaaggataaggtttgttatgcaggtttaggcaggtgccttctccattggtaagagttcctagtggcttagagtcatccttgtctccctggtacagaaagagaggcaaatggagatttccttttatagatgtaattttcccttacaaatgaggtaac

SEQ ID NO: 176887 - DNA, 601 bp, Human
tctggtctcctgcacattcaaaatgttaggttatttagagaatttttgtttgttaaacatttaaaaggtttgttatctttgtttatcctttactagttgagaagaaaagtacgttactgtttttaaattatgaatgaagaaagtactatttgaggtaaaactttgcgcatcaacctctgagctgaaatttagtgactattgccactactaaaaatcttgttttatcaaaccttcaacctaaattaacagacagaggctctctaaaagaacatgacacttatttgggaatagtgtattgcartgggaatctttgtgccacagtaaactatgtgcatattcaaggaggtaaaggaagacaaaggtttttcaaggaataatgaggattatataattcttttaagataattattattggctacaaggatcagtaacaagtgtgaccagtctgagattggacaggcaattgctggacagatgtccttgtggagatattttttgtgtaaggttgtgatgacctttgtgcaggattgtggtttttgcagagtcatttgggatagtttttgttaatcaggcattgatgcatgagaaccctctcttcata

SEQ ID NO: 176888 - DNA, 601 bp, Human
ggaaaaaagattgtgtctgtactgaataagtacagacttattttcttgttattatgtcaatctaaaaggaagaagctcaggcaaagttaatgtaagtagagagtttatttgggccaagcttgaagattgcaacccaagagcatagattcaagttgccctgaatatacactctaattagcagcagttacaagtaggtttttaaaggacaagaatagttacccagggccaggtgaggtggctcacgcccgtaatcccagcactttgggaggctgagaccggcagatcacgaggtcaggagatygagaccatcctggctaacatggtgaaaccccttctctactaaaaatagaaaaaattagctgggagtggtggcacactcctgtagtcccagctactcgggaggctgaggcagaagaatcacttgaacccaggaggtggaggttgcagtgagctgagatcgcaccactgccctccagcctggcagagccagactccgtctcaaaaaaaaaaaaaaaaaaaaaaaaaagaatagttacccaaaaagctggctgaaagaaaagcaaaagaaaagaagaggcgattcctaaattgtttaccaaga

SEQ ID NO: 176889 - DNA, 601 bp, Human
tgtcaatttccctcaaaaactggtatactctgttttcagagtttctcctgtagctgcagtttctcaaaataatccttatgctgttgaggcatattttggggtggcatatgctctcccacacaagcaagagacatctgtcttcatctgctcccagagtaactggtgccagggaaccaaacaccaaaactgccattagtttggatattatggatttggtttctggaaaagtccattgtgatgccagcatggtacaggggattccctctcgccttgtcctaagcctgtcatcctgcagaacccrtcttacagtactgtgaagttccagaccataccaaccaaccctcgccaataggcatttgtggcaataggaagaaaaagctgatggaggtctcatctgtatttgttttctctctcctatctcctgcatccttaccaggcaaaagtagaagaaaagatccaagaggtcttcagttcttacaagttcaaccaccttgtaccaaggtaagctgtggttaggagtttgaggggatctgggagaacaccaccatgcagcagcctttcttctttcctccttgagcgaatctaaccacggggagcatct

SEQ ID NO: 176890 - DNA, 601 bp, Human
gaaaaaatttattatttaatttgaacctttattttctcttccagtgttttgtaatatgtcacactagaatttcataaggttatttcattcttgtattagtacttctcatgcagtcagagtctttttttgaaaccattatttgttatatttccagccatcagaattgatcagtagcctaaaactgtgtggtcaccattttatcttaatgatggaacactttctcttcctttcttttctttctttctttctttctttctttctttctttctttctttctttctttctttctttctttctttctctctctctctctctttctctttctttctctcctctctctttctctctccctctctctttctgtctctgtctttctcactttctttcctttctgtctgtcttgtcttgtcctgtcctgtccggtcctgccctgccctgccctgtcttgccctgtcttgctctgttgcccaggctggagtgcagtgccctgatcatagcccacagcagccttgaattcctgcgaatcctttcagtgcagcctccgcagtagctgggactatgggaacacatcactatgcctagcttattttatttttgtttt

SEQ ID NO: 176891 - DNA, 601 bp, Human
tttattatttaatttgaacctttattttctcttccagtgttttgtaatatgtcacactagaatttcataaggttatttcattcttgtattagtacttctcatgcagtcagagtctttttttgaaaccattatttgttatatttccagccatcagaattgatcagtagcctaaaactgtgtggtcaccattttatcttaatgatggaacactttctcttcctttcttttctttctttctttctttctttctttctttctttctttctttctttctttctttctttctttctttctctctctctctctctttctctttctttctctcctctctctttctctctccctctctctttctgtctctgtctttctcactttctttcctttctgtctgtcttgtcttgtcctgtcctgtccggtcctgccctgccctgccctgtcttgccctgtcttgctctgttgcccaggctggagtgcagtgccctgatcatagcccacagcagccttgaattcctgcgaatcctttcagtgcagcctccgcagtagctgggactatgggaacacatcactatgcctagcttattttatttttgtttttattttt

SEQ ID NO: 176892 - DNA, 601 bp, Human
tattatttaatttgaacctttattttctcttccagtgttttgtaatatgtcacactagaatttcataaggttatttcattcttgtattagtacttctcatgcagtcagagtctttttttgaaaccattatttgttatatttccagccatcagaattgatcagtagcctaaaactgtgtggtcaccattttatcttaatgatggaacactttctcttcctttcttttctttctttctttctttctttctttctttctttctttctttctttctttctttctttctttctttctctctctctctctctttctctttctttctctcctctctctttctctctccctctctctttctgtctctgtctttctcactttctttcctttctgtctgtcttgtcttgtcctgtcctgtccggtcctgccctgccctgccctgtcttgccctgtcttgctctgttgcccaggctggagtgcagtgccctgatcatagcccacagcagccttgaattcctgcgaatcctttcagtgcagcctccgcagtagctgggactatgggaacacatcactatgcctagcttattttatttttgtttttattttttg

SEQ ID NO: 176893 - DNA, 601 bp, Human
atttaatttgaacctttattttctcttccagtgttttgtaatatgtcacactagaatttcataaggttatttcattcttgtattagtacttctcatgcagtcagagtctttttttgaaaccattatttgttatatttccagccatcagaattgatcagtagcctaaaactgtgtggtcaccattttatcttaatgatggaacactttctcttcctttcttttctttctttctttctttctttctttctttctttctttctttctttctttctttctttctttctttctctctctctctctctttctctttctttctctcctctctctttctctctccctctctctttctgtctctgtctttctcactttctttcctttctgtctgtcttgtcttgtcctgtcctgtccggtcctgccctgccctgccctgtcttgccctgtcttgctctgttgcccaggctggagtgcagtgccctgatcatagcccacagcagccttgaattcctgcgaatcctttcagtgcagcctccgcagtagctgggactatgggaacacatcactatgcctagcttattttatttttgtttttattttttgtaga

SEQ ID NO: 176894 - DNA, 601 bp, Human
gaagcagttgttttttgagagtggtggtagatgatattaaaggagtgaaatcccctgattcatagctggtaggtcaagtatgggtgggaaaaaaaaagtgttcctcctgggctcggatccttgtggaaatagaatatatcagggctctgggttagtttcaggaatttcacaattacccgtttttatcattgttgcctatgaaattgagtgttttaaaggatgctaattaatattggagatactatacattttggctgaatggctgagtatataattcaacatatcaatataaggctgaagscaaacatcaccatcatagaataagcgaggatataagaataaattagaaaatttatcagaattttaaatcattatcacagtctcaatatttaacatattaatagtcaaaatttaaaagtctgacactttaatacaggaagtaaccttcactgttagctgaagtgcatggttagctgttagcagtaaatctagatggcagggcttgtttgtgtgtctgaggtcatgatgctgatcaaatgggacagactcacacacatgcccaggaccacagaccacgcacaggtccagggatgcctgtgat

SEQ ID NO: 176895 - DNA, 601 bp, Human
gcaggcagcataaatcagtgaagtgggctgcatggagactgaggctaactggagaccctgtgcccttaacttctttcctgcccattactgccatctgggaatgcagacccagggttgccaaatcatctttgtttccttttttttttttcttcctccaaatgaagccggaaatcacgttttcatgtgactctcctgacaaatgttgcagctactaccagttaaacaatacacatccatgggctagatttggcctgtgggctatgaattttcaatccttgactcaagtcctcaatagttatgytacagttggtaccatatcagctaacaatttattgaacagtgtgctgaaagcttaccatgcattctctcataatttatgagatggagtctcgctgtatttcccaggctggagtgcagtggcatgatcgtgagtcactgcaacctccgcctcaggttcaagcgattctcttgcctcagccttctgagtggccaggattacaggtgtgcaccatcacgcctggctaatttttgtatttttagtagagacagggtttcaccatattggccaggctggtctcgagctcctgacctcaagtgatcc

SEQ ID NO: 176896 - DNA, 601 bp, Human
gcttaccatgcattctctcataatttatgagatggagtctcgctgtatttcccaggctggagtgcagtggcatgatcgtgagtcactgcaacctccgcctcaggttcaagcgattctcttgcctcagccttctgagtggccaggattacaggtgtgcaccatcacgcctggctaatttttgtatttttagtagagacagggtttcaccatattggccaggctggtctcgagctcctgacctcaagtgatccacctgcctcagcctcctgaggctctggggttacaggcgtgagctactgcrcccagttgcattctcttatttaaatcttgtaactacgtgaggtagatcaatctcttgttttttgcagataatgaaatgggcatagtaaaattaagtcatttgctcaaaggcacatagcgagtaagatgaggagctgggattcaaacttaagctgcatccctggcagtgtcttcagtagctcaccagcctaccttccaggtggtgggttagccacagcttgggatatcagcatagttttgaagagagcagcttgggccaacggaaagaacactggattgactctaaaaacctaggttcttg

SEQ ID NO: 176897 - DNA, 601 bp, Human
tctcgctgtatttcccaggctggagtgcagtggcatgatcgtgagtcactgcaacctccgcctcaggttcaagcgattctcttgcctcagccttctgagtggccaggattacaggtgtgcaccatcacgcctggctaatttttgtatttttagtagagacagggtttcaccatattggccaggctggtctcgagctcctgacctcaagtgatccacctgcctcagcctcctgaggctctggggttacaggcgtgagctactgcgcccagttgcattctcttatttaaatcttgtaactacrtgaggtagatcaatctcttgttttttgcagataatgaaatgggcatagtaaaattaagtcatttgctcaaaggcacatagcgagtaagatgaggagctgggattcaaacttaagctgcatccctggcagtgtcttcagtagctcaccagcctaccttccaggtggtgggttagccacagcttgggatatcagcatagttttgaagagagcagcttgggccaacggaaagaacactggattgactctaaaaacctaggttcttgtctcacctctgacatttgctatttttataatctgaaa

SEQ ID NO: 176898 - DNA, 601 bp, Human
tagtcccagctacttaggaggctgaggtgggaggattgcttgagcccgggaggttgaggctgcagtgagctgagatcataccactgcactctagcctgggtgacagagcgagaccctgtctcaaaaaaataaacggtagaaaccaaattttattatcatccccccagtgtctaatacagtgcttggcacaagtagatactatcaaatatttgttgaatcagtgattgagttaagctaggaaatctcttcagagaatgtatatctccttggttctataccgagaaaatagcagcccctaacstcctggcctgtaggaagtcctctgctcagccttccttagatgcctgccagggagggatccactgggttcagggtcatcttttttttaatcctgttgtcttttttttcttttctttcttttttttttttgagacggagtcttgctctgtcgcctaggctggagtgcagtggtgccatctcggctcactgcaacctctgcctcccgggttcaagtgattctcctgcttcggcctcccaagtcgctgggattacaggcgcacatcactatgcccagctaatttttgtaattttaatagagaca

SEQ ID NO: 176899 - DNA, 601 bp, Human
acacagtttctgcagtaacaggaatttaattgtcaaagaaaggcccacgtggttttttttttttttttttttgagacagagtttcactctgtcacccaggctggggtgcagtggcacagtctcagctcactgctgcctctgcttcccgggttcaagcgattctcctgcctcagcctcctgagtagctgggattacaggcacccaccaccgtgcccggctaatttttgtatttttagtagaggtaggctttcaccatattgaccaggctggtcttgaactcctgacctcagctgatctaccygcctcggcctcccaaagtgctgggataacaggtgtgagccaccacatccagcctcgtgtgtttttgaaataccagctcgggggcctggggattgtttgggaagttttcccttcactcctacacaatcaggatatttggaaagttttcccttcactcttgcacaatgggaaagttgggtgtgagagaagaaagaaaaaatggggatttctgtgagcctggatctgaacgctggatggaggaggccgcagacccatgaaaaactggaagagagaatcacagggggtgcctgaggtggaagaa

SEQ ID NO: 176900 - DNA, 601 bp, Human
gagagaatcacagggggtgcctgaggtggaagaactcgagccaaaatcgactgagtttttttctaggctgtgtacttggtgttttatagtgaaggcttttctgaggaagtgtcagcgccgcttctggggcaatgtcacataggaagagaggagcctttaaagggcctttcattggaagcaatctaaattaaatatcaacagtagagaatgtttaaaaaaaattttttttaaatgtaaagctgggtgtggtggctcacgcctgtaatcccaagcactttgggaggttgaggtgggtggatcrcttgaggtcaggagtttgagaccagcctggccaacatggtgaaaccccatctctactaaaatacaaaaattagctgggcatggtggtgcatgcctgtcatcccagctactcgggaggctgaggcaggagaatcgcttgaacctaggaggcggaggttgcagtgagtcgagattgcgcctttgcactccagtccgggcaacagagtgacactccatctcaaaaaaataaataaataaaatacataaatttaaaaaataaaacataagtcatttatggtgcagtacattctgtgaaatacta

SEQ ID NO: 176901 - DNA, 601 bp, Human
ggctgggcacggtgtctcacacctgtaatcccagggcttggggaggccaaggtcggcagatcacctgagatcaagagttcgagaccagcctggccaacatggggaaatcttgtctctactaaaaatataaaaattagcctggcttggtggtgtatgcctgtaatcccagctactcgggagactaaggcaggagaattgcttgaatctgggaggtggacgttgcgacgagccaagatcatgccactctactccagcctggaggacagagtgagactctgtcttaaaaaaaaaaaaaaaaaaaggccaggcgcggtggctcacacctgtaatcccagcactttgggagaacgaagtgggtggatcacctgaggtcgggagtttgagaccagcctggccaacatggagaaaccccgtctctactaaaaatacaaaattagccaagcgtggtggcgcatgcctgtaatcctactcaggaggctgtttgtttgttttttgagacaagagtctccttctgttactgcactcccggctcctactcaggaggctgaggcaggagactcgcttgaacccgggaggcggaggttgcggtgagccaagattg

SEQ ID NO: 176902 - DNA, 601 bp, Human
gagactctgtcttaaaaaaaaaaaaaaaaaaaggccaggcgcggtggctcacacctgtaatcccagcactttgggagaacgaagtgggtggatcacctgaggtcgggagtttgagaccagcctggccaacatggagaaaccccgtctctactaaaaatacaaaattagccaagcgtggtggcgcatgcctgtaatcctactcaggaggctgtttgtttgttttttgagacaagagtctccttctgttactgcactcccggctcctactcaggaggctgaggcaggagactcgcttgaaccygggaggcggaggttgcggtgagccaagattgcaccactgcactccagcctgggcaacaagagtgaaactccatctcaaaaaaagaaaaagaaaaagaagaactttctggctggatgtagtggctcatggctgtaatcccaggactttgagaggctgagacaggcggattacttgaggtcaggagttcgagaccagtctggccaacatggtgaaaccctgtctctactaaaaatacaaaaaatagccagatgtggtggctggcacctgtaatcccagctactcgggagactgaagcaggag

SEQ ID NO: 176903 - DNA, 601 bp, Human
ctgtagtgcagtggcatgatctcagctcactgcaacctccacctcccgggttcaagtgattctcctgcctcagcttcccaagtagctaggattacaggggtgtgccaccacgcccagctaatttttgtattttgtaaagacaggctttcaacatgttggccaggctggtcttgaactcctgacctcaggtgatacacccgtcttggcttcccaaagtgttgggattacagatgtgagccaccgcacccggcctagcttccctcttttaagaggttatatgcacacatttatatgtgtttayctaaaatgaattaatattttggaactagactaagtacatttgctttgcttaatggttttggcactgaaggaagcatcctctaatgagaatcccattctttgttactgaaagcagcttcagtgaaacagagcaaaataaaattcacagggagaccatcgcactgttaaagttatgtttttagcttctgtaagatttaaaaattgcctttaacttaaaaaccattttaggacatttcagcttgtaagatttttccaaagataaattcaaattttgctatttcagtgttttatcctttccctt

SEQ ID NO: 176904 - DNA, 601 bp, Human
gagacttgccggtgcttgatgaagagtcaaataacacgtctgactctgtgagcagcagaggccacccggaatcaacaagagatgctgcccgtcttcacctgtccattgtcatattctacctagggaaggagatttcctcttcactatatcaagctgaagctgttttagttagtacgagaacaagcttgatgtgatgccagctcatgcatcttgcatttacatcccctcctaagccgttctgcccatggatgactgttcctatttccaaagctgtaatctttttttctgtttttttttttttaaacctgcccaattgtgcagaacatagctataatttttataacttatcctaggccttaagtctgtctatgatagcctagtctagtgctgaagttttttatgtaacctaaatacttcttgctacaaattagtctcagtttttacctactagaatgtttatgtaattatcctttgtatatttgaggtattttgctgggtagctttctcactgtgattgtctgtaatattaagctttttatattattttaaaaatagagataaggtctcgctgtattgcctaagctggtctcaaactcttggc

SEQ ID NO: 176905 - DNA, 601 bp, Human
gactctactaaaaaatacaaaaattagctgggcgtggcggcatgcacctgtagtcccagctactcgggaggctgagggaggagaatcacttgaacccaggaggcagagcttgcagtgagctgagatcgctcaactgcactccagcctgggcgacagagggacactccatctcctaaaaaaaaaaaaaaagaggactctcagacccatctagttctactgaattagagctgcagtttagcaagatccacaggtaatttctatgcaactcaagtttgagaagcactgatacctggctgaacaytggaatcacgtggggagtttaaaaaaaatactgccacctgggtcccacccatagtgattccggtttaattggaattaggtgtggcttgggtgttgggatttttttaaaacaccccccaagtaattttagttgtgcagcaaggactagtgatggctcaagctttgcatgtatctgaatcacctgagaatttggtaaaaatacaaaggcccaggatcttttccacctcagcaggactgggtctctgtattcttttattagctttctacagattctgatgcacacattttgggtttgaagatc

SEQ ID NO: 176906 - DNA, 601 bp, Human
cacgtggggagtttaaaaaaaatactgccacctgggtcccacccatagtgattccggtttaattggaattaggtgtggcttgggtgttgggatttttttaaaacaccccccaagtaattttagttgtgcagcaaggactagtgatggctcaagctttgcatgtatctgaatcacctgagaatttggtaaaaatacaaaggcccaggatcttttccacctcagcaggactgggtctctgtattcttttattagctttctacagattctgatgcacacattttgggtttgaagatccatgatrtagaagatagtttcccactttgctggtaattggcacgtaagctagaatgaaatgccttgctgacgttaaagaaaattgatgtattgcagctttcagtcatattctaaaggaatgattttgtgaatacttgtttttcacaaaatgtgccacttggtgtttgtacaatgttttttgcttgtaattttttatttattggtgaacttcttgtctctatgataagtttttctccccctacatttgtgggaaaaaaaaatatttttttgtagagctggggtctcactgtgttgcccaggctggtct

SEQ ID NO: 176907 - DNA, 601 bp, Human
atcagtatgtgttgattcttcttaaggaaaatgttaaaagagtttttttccctcgtgttcactacattttcgttcctgttctgttgctattcccccaaaatatgcacagtcttgaaacgcagcttttaaaaacctactaagattattaggcaaaagcaaacaaatcatagcaagatccttttggtattttatcatataccttttgcagctgtgattatttgctatcttattcattccagcactttttttttccctatgctctttatttatatgttctagataaatgctaggaaacttctccagtaaggcagcttggttcccctgccgagcactgtagccatattcttccctgacctttgctctttgggtgatgctctgccattcgtgcccgtgctttctatttacataaaggattaaagatatgaatgatagagaaaagctagcagattgcatccattttccttgctttgcctggtttctagtaccccgattccatcatttttcacttggcatttctttcattgtcctttgcctggaagcatcagccagtcctcaggagtgcttgtttgggtggatttgacttggagaaaagcagcagtga

SEQ ID NO: 176908 - DNA, 601 bp, Human
gaaaatgttaaaagagtttttttccctcgtgttcactacattttcgttcctgttctgttgctattcccccaaaatatgcacagtcttgaaacgcagcttttaaaaacctactaagattattaggcaaaagcaaacaaatcatagcaagatccttttggtattttatcatataccttttgcagctgtgattatttgctatcttattcattccagcactttttttttccctatgctctttatttatatgttctagataaatgctaggaaacttctccagtaaggcagcttggttcccctgccragcactgtagccatattcttccctgacctttgctctttgggtgatgctctgccattcgtgcccgtgctttctatttacataaaggattaaagatatgaatgatagagaaaagctagcagattgcatccattttccttgctttgcctggtttctagtaccccgattccatcatttttcacttggcatttctttcattgtcctttgcctggaagcatcagccagtcctcaggagtgcttgtttgggtggatttgacttggagaaaagcagcagtgatgggagagtttgacatctggagacta

SEQ ID NO: 176909 - DNA, 601 bp, Human
gtggtatagttgcatcggaatataatgtagcagtgaaaatgaatgaactagagttacatgtatcaatatggaaaaatctctatgttgagttgaaagaatgaaaagaaaaaaatacaaaaaaaccatacagattagcacatttacttaaaatttgaaacatgcaagagaattctgtattgtttctgagaagaatcatgtggtaataatataaaaacatgtatacgaaagataaacaccaaatttagcatagtgattcccgctgaggggagagcaaaggaaatgagataagtctgcataggaracttcagctgtaatagttaacaacaacaaagacctgaagtgtatatggctaattctaagctaggtcttagatacgtgtatgttctatattttgtttgctgtactttcctggatgctccaaatatttcatagtttaaaaaaagcaggccaggtgcggtggctcacgcctgtaattccagcactttgggaggccagggcaagcggatcatgaggtcaggaaatcgagaccatcctggctaacatggtgacaccccgtctctactaaaaatacaaaaaattagctgggcatggtggcgggcgc

SEQ ID NO: 176910 - DNA, 601 bp, Human
agtgattcccgctgaggggagagcaaaggaaatgagataagtctgcataggagacttcagctgtaatagttaacaacaacaaagacctgaagtgtatatggctaattctaagctaggtcttagatacgtgtatgttctatattttgtttgctgtactttcctggatgctccaaatatttcatagtttaaaaaaagcaggccaggtgcggtggctcacgcctgtaattccagcactttgggaggccagggcaagcggatcatgaggtcaggaaatcgagaccatcctggctaacatggtgamaccccgtctctactaaaaatacaaaaaattagctgggcatggtggcgggcgcctgtagtcccagctactcgggaagctgaggcaggagaatggagtgaacccaggaggcggagcttgcagtgagccgagatcacgccactgcactccagcctgggcgacagggcgagactccatctcaaaaaaagaagcaaaaggtatagtagacacatatatactatgatggaatgatagccaagctgagatactgttttagttaaaaaaattttatttttatcaaagtagtatgtattaccatataaa

SEQ ID NO: 176911 - DNA, 601 bp, Human
catggtggcgggcgcctgtagtcccagctactcgggaagctgaggcaggagaatggagtgaacccaggaggcggagcttgcagtgagccgagatcacgccactgcactccagcctgggcgacagggcgagactccatctcaaaaaaagaagcaaaaggtatagtagacacatatatactatgatggaatgatagccaagctgagatactgttttagttaaaaaaattttatttttatcaaagtagtatgtattaccatataaatataatttacagtgataccagatgatatgctgagatcrtgtttacttttttgtatgagtttcattttcctggagttaatggatatatcatgaatgtacttatgaattccttcccaaattgtctgtcagagctataaaaaattactctaaacatagtcaaacccttcaggtaacctgtctctgtgcacacgtgcgttttgagttgccccttctggagccctctgccctcctgcttcagtctggacagattgctctcagcttgctacacagcaggcatcccgaagcttcctttcagcatgaaattcacttcatttctctccttcgttgaagtccctgtcc

SEQ ID NO: 176912 - DNA, 601 bp, Human
tcatgcagcagctcagagctcagttcttgcttagaagttgctttgtttccccagcacgtatgtggaaacttgaactgagtttaaatgcagaatttgggatttttcttctttgactttcctgtttctggattcgtcctcagtttctggcagcctgcatcttcctgccagaaggatggttggcttcccattagagtgttggctgcccgccctgacccctgacccctggcctgctgctgccgccctgggctatggctgccatcctgagggcaaaccagagagaaaaagttgtgggggaagggasggactaactgcatgctgttctctgttccaagtttcaaactccaccaaaatctgcctgccctttttcagtcagctgaaccctcaggaagctgtttttttgtattttgttcagtgtacagctgtcatttgcaggggggttgactggttaggcacagactagatacggaactcagacagcctgggtttgaatcccagttttgccctttctttcctcttctcttccttctttcttcctctatctttcaattctctctttctttttttgagacagagtcttgctctgttgcacgagctggagtgt

SEQ ID NO: 176913 - DNA, 601 bp, Human
cgccctgggctatggctgccatcctgagggcaaaccagagagaaaaagttgtgggggaagggagggactaactgcatgctgttctctgttccaagtttcaaactccaccaaaatctgcctgccctttttcagtcagctgaaccctcaggaagctgtttttttgtattttgttcagtgtacagctgtcatttgcaggggggttgactggttaggcacagactagatacggaactcagacagcctgggtttgaatcccagttttgccctttctttcctcttctcttccttctttcttcctctrtctttcaattctctctttctttttttgagacagagtcttgctctgttgcacgagctggagtgtagtggtgtgatcacagctcgctgcagccaccacctcctgggctcaagcaatcctcccatctcaacctcctaagtagctgggacaacaagcgcgtgccaccataaccagctaatgtttaaaaaaaaaatttgtagagatgggatctgtctgtgttgtccaggtggggcttgaactcctgggctcaggctatccacccaccttgacctaccaaagttcaaggattacaggcatgagcca

SEQ ID NO: 176914 - DNA, 601 bp, Human
aaccagagagaaaaagttgtgggggaagggagggactaactgcatgctgttctctgttccaagtttcaaactccaccaaaatctgcctgccctttttcagtcagctgaaccctcaggaagctgtttttttgtattttgttcagtgtacagctgtcatttgcaggggggttgactggttaggcacagactagatacggaactcagacagcctgggtttgaatcccagttttgccctttctttcctcttctcttccttctttcttcctctatctttcaattctctctttctttttttgagacmgagtcttgctctgttgcacgagctggagtgtagtggtgtgatcacagctcgctgcagccaccacctcctgggctcaagcaatcctcccatctcaacctcctaagtagctgggacaacaagcgcgtgccaccataaccagctaatgtttaaaaaaaaaatttgtagagatgggatctgtctgtgttgtccaggtggggcttgaactcctgggctcaggctatccacccaccttgacctaccaaagttcaaggattacaggcatgagccactgcgcccagctttttttttttttctttgaag

SEQ ID NO: 176915 - DNA, 601 bp, Human
ttaaacccctgagcttaagcaatccgcctgcctcagcctcccaaagtgctgggattataggcgtgagccaccacacccagcctttaaattttatattaagcagaaatacagagaaatcaaatggattccactgtgctgtactacctggcagtgccattgtgattcttaattctctgtatgtttttttcttctgtctctctttttctatccccatcctgtccttctttagcggcttggaatctttattctttttgtgtgtgatggagtcttgctctgtcacccaggttggagtgcagtggcrtaatctcagctcactgcaacctcaggtgcctgccaccatgcctgactaatttttgtatttttagtagagacagggtctcgtcatactggccaggctggtctcaaactcctgacctcaagtgatctgccctcctgagcctcccaaagtactgggattacagacatgagccacctcgcctggcctggaatgtttattcttgtttggaaacttgatgatgaatcttgatgtggattatttttattcattttgctgggcactcgatttggaagtgcatatactttagtaccaagattctttatt

SEQ ID NO: 176916 - DNA, 601 bp, Human
agagattctcttagtatttatcttctaatcctcttgtttttatttttgtaatcctatttttagttttcctccctgactacttttacttcctgactacttttttatctactctcttgttcttttctggggatattttgtcctctcaatagtcttacttcatataatattttatctaaagatacaactttaaaaagttttcttttgctccctgtcttatttcctccaatttatttttgtttgttttggtctcctctttcatagtagagactgtggtcaaatgtctggtactctacagctgtctgttcatatttaaggatccagcactgaaaagctgctggggagctctgcgagagtgggcaggatcaagccattcattggggaattctcaaagcagtgtctgtagggtttttcccttgggcttatcagttccctcagagaggaatcttctaaattcctgcttggggtatgaaactggcagccttgtgtgaaatacacagaggaatggggctgggggtattgtgttgagattactgactctcacgtaatcacatttggtacagtgctccctcctcctcttagcttgttggatattctggaactc

SEQ ID NO: 176917 - DNA, 601 bp, Human
acatgctggaagccctggttcatttaagatcaaccgaggatatattagtacctgaacctgcagtacagtgttttctgtctcttttaagcatttgtgactgtgactctctatgggcaggtgttgccttgaagagggaataatctaaacaacagcttttaggggagggctggcccccacttccatcaagggtcccagtggctcctttcaggacctttacctagtaagactctagaaacaggaagtaccctcccctgtaccctttcagttgagtgaggcagctctgtaagtccgtggctggaayggcctaggtggtctagggagggaaatggaaatgtcatatctgctcagccagttggttctgctcattctgagggaccaaacccatgactatcttgatctttgtagtagagtgtgtttagaaaacttgtagataagcaaggaatggtggtatcgtgtgtgaccgctgagtgacatcaagaccaagacctattttacagcttcaaagtaaaagattttcttatatcagccacagactgggcagagttgtcatttggtaattagaatgaatggcttctgctttcaggcctgctagtgacttgct

SEQ ID NO: 176918 - DNA, 601 bp, Human
gtgcagtggtgcaatctcggctcactgtagcctcctcggttcaattgattttcttgcctcagcctcctgtgtagctgggattacaggcgtgtaccaccacacccagccaatgttttctatttttagtagagacaggatatgactatgttggcctggctggtctcaaactcctggcctcaagtgatccaccttccttggccacacaaagtgctgagattacaggcgtgagccaccatacctggccaactttttagattttctatccttctgtattatactgtgcctttaaaaaaaaaaaaamcatgtgcattactaattttattttggtaaatgtacaaatacattttttaaaaggcattgatcatattgctaactaaaaagcaaaaagaatgctctacatagtgcagcacgtgggtctaggccatgccctgacccagcaagtgaccatcagtggctccatgccattgactaccttctatgtgtaaatgacagtatttgagtagaagaaggaattactattagtaccttaaaatgctggacatggtggttcatgaccataatcccagcactttgggaggccaaagcaggaggacctcttgag

SEQ ID NO: 176919 - DNA, 601 bp, Human
caaggggcaagtataagaaaaagctagattaataaaattggctattggatctcagaagattaggccaaacagacaccatcataaggaaatgcaaatattaaacacaagttatggaaaaatttcaccctaattagtaatcagaggcatgcaaatcaaaataaactatcaggtactatttctttttaccattttaattgctgataacttttaaaaagtaactaaagctggccgggcgtggtggctcacgcctgtaatcctagcactttgggaagccgagttgggcagatcattttaggagttygagactggcttgatcaacatagtgaaaccctgtctctactaaaaatgcaaaaattagccaggcgtgggggcttgtacctgtaatccaaggtactcaggaggctgagacaggagaatgacttgaacctgggaggcagaggttgcagtgagctgagatcacaccactgcactccagcctgggcgacagagcaagatagcatctcaacaacaacaacaaaaaggtgctaatgctggaggtggtatagcaaaattttaaattttgctggtagctatataaagtctttgtttttatttttagttt

SEQ ID NO: 176920 - DNA, 601 bp, Human
atgatacagttaccttatatgtccacttaatgaaatactatatggctattcacagtgatggctatgcagattatgtaatagaatagaaaatttatgcctatagtggtataagtgaaaaacataagctacacagttataataactaggtagaaaaacgcatagaaccaaaaagactggaagaaagaacaattagctttcaggtgccatttaccaattgttgggcatcttttttttaaaaatgatttattgtcaggcatcttttagcccaggtatcaaaatataaaattgaccaaggacttartgtacatcctatatgtatatatatttttaatcgatttctatgcagatgtttctgcacacctgtccgtgatttgtccctccttcccacttgataactgtgtggcccacagaattctttgaccatagtgattggacttcagagtgaagaagtccagttgcttgtcagtaccttagtagtattaccagaatacccagtttttgctagggtatcatatgatgcaggagggcagttactagtaatgtttcttaggtaaattctttgagctgagagacaagttagagaattccctttggagatcaa

SEQ ID NO: 176921 - DNA, 601 bp, Human
gactgtaatcatgacaactattatagagtggattaaatgattaagctcaaatctgagatggcttatgtgttagaaaaagggaaataaaataagtcctctcacctttgttacccaccctctgtcttcccccatcccagcacacgtcctgctgctcttggcatccaggggaaggcctggtcccacaatgtatcaggaagaatgtggcccatttctagatatttaggtatttttctagagaagtgtatcaatttatcattagtactgcccctggagagccctttccagaagacagctggagagrctgactttaaaattacagtttcctttaatagtttaaggtaaaaaaagaaagaaaagaaaaaaaatacagttcccactgctgggcagggctggaggatggggcttttattttattgtattttacttttttgagacagggtctcactctgtcacccaggctggagtgcagtgtcacaatcatgactcactgcagccttcacctcttgggctcgagtgatcctcctgcttcagcctcccaagtaactggaattacaggcatcggccaccacacctagctaatttttaattttttgtagagacg

SEQ ID NO: 176922 - DNA, 601 bp, Human
tctgctttcctgaaaaaacaatagccctatgagggcaggatgctcactgctgcagccagctgaggacaacctggaggtgctctgagcctagacgtgagcctggacatgaatccaatggagactgtccccagtgatcaaatcacagggcccatgcagactgtcatgaatttttgtgtgcagttccctactcttactaagccctacttccaccagtgtaaacatggcctgctgctaccatctaggtcactgccttattttctcatctgtgtcattgtaaccttccttttttgtttaaaaaaawtttttttttaatttttaatttttttttgtgagacaaagtctcactctgtcacccaggctggagtacagtggcatgatattggctcactgcaacctccacctcccaggttcaagcaattctcgtgcctcagcctcctgagtagctgggattacaggcatgcaccaccacacccagctaatttttgtatttttagtagagacagggtttccccatgttggccaggctggtctcaaactcctggcctcaagtgatatgcctgcctcagcctcccaaggtgccaggattacatgtgtgagccac

SEQ ID NO: 176923 - DNA, 601 bp, Human
ctctgtcacccaggctggagtacagtggcatgatattggctcactgcaacctccacctcccaggttcaagcaattctcgtgcctcagcctcctgagtagctgggattacaggcatgcaccaccacacccagctaatttttgtatttttagtagagacagggtttccccatgttggccaggctggtctcaaactcctggcctcaagtgatatgcctgcctcagcctcccaaggtgccaggattacatgtgtgagccaccacgcctggccccatctttgtttcttttaattgggaaacatttcaaatggaagaaacacaaatggccaatagatagttgaaaagatgctcaacctcattcttaatcagaaaaaccaccacccagcttttccaggccctaattatttccccctatttgcctcttatgtagccctcttccagttttttttcctccctccttctccagaggtaaccctgtcccaaatttgacatgtatcatgcctgtggatgtttttgtgctattgctacatacatatgtatctataagcaatatatagttttttataagcaatataacagttgcttgcatgttttcaaactttttg

SEQ ID NO: 176924 - DNA, 601 bp, Human
ccctccttctccagaggtaaccctgtcccaaatttgacatgtatcatgcctgtggatgtttttgtgctattgctacatacatatgtatctataagcaatatatagttttttataagcaatataacagttgcttgcatgttttcaaactttttgtaatggtacctactgtaccagtcattctgcattgctttttccacttgccattgtatttttgaggtttatctgtgttcacatgtgttgctccagtttattcattttaactattatatgatactcccttatataaatgtaccccagtgtrtttctctgttctcctgctagttatcaattttttgctattacagtgttgcagtgaacgttgtggtatctgtctcattgggttcacatgttagaatgtctccaggaggggacctgctgggttgaaggggacacatattgtcatctttgatagatacctctgtaactgctccccagtgtggttgtgtaagatgaatcgatccatagtcagaccttttcctttttgccaatttgatgggtgtgaagtggtatttgtttgattttgtgttttcctgattactggtgaggttgagaatattttcaa

SEQ ID NO: 176925 - DNA, 601 bp, Human
agagcctgagagcatcctggctttataacagcctacccttgcaggaactaatccattccctcaaggactaatccagactccccagagcaagagtgagagctcacgcactactgcaagaacagcaccaaggcactcctgagggatccacccctcaaacccaaacacattccacaaaccccacctctcaacatagccatcttggggatcagatttcaacattaatttttgtggggacaaataaaccacatccaaaccatagcattttgtttttggtgtttttttgttaaatagaagattttargccagatatggtggttcgcacctgtaaacctagcactttgggaggctgaggtgggagaatcgcttgagcccaggtagtcaaggctgcagtgagctctgtttgctccagtctgggagatagagtgagaccctgcccccagcaccccttccccacaaaaatattttaatattttaattttgaagtggtcaaatctatttgtcttttctgtcattcaggggtttgtttttgggggagggtaggtgaggattaacttaaggaatctctaccattttttgagggaagcagacaaaaggaggcaca

SEQ ID NO: 176926 - DNA, 601 bp, Human
ccttgttgtttttcttcaaaattgccttggctattctttgccttttgctttttcctgtgaattgtaggatcagcctgtcaagttctaatgggatttttattggaattgcactacattttagattaataggagagaaccaacttttttttttttcttcctgtcttcccaggagtacaaagagaactgacttcttttcaatatttaggcttccatttatgaacataatttttcttttctttaatgtctttcagtgttttttttataattttttccataaaggactagcattttttttttttcrgttagagttatgtctaatttacagttttcatgtctcttgtgactggaatcttttcttattttcagttttgtaactgtttgttactagtgtatagaaatgctaataatatttataaatcttgtgtccagccaccttgttgaactctttaatagttttaagtttgtctaagttagtttccattttatttttcttgccttgtattgttgggtaagatccccacatagtgctgactaaaggtagtagagggcattcgtctcttgctcctgattataatgggaaggctttttataacctgatcat

SEQ ID NO: 176927 - DNA, 601 bp, Human
caggataagcccttcttggtcatagtagaggcagtgtgtctgtgtctgtgtgttttgttcagtatactgctggattcagtttgccagtatgtttgcctagtacttttatttaggatttttttgcatgtacattcataagaaagattgatctaaaattttattgtattgtccttttccagtgtttcaggataatatcatagcctcataaaattaaatgggtagcttcctgcacctcttaccttttttctttttcttttctttttcagagacatgatctcactctgtcactcatgctggagtrcagtgctgtgatcatagctcactgcagcctggaactcctgggctcaagctatcctcctgccttagcctcccaagtagcagggactacaggtgcacaccaccagaacctgctaatttttaaattttttgtagagacagggttttgctatgttgcctagtctggtcttgaactcttggcctcaagctatcctacctcagccacccaaagtgctgggattataggtgtgagccattgtacctggcccccgcactagcccctttttttttttcagtccttaaaaggtttgtatagatcagagat

SEQ ID NO: 176928 - DNA, 601 bp, Human
ctgcacctcttaccttttttctttttcttttctttttcagagacatgatctcactctgtcactcatgctggagtacagtgctgtgatcatagctcactgcagcctggaactcctgggctcaagctatcctcctgccttagcctcccaagtagcagggactacaggtgcacaccaccagaacctgctaatttttaaattttttgtagagacagggttttgctatgttgcctagtctggtcttgaactcttggcctcaagctatcctacctcagccacccaaagtgctgggattataggtgtragccattgtacctggcccccgcactagcccctttttttttttcagtccttaaaaggtttgtatagatcagagattatctgtttctttgtaggtttgatactacttgcctgagaaaccatctaggtctagtatcttttaaggtatgtgggggtggcagaataagcaattgttgttactaatttcttcatgtaggcctttaaaaattccttaagtcaattttggcagttttcctggtttttaaaaattattgttttatctgaatttttgtatgtttcagcatgaggttgctcctagtattct

SEQ ID NO: 176929 - DNA, 601 bp, Human
gcacctcttaccttttttctttttcttttctttttcagagacatgatctcactctgtcactcatgctggagtacagtgctgtgatcatagctcactgcagcctggaactcctgggctcaagctatcctcctgccttagcctcccaagtagcagggactacaggtgcacaccaccagaacctgctaatttttaaattttttgtagagacagggttttgctatgttgcctagtctggtcttgaactcttggcctcaagctatcctacctcagccacccaaagtgctgggattataggtgtgarccattgtacctggcccccgcactagcccctttttttttttcagtccttaaaaggtttgtatagatcagagattatctgtttctttgtaggtttgatactacttgcctgagaaaccatctaggtctagtatcttttaaggtatgtgggggtggcagaataagcaattgttgttactaatttcttcatgtaggcctttaaaaattccttaagtcaattttggcagttttcctggtttttaaaaattattgttttatctgaatttttgtatgtttcagcatgaggttgctcctagtattctct

SEQ ID NO: 176930 - DNA, 601 bp, Human
tttttcagagacatgatctcactctgtcactcatgctggagtacagtgctgtgatcatagctcactgcagcctggaactcctgggctcaagctatcctcctgccttagcctcccaagtagcagggactacaggtgcacaccaccagaacctgctaatttttaaattttttgtagagacagggttttgctatgttgcctagtctggtcttgaactcttggcctcaagctatcctacctcagccacccaaagtgctgggattataggtgtgagccattgtacctggcccccgcactagccccyttttttttttcagtccttaaaaggtttgtatagatcagagattatctgtttctttgtaggtttgatactacttgcctgagaaaccatctaggtctagtatcttttaaggtatgtgggggtggcagaataagcaattgttgttactaatttcttcatgtaggcctttaaaaattccttaagtcaattttggcagttttcctggtttttaaaaattattgttttatctgaatttttgtatgtttcagcatgaggttgctcctagtattctctcaaaatttttaaaatctctcctgcagttgt

SEQ ID NO: 176931 - DNA, 601 bp, Human
tggcctccttttttttgagacatggtctcactctgacacccacgctggagtgtgatctcagctcactgtagcctcaacctccatggctcaggtgattctcccacctcagcctcctgagtagctgagattacaggcgcgtgccgccatgcccagctactttttgtatttttcttgtagagatggggtctcaccatgttgcccaagttggtttcgaactcctggactccagcaatctgtctgtcttggcttcccaaagtgctggcgttacaggtgtgagccaccgcacctggccatcccggcmtttttctattctgctgtgaggctactgtgcatgtctgtgcatgtcacaatccccattttctcattggtttgcttgactagccttcagtgaacacccactgcgctgggcactagcagatattaccaaatgcctgcctccccgggagtagcttggggtcgcagagaaaaacctttaaaccagctgcaccacacactctccctccctctgagctccagggtgtccataggggaggctcatctactaagcactcagcaatgaactgcacatctggctggcactttagagtttacaaaatacttt

SEQ ID NO: 176932 - DNA, 601 bp, Human
ttttttttttttgatggagtcttgctttgtcgcccaggctggagtgcaatgacacgatctcagctcactgcaacctccacctcccagattcaagccattcttccgcctcagcctccagagtacctgggatacaggcatgtgccaccacacccagctaatttttgtatctttagtagagacagcgtttcaccatgttggccaggctggtctcgaactcctgacctcaagtgatctgcccgcctcggcctcccaaagtgctgggattacaggtgtgagccatatctcctggcctccttttttytgagacatggtctcactctgacacccacgctggagtgtgatctcagctcactgtagcctcaacctccatggctcaggtgattctcccacctcagcctcctgagtagctgagattacaggcgcgtgccgccatgcccagctactttttgtatttttcttgtagagatggggtctcaccatgttgcccaagttggtttcgaactcctggactccagcaatctgtctgtcttggcttcccaaagtgctggcgttacaggtgtgagccaccgcacctggccatcccggcatttttctattctgc

SEQ ID NO: 176933 - DNA, 601 bp, Human
cgctgtctaggaacaagtctgtgccaagagctgtctccatgccctttgacctccagccagtggctccagacttcagtgctcagcccaacagcttcaataatacgagggtcctttacacccactccaatttcacaaacagtaaggagctgggtacactcatttcagatgagaagactgaggctcagaatgatatggtgacttactccaggtcacacagcaaatgaggaacacgctggggatctgaacctggactggcccccacatctcagcccttttctttccttcttttttttttttttttgatggagtcttgctttgtcgcccaggctggagtgcaatgacacgatctcagctcactgcaacctccacctcccagattcaagccattcttccgcctcagcctccagagtacctgggatacaggcatgtgccaccacacccagctaatttttgtatctttagtagagacagcgtttcaccatgttggccaggctggtctcgaactcctgacctcaagtgatctgcccgcctcggcctcccaaagtgctgggattacaggtgtgagccatatctcctggcctccttttttttgagacatggt

SEQ ID NO: 176934 - DNA, 601 bp, Human
ccagcacacgtgggtattttacacgccacgacctcattactttgcacgaccccattttgcagatggggaagccaaggatggacaaggtcatcacctgctcaagcgcatacagctcacaaaaggaagaaccagcacccaaacctaggtcgaatttactctagagccagtacaaagaggagtaaatctgtacttagtttttaaaatgaatgagatgactatgcagataaacaggaagtcctgtccccagggaggtcccaccacacaagattctggattttctgagtgatcttgggctgtcccygctccagccatgggcctctctgtctcctgtctgcaaaaagagcgacgggacctgggatgggcgctgtctaggaacaagtctgtgccaagagctgtctccatgccctttgacctccagccagtggctccagacttcagtgctcagcccaacagcttcaataatacgagggtcctttacacccactccaatttcacaaacagtaaggagctgggtacactcatttcagatgagaagactgaggctcagaatgatatggtgacttactccaggtcacacagcaaatgaggaacacgctgggga

SEQ ID NO: 176935 - DNA, 601 bp, Human
tttagaacacaggccgggcgcggtggctcacgcctgtaatcccagcactttgagaggccgaggcaggcggatcacaaggtcaagagatcaagaccatcctggccaacatggtgaaaccccatctccattaaaagtacaaaaattagctgggcgtagtggcgcacgcctgtaatcccagctactcggcaggctgaggcaggagaattgcttgaacccaggaggcagaggttgcagtgagccgagattgtgccactgcactccagcctggcgacagagcaagactccatctcaaaaaaaaaawaaaaattaaaaattagaacacagcatcttcttatcagctgataccttcgtatcagcatctgctgtgggttccgcatctgccgattcaaccatggatcaaaaatacgtggggggagaaaataaaaaataacaacacaacaataagaaataggttgggtgcagtgatgcacaactgtagtactaccactttgggaggctgaggaggattacttgagtccagcggttcgagaccagcctaagcaacatagtgagaccctatctctacaaaaaatacaaatattagccaggcgtggtagcacgt

SEQ ID NO: 176936 - DNA, 601 bp, Human
ttttagaacacaggccgggcgcggtggctcacgcctgtaatcccagcactttgagaggccgaggcaggcggatcacaaggtcaagagatcaagaccatcctggccaacatggtgaaaccccatctccattaaaagtacaaaaattagctgggcgtagtggcgcacgcctgtaatcccagctactcggcaggctgaggcaggagaattgcttgaacccaggaggcagaggttgcagtgagccgagattgtgccactgcactccagcctggcgacagagcaagactccatctcaaaaaaaaataaaaaattaaaaattagaacacagcatcttcttatcagctgataccttcgtatcagcatctgctgtgggttccgcatctgccgattcaaccatggatcaaaaatacgtggggggagaaaataaaaaataacaacacaacaataagaaataggttgggtgcagtgatgcacaactgtagtactaccactttgggaggctgaggaggattacttgagtccagcggttcgagaccagcctaagcaacatagtgagaccctatctctacaaaaaatacaaatattagccaggcgtggtagcacg

SEQ ID NO: 176937 - DNA, 601 bp, Human
tctgtgtttggctctagctacataaagaaacactgaacagaaacatgactgtacagggctaagtgggtcagggaggaaggggtgggggacgcttcactggatactgtgttataagttgcaatttctttcaacacctttattgagatgtaattcagataactctccaattgagtcactcaaagtgtgcgactcaccgtttttagtatattcacaagcttgcgcagccattaccacaatcaattttagaacacaggccgggcgcggtggctcacgcctgtaatcccagcactttgagaggccraggcaggcggatcacaaggtcaagagatcaagaccatcctggccaacatggtgaaaccccatctccattaaaagtacaaaaattagctgggcgtagtggcgcacgcctgtaatcccagctactcggcaggctgaggcaggagaattgcttgaacccaggaggcagaggttgcagtgagccgagattgtgccactgcactccagcctggcgacagagcaagactccatctcaaaaaaaaaaaaaaaattaaaaattagaacacagcatcttcttatcagctgataccttcgtatcagcatc

SEQ ID NO: 176938 - DNA, 601 bp, Human
cccctcccactgggctactcacagggatagcctttgcagaggacctcgatgggcgttgacatcttcttctcgctgatccgttcatacttctggcgcttggtggctgctttgagcccctgccagggcagggagcccaggttgaagtacatgagcacgtagcccaggctctccaggtcatctcgacggctttgctctgcacagagagtcaaagactaggtgagggacaggggtccactcaggcccctaactcatcctctgggtcatgctcctcacaatgcaccaggaccctcctgcccccacrtcggatgttgctcactgcacgcattttaaacaggcactgctattatcctcctcctacagagaagaagcctgaggcagggccttctcaacttaatttgggcctagtttttccagttcaggcacttaatcattcaatgactatgagagggcacctactgcccccttgcctggcccaccccgtggagaggtcacaagcttcagcatcagacagggccggggtcaagtccagctttggcattagctaagctgcatgaccttaagcaacccatgttaaacctctgagcctgtatcttccagcctg

SEQ ID NO: 176939 - DNA, 601 bp, Human; identical to SEQ ID NO: 112540

SEQ ID NO: 176940 - DNA, 601 bp, Human
gccaagcagagggctggagcccctgccctttgtgagcccagcaggctcaggccattgccagccccgaggcaagaagtgggcgactctccatggtcccatccaacccataggacgcaagaaacacacagcagggagctctcttggcctttattgcccatagaaaacataaaaggtcagcaaagtcacacgagcatccacccgtcatcatatggacctctgtccttggctgtgttgaattccttcccggccagctgactggacctcggaacacagtggctgtatgtgctgagagtggcttccrggccccagggatccacagatcccagcaccccggtgcagccaacaacacagggtgtcctgtctactgttgggtagcatgggaagggcctggcctcagggtgaaggttcccattgcatgttttccaggtgcttctgccaggggactgctggaggtggttcagctcactacagtggccgtggcattgagtcagagattggcaaaggataaggctgtgggtgcctctgcccagcttctaactccagggcctgcctcaagagggacttccaggaaggcggtcagaccagcagcagtgggtggaga

SEQ ID NO: 176941 - DNA, 601 bp, Human
ctctgggcccagcagccctgcagggcacagaaggggagggaggccaggtggatatctcagaaaccttctgctccagcctccctgacaagcgcgggaagccaagacccacgatcacacagcacagagacacgaagccacacaaccaccagaggaaggagaaagcaggagtctgggggcagagggaggtcagtctgccctgctctcctgggatggagccagagaaaggacaactaatgcgcccaggatgatcaagagcacctcttggccctcctgacctggggctgggcctgccctggccccmctctgtgtaccaagagcccttaactactcaaggttgctaaaccgagcaggaaagctgtttagaggcctctagcagactggctaggggtgtccagagggggaaaagaacaggcccagagtcacaaaactagtggaaggctgggctaggactcagaccagctctcccggtacctagccaggggctcttctcatcagggagctgtccttccccctgccgggacctggcaatggcttctggcaggtgcagtggaggccacagccaggaggcccagggaacccacagacaccgcctgccttggga

SEQ ID NO: 176942 - DNA, 601 bp, Human
cctccacagccctgttgtgagtcttgtgcaggaattaacttgcgtaacagcccagaggctgagacagggctaatgccgtgggagaggtcagagtgtgagcccatggccccgtctctgctgggaaccaaccttccaaaatatgttaaggcagaaggagatagagacctggccgagggcagaaaaagtttttccagcagaaactaatccatgaggggtcaggcctgagcatagaaacccttggccccaagtcaggcagcctccgaggttttaaactacttgaggccccttagagttctggggygcctggtaccatctgccactgccactgccacccacccctccacaacacattggtctctttctggggccctgggagcttctaggtcggctgggctggctgcatctgcagcagtcatggactcacctaagcaaacactggtccaatgggggctctcctcacttcccgagatggtcaaatggcacacttgtcttttgagggtggggagggagagagggggagggagagagagggaggtacaagcttcaagtcaagtcccttagccgctggcgatagagatttggcaagtctctccccactgag

SEQ ID NO: 176943 - DNA, 601 bp, Human
gtctggctcctgtagcctggtgttgtcaggggagcatctggcagcctgaaggttgggggcagcgggcaccacaagggggcaagaatcctcagtgctgagggcatctcatcttcttgccattggcaaagaaatcaaagaaacaaactccatcgtcggttttgtgctgggtttttttgttgttcttttgagtggtttatttttgcctttttttttttttttttttttttaaagaaaatacagtgaagacactagaagggagaagggaaaagacaggtgaggtacacagctgtctctggctacytttttttttttttgagatggagtctcgctctgtcccccaggctggagtgcagtggcacgatctcggctcactgcaacctccacctcccagattcaagcaattctcctgtctcagcgtcccgagtagctgagattacaggtgtgtgccaccacacccggctaatttttgtgtttttagtagagatgggttttcaccatgttggccaggctggtctcgaactcctgacctcaagtgacccacctgtctgggcctcccgaagtgctgggattacaggtgcgagccactgcacttggcccccca

SEQ ID NO: 176944 - DNA, 601 bp, Human
atttttttttttttttgtagagacaaggtctcagtttgccgttaggatgatctcaagagatcccctccccacctccagccttggcctcccaaggtgctgggattacaggtgtcacccactgcacccggccaggtgatatgtcttttaaatctctttaatctataggtcttctccctgactccatctcttttttcctccttgtaatttatttgttgaggaaactgggaggtttgttctgactaaatatattttgaaattagaacagacaggatttattaatgggttagagttagggtgtgtragagaaaaaagatgtcaaggataacacccaggttttaggtcagaggatcaggaaagagatagatctaagatgagggagactttgggagaagcagatttggggcaaaggtcagaagtttgatttttggacctgtgaagtctgagctatcaattagacgttcaagtggaggtatatttgactatgaaatcctttttttcttaatgtatcttgtgaggccagcattttgagaaatacttagaggaaatactgcttttgttctaaatgctcttgggcactgctgtaacacatgaaacactaatt

SEQ ID NO: 176945 - DNA, 601 bp, Human
tattaatcttttattatagaaaatatcaagcataaacaaatgtagaaaaaaaataatgaaccatcgtgtctatcactcagcttcaacaatcgtcaactatgaactcagggtaaatcttttttcatatagaccactaaccatttacctcccttcccatattattttaagcatatactaagcaacatatcatttcattataaatatttcagtatgtatccctaaaagatgaagatgaagactctcatctttaacaaccatattcccactatcacacttaaatttagtaattccttaatttttytttttcagacaaggtttctctctgcgtcacccaggctagagtgcagtggcatgatcgcggctcactagagcctcaacctcaacctcctgggctctagcaatccttctatctcactcagactgctgagtagctagaactacaggtgtgcaccatcacacccagctaattaatttttttttttttttgtagagacaaggtctcagtttgccgttaggatgatctcaagagatcccctccccacctccagccttggcctcccaaggtgctgggattacaggtgtcacccactgcacccggcca

SEQ ID NO: 176946 - DNA, 601 bp, Human
tattgtcaaataaagtgatcagagaagttctcattgagacatggacatttttgccaagacctgaaagagatgacagcaagccatgtagatctaagaggaaagaatatgataggcagaggcagcacaaagtgcaaaggccctgatgcaggagtgtatctgacatattctgggaatagcaaagaggtcactatggctggtacatagaaaactagaaaagtgaaatattagagatgggagaggactttggcttcttttctgagtgagagggggaatcatcagggtgttatgagccactgcattscagcctaacctatgttttaaagtgaccattctggctctttagtgaattaaaaaaaaaaacaaaacagtaggggcaaggtctcaaggagggaggttaattagaggttattataataatccaggggagatattaataggtggtagtttagtccagtgaggtaacagtagaggtggtaagaaatagttgaattatattctcactctctatgtacacacacacatatacacataaaaataacatatattatatattaatcttttattatagaaaatatcaagcataaacaaatgtagaaaaaaa

SEQ ID NO: 176947 - DNA, 601 bp, Human
tacaaaaattagccgggcgtggtggcgggcacctgtaatcccagctactcgggaggctgaggcaggtgaatcgcttgaacctgggcagcagaggttgcagtgagctgagatcatgccactgcactccagcctgggtgacagagcaagactccgtctgaaaaaaaaaataaataaataaaataaaaaataaacacaaataagtaaaatatgtagtacatcagatgttattaaatggtatggataaaaataaggccaggaaaggggacaaggaagacagagtatgaaagttaggaggttataytgtcaaataaagtgatcagagaagttctcattgagacatggacatttttgccaagacctgaaagagatgacagcaagccatgtagatctaagaggaaagaatatgataggcagaggcagcacaaagtgcaaaggccctgatgcaggagtgtatctgacatattctgggaatagcaaagaggtcactatggctggtacatagaaaactagaaaagtgaaatattagagatgggagaggactttggcttcttttctgagtgagagggggaatcatcagggtgttatgagccactgcattgca

SEQ ID NO: 176948 - DNA, 601 bp, Human
ttaattaaatattaatttttaaaaacctagctcctggctgggcgcagtggctcacatctgtaatcccagtactttgggaggccgaggcaagtggatcatctgaggtcaggagttcgaggccagcctggccaacatggtgaaactctgtctctactaaaaatacaaaaattagcccggtgtggtggcacacacctgtagtcccagctactcaggaggctgaggcaggagaattgcttgaacccaggaggcggaggttgcagtgagccgagatcatgccactgcactccagcctgggcgacasagcaagactctgtctcaaaagcaaacaaacaacaaaaaaaaacctagctcctgaatgatcttttctgttctcaagagcaaacatcaagggcaccagaaaactcacaataacagtaattatttctttagcccagtggttcttagaccaccatgtggtagagtaactaaagaaaatcagattgtcatttgaatcaagtgttttgttgatcaacctcattttgaccaatttgcctaggggtaggatttctccaagcctcttccttaactttacttgaaaaaagggtatgtgattttaaaagtc

SEQ ID NO: 176949 - DNA, 601 bp, Human
ttttttgtatggctggggtcttgctatgttgcccaggctggtctcaaactcctgaggctcaagagatctgcccaccttggccttccaaagtgctgggattatagacatgagccatcatgcccggcttcagtttttaatatactgaaaaacatatgaaaaacaggtattaggaaaatccagtgattgtcattatggtcaggttatctcacataaaccaaattttatggaggacatgtcagaatagtaaatgtcaaagatgttgtaggtaatgctagcagttagaagagtaactgtcagattytgacagcatacatttaattggtagcccaatgttgtagtgcatttaaagctctgaataagaaaaggcctaaatttaagtcatgatctcattcattcattaaatgcaacacatattaattgtgttaattgtgctaagacctggtaggggcactttaaaaaccttgtatgtagtctattaacatgattttttgggatgtgatcacaggtcagacaaaaatttaagatatatagataatccaatacatttacatttacatagtttaagagagcaatttaaatgtaaattgaaacaatgttggaa

SEQ ID NO: 176950 - DNA, 601 bp, Human
ggcatggtggctcatgcctgtaatcctagcactttgggaggccgaggcgggcaggctgcatgagctcaggagttcgagaccagcctgggcaacatggtgaaatgccatctctactaaaaaataaaaaattagctgggtgtggtggcgtgcacctatagtcccagctacttgggaggctgaggcagaattgcttgaacctgggaggcagaagttgcagtgagccaagatcaggccactgcactccagcctgggcaacagagcgagactccatctccaaaaaaaaaaaaaaaaaaaaaaaaaatcagccaggcgtggtggcagttgcctgtaatcccagctacacaggaagctgaggcagaattgcttgaacctaggaggcagaggttgcagtgagccgagatggcaccactgcactgcagcctgggagacagagcaagactccatctctaaataaataaataaataaatgaaaataaaataaagaccccaccacaggaaagaaagcctggggttcccctactgaactgaggtccttaaaggggagctgaagtagtcttaaactggtgccatcccctagctaccagcaaaagcaaattcgttc

SEQ ID NO: 176951 - DNA, 601 bp, Human
atgtttaccaggctggtctcaaactcctgacttcaggagatcctcctgccttggcctcccaaagtgctgggattacaggtgtgagccaccacgctagactgcaattactttttatgtagtagtagttaacactaaggagctactttataccaggtacatacattatttcatttacttttcaaaacaatcctaacatttggcactgtcattatttcaattttattggtgggggaaattagagaagtagagcaacttgcccaaggtcacacagctactaacgatagaaccaggattgaagtcyggcattttgattccagaactcctttctttttttttttttttttttttttgagacgagtcttgctctgttgcccaggctggagtgcagtggcgcgatatcggctcactgcaagctccgcctcccgggttcacgccattctcctgcctcagcctccccagcagctgggactacaggcgcccgccaccatgcccggctaatttttttgtatttttagtagagaccgggtttcaccgtgttagccaggatggtctggatctcctgaccttgtgatccgcccgcctcggcctcccaaagtgctgg

SEQ ID NO: 176952 - DNA, 601 bp, Human
aaggcaggcagatcgcttgagcccaggagttggagatcagcctgggcaacgtggtgaaacctggtctctacaaaagataaaaaaaattagccaggcgtggtggtatgtgcctgtagttccagctactcagaaggctgaagtgggaggatcacttgaccctgggagttcgagtctgcagtgagtgtaattgggccactgcactccagcctgggcaacagagcaagaacctgtctcaaaagaagaaaaaaattaggccaggcgtgatggctcacgcctataattccaacactttgggaggctraggtgggtggatcacttgaggtcaggagttcaaaaccagcctggccaacatggcgaaaccccatctgtattaaaaatacaaaaattagccaggtgtggtggtgtacatttgtaaacttagctacttgggaagctgaggttgcagtgagttgagactgcaccactgcattccagcctgggtgatggagaaagacactgtctcaaaaaaaaaaaagtaaaattagtacattaaaatgaaacatcaccttttctctttttctctgaagcatgatctttccagttctattgttagcatcacata

SEQ ID NO: 176953 - DNA, 601 bp, Human
aattgcaggccgggcatcgtggctcacgcctgtaatcccagcactttgggaggccaaggtgggtggatcacctgaggtcgggagttcgagaccagcccgaccaacatggagaaaccctgtctctactaaaaatacaaaattagccgggtgtggtggcatgcacctgtaatcgcagctactcgggaggctgaggcaggagaatcgcttgaacctgggagatggaggttgtagtgagccgagatcgcaccattgcactccagcctgggcaacaagagtgaaactccatctcgaaaaaaaaaamctccaaattgcccaaacagtggctgctactctgcaagaacaattcttccctctctgagataagaatcatccttaatcaattgtttctgaaaccagctgaactccagctgagcacccttgttaaagccctgtacgacatttcaccctccttccccaagttaaaaggctctttcagagacttcttatgcctggcatttctgaaaagggacttctgcaaacagttctctgttttgttttctaagtgagtattttagatagtaaattctataataggtcaagaaggacaagattttctaaattg

SEQ ID NO: 176954 - DNA, 601 bp, Human
tgtggcccttgccacagtgccctgcacccccacccagctgttcttctccactctctcttgcatatgacttagctcctaagtattcctattgttcttagtaaaatccaaattgcaggccgggcatcgtggctcacgcctgtaatcccagcactttgggaggccaaggtgggtggatcacctgaggtcgggagttcgagaccagcccgaccaacatggagaaaccctgtctctactaaaaatacaaaattagccgggtgtggtggcatgcacctgtaatcgcagctactcgggaggctgaggcaggagaatcgcttgaacctgggagatggaggttgtagtgagccgagatcgcaccattgcactccagcctgggcaacaagagtgaaactccatctcgaaaaaaaaaaactccaaattgcccaaacagtggctgctactctgcaagaacaattcttccctctctgagataagaatcatccttaatcaattgtttctgaaaccagctgaactccagctgagcacccttgttaaagccctgtacgacatttcaccctccttccccaagttaaaaggctctttcagagacttcttatgcctggca

SEQ ID NO: 176955 - DNA, 601 bp, Human
catagaaatgtgaggcagtaatgactttaactattaaattatcaaaactttacaataaccttggaagctagtttttatggcctgttttacattttacaacgtaagacactggcaaacagagattaggcaaatgacttgagcttatgcagcaaatcagttacaagagaaaaactaggaactaagctttgtgagtccttttgttctcagatctataaaaatagacctgtaatagataatatcactgaattataattcaataactgcaaagtgaattaattcactctcttcatacccctcattsctcaatatgaaatagtttattatattattaatcacatgttgttaaatgataaatttgactacatgaaccaaagggtcaaaaaggtaacttcaagggcccagaagagaaatatcgaccaaaggttttttgttggcataggttttctttttcttttcaaatcttacctggaaagtatatacagtttaaaatctactttcttctaaaggagttgttagctttttttttgttttctcctccttcagtctcctgagtagctgtgattacaggcgcgagccatcatacctagctaatttttgtatt

SEQ ID NO: 176956 - DNA, 601 bp, Human
tttaggagatacagagtttcatcatgttagccaggatggtctcaaactcctgaccttaaataatctgcccgccttggcctcccaaagtgttgggattacaggtgtgagccactgcgcctggcctgaatcttgaatattatacatacaaggctcctatgtgccaggaactgtacctgttcacttacatacatttgttctatccttacggcaatcttggcacataagagatcctcgataaaggataattattggctgggcacagtggctcacgcttgtaatcccagcacattgggaggccaargtgggcagattgcttgtttgatcccttggaggcccacaagtttgagactaggctgacaacagggtgaaaccctatctgtacaaaaaatgcaaaaaattaacccggtgtggtggcatgtgcctggttctgtgctgccttggaggctgaggtgggaggatcacttgagcctgggaggccaaggctgcagtgagctaagatcatgccactgcactccagcctgggcaacagagaccctgtctcaaaaactaaactaaactaaaataatacataggataactattatttaactaaacaattcag

SEQ ID NO: 176957 - DNA, 601 bp, Human
ggtgaagaaaaccttgtagtttcacatttattgagctgtggactagatgctttacatgttattatatttgctctttacagtggccttaggatgcaggtagtattagctccgttttatagattgaaaaactgaaactcagagtggttaaattctttgtccaaggtcacacaggagtggttagagaatggggtctgattgccaaatggcttacccaagtaaatggttgacacttcaatgttattggcagacatttgcaaaatgacggtgctaatactcctcgtagtggtaatggtgatggtgytttgttgatgaagatgagtcttgcaggcagttttcattcccaaatattcaatatagctaagacaagatagaacagaattcttttgttatcctggaagccactggcctgtgggtggagggcatggaggtatatgaggtatatgtcttgtgggcttccagatgccaactgcaggtagaagactttggcatgtagatggaaagcactgcgctttctatccacagtgccatattctcagtcacttgggtcctgcccttcctgttaagcagcaggaggcaggctgcttgtgccctctttaccatg

SEQ ID NO: 176958 - DNA, 601 bp, Human
ccattgcgacttattttctgcttagcagaggacctccgtgattcttcttggtgtcagcagagaaaagatgcccagaattcctctcttgtcaggctccttgccccagaccctactgactatttagtctggatagctgggataacagaggtcgtcctctctccccactggatcctgtcagacacataggcttgtaaccattctgaaagggactggttattgttctccaagctgcttattccttgtaacagaacctactattttagaggaaggcagccctcacaacaatcccagagtatattayggtttcttcccctggtcactcctagttagcaacttcaatacaagacctgcttaccttcatcttcattatgggattatctttgctgaaatgacagctggggttgttaacgattatgaattcagcccataccagcacttgtctctgtcatctttgcaggaagcccaggtgggcctggatgcatcattaaagaaacacttttctttgctgaatgtaggctttgtaaagccaggtaataattcttttgtagtttgagttgaagattgaagaaatctcaaaatcattcttaaactattttataca

SEQ ID NO: 176959 - DNA, 601 bp, Human
gcctgctctaataagatgaaccactcaaagatcacttaataattgtagaatttcaggaaccacatataggtcaattttgacaagtgttgagtctgtttttgaagacccagattcttaagactcctctttcccctcatccttttatgtggactcagtgaattttaccatgccttgacaactcacaccccacccatggcaattaacccacccatggcaaacccacccatggcaaagcgtaagatgtcagacatttattaacacatctgtacacccaagcatcatcctcgaatccaccagttgratgctattagattcatagtgactcctcctgctggaattctttacaaatagaaagagatcataactagttaaacaagttgaacaataatcagaagactaacccagatacacggccccaaggagtcagtttcatcagtggtttccttgctgcttcacctctgtttatcacatcctttctctgtaaaatgggaataatgataccttcctcatcctacctcagagaaattttgtatagataaataagacatttaaaattgtaacaaatgtagaggaatgtgctctttaagaatacattcttaat

SEQ ID NO: 176960 - DNA, 601 bp, Human
ttctttacaaatagaaagagatcataactagttaaacaagttgaacaataatcagaagactaacccagatacacggccccaaggagtcagtttcatcagtggtttccttgctgcttcacctctgtttatcacatcctttctctgtaaaatgggaataatgataccttcctcatcctacctcagagaaattttgtatagataaataagacatttaaaattgtaacaaatgtagaggaatgtgctctttaagaatacattcttaatgttgatattttaaaagggggcagtctggcctaatctrtaggatctggaacctggcaggcctggatttgcctactgactcttttccttgtcttaaaatggggataataatggaatctctcccatggtgtagtagtgaagattaaatgagaattcaaggaaatcatcgtgaatagtgagcattacataaatgttagctaatattagtagttgcagtaataatttttttaagggtcccaggttgtagttgatttatcatgagatttctttgaaaaagaagactcatgcctataatcccagcactttgggaggccaaggtgggccaatcacttgaggccag

SEQ ID NO: 176961 - DNA, 601 bp, Human
gtgttgagtttggatatcagacttctaggagttatccaggcaattggaaattcagtctggagttctgggcataggatggtgttagaaatgagtgtttttatagttttcaaaatgacagccaaagccatagaacaagatggccaaggggaaagtttggaggaaacagaacagggccactgacagactactggaaaaaactggcattcaggagacaagagcgggggacggggtggggaggcacatcaggagaggtcaggtgatgcgtgagcagggtgggagggaagtgcttcaagagggaaargctgagtggccagcagtatcgaatgctgtaggagtcaagaagagggcattagagagtttagaaggccactggtgggccaggcatgatggctgacgcctgtaatcccagcactttggtgggaggccaaggcgggcagatcacttgaggtcaggagttcgagaccagcctggccagcatggtgaaaccccgtctctactgaaaatacaaaacttagccaggcatgatggcgggcgcctgtaatcccagctacctgggaggctgaggcaggagaatcgcttgaacctgggaggcagaggttgc

SEQ ID NO: 176962 - DNA, 601 bp, Human
gcagtatcgaatgctgtaggagtcaagaagagggcattagagagtttagaaggccactggtgggccaggcatgatggctgacgcctgtaatcccagcactttggtgggaggccaaggcgggcagatcacttgaggtcaggagttcgagaccagcctggccagcatggtgaaaccccgtctctactgaaaatacaaaacttagccaggcatgatggcgggcgcctgtaatcccagctacctgggaggctgaggcaggagaatcgcttgaacctgggaggcagaggttgctgtgagcaaggaytgtgccactgcactccagcctgggtgacagagtgagactccatctcaaaaaaaaaaaaaaaaaaaaaggccactggtggcatgtgacaactgcggtttcttctgtagtgggcagattcccattgagtagatggtgggatagtacagtcaacacgcgttgatgactctcgagatgtttgatggtgaaaggaaaaacaggagatggtagctttgcagataagcaggggcaagggaaggggggtggttttcctttccttagtttaggagcttgtttggagtgggaggaagagaagaagagaca

SEQ ID NO: 176963 - DNA, 601 bp, Human
ggcatgatggctgacgcctgtaatcccagcactttggtgggaggccaaggcgggcagatcacttgaggtcaggagttcgagaccagcctggccagcatggtgaaaccccgtctctactgaaaatacaaaacttagccaggcatgatggcgggcgcctgtaatcccagctacctgggaggctgaggcaggagaatcgcttgaacctgggaggcagaggttgctgtgagcaaggattgtgccactgcactccagcctgggtgacagagtgagactccatctcaaaaaaaaaaaaaaaaaaaaaggccactggtggcatgtgacaactgcggtttcttctgtagtgggcagattcccattgagtagatggtgggatagtacagtcaacacgcgttgatgactctcgagatgtttgatggtgaaaggaaaaacaggagatggtagctttgcagataagcaggggcaagggaaggggggtggttttcctttccttagtttaggagcttgtttggagtgggaggaagagaagaagagacaaggagaatatttggtgcgggggaagagagtcacacatgctgaaggggttagccagccagggaaggag

SEQ ID NO: 176964 - DNA, 601 bp, Human
aggcagaggttgctgtgagcaaggattgtgccactgcactccagcctgggtgacagagtgagactccatctcaaaaaaaaaaaaaaaaaaaaaggccactggtggcatgtgacaactgcggtttcttctgtagtgggcagattcccattgagtagatggtgggatagtacagtcaacacgcgttgatgactctcgagatgtttgatggtgaaaggaaaaacaggagatggtagctttgcagataagcaggggcaagggaaggggggtggttttcctttccttagtttaggagcttgtttgsagtgggaggaagagaagaagagacaaggagaatatttggtgcgggggaagagagtcacacatgctgaaggggttagccagccagggaaggagcaggggtgctctcagagacaggacagctgggaaaggctgagggagtgattgtggaaattaaatccagcacctcatggaaagcagctgacgggttgtcatatagtaggagctcagtaactgtttggtcggttggtcctgccttctgtctgattcccttccttgtcctgagctcaaactcatttctccagctgcttgctggacatgtcac

SEQ ID NO: 176965 - DNA, 601 bp, Human
aggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgagtgggaggcgccccaaggaggggaggcgtcagcagggctgcttgggtctggttatgtgcaagtctgaaactgttctgagactgaggcctgttggtttggggctttgacatcgggtgaggctggcragttttgcaggggtgcccagtcctctgagtaatggtcttctcaaggcttgaaccttgatctctcccttacattagactagggaaggtatcctcttggtaaaaaccaggtacccttgaagacctgtcttattttttgcagaggcatagaggagggtttctcctgggccttacttgttaccttcagaaatgttttctgcagaggattgggctactttgaggaggtgacaccaggtaggtagtaccttcagaggggcaggcctggggaagaaacggagaagacagccataggaggcacaggcc

SEQ ID NO: 176966 - DNA, 601 bp, Human
ttaaatttttaagcagctattcctgctcggaacattaaaaacaaccaaaaagtgtttaagcagctcatctaatagattaactgagaaagaaagggagcagagggctctgtgttggatctcattgctaagcttgcctttgtgacccactgatcttcctccctggacagacagtgggagtgctgaggggagcggcaaggcctgtaaccttgtgcacatctccacagctttcacagcaggagtaaggaagagggagggcgggaagggacagagtcagagacacacatgcctcgagtgttccctyggcaaggccttcccaaaacccttccccatttctcgattccttcagctgcctgtattaataaatgtagtaaacataagcatctgttcatagcaaacttgatcaagttgctgcacaaacacaggttctcaagcaaattctccctaaactggagagcagtaaagagaggcagagccgtgtgaacactcgtaggctctctgcctgaggcttttgggacctcagcatgccttcatttcccatttccttcaatgttgcaaagggccatgaccagcttcttgactgggctgaggaaagctgcttgcc

SEQ ID NO: 176967 - DNA, 601 bp, Human
aaagtgctgggattatgggcatgagccaccatgcatagctgaacactcacctctttttatgatagcattctatatgcaacttactttttttttccccttaaaagcatattttggagattagtccatatcagtagataaaaatttcttcttttgtacagcacatttcatacacgtgccctgatttatgtaaccagtccttacggtgatatttggaaacatttattgttactggaaggatagtaatagtaataacaggtgcaattgcttaaacacctagttcctgctagttgtgtgctggacmcttcatgtgtgttgtgacatttaaacatcaagtgaccctctgaagtggatattgttatctccccattttacagatggggaaactgagggccagtgatgttaagttgaatccactttttgttgttgttgtttatgagacacagtctcgctctgtcacccaggctagagtgcagtagctcgatcatggctcactgcagccacaacctcccaggctcaagtgatcctcccacctcagcctcccaagtagctgagactacagcgtatcctgccacacccagtcaatttttcttttttttgtagg

SEQ ID NO: 176968 - DNA, 601 bp, Human
tatcctgccacacccagtcaatttttcttttttttgtagggtgggggaaacagagtttcgctcttgttgcccaggctggagtgcaatggcacgatctcggctcaccacaacctccacctcccagattcaagcgattttcctgcctcagcctcctgagtagctgggattacaggcatgtgccaccacgcctggctaattttgtattttagtagagacagggtttctccatgttgttcaggctggtcgcgaactcccgacctcaggtgatccgcctgccttgacctcgcaaagtgctggggtkacaggagtgagccaccgtgcccagccttaatttttgtatttttttgtagagacggaggtcttaccaggttgtcctgcctggtctcaaactcctggcctcaagtgatctgccttccttggcctcccaaagtgctggggttacaggcatgagccactgctcctgacttggattcattttgatggctcaggacagttgtttccctgactgggtttatcttttttattgtttgcaagtctcctccgattttgacgccccacatcatcgagtcaggggttaacgtgatttttgcccagcccagct

SEQ ID NO: 176969 - DNA, 601 bp, Human
ccacctcccagattcaagcgattttcctgcctcagcctcctgagtagctgggattacaggcatgtgccaccacgcctggctaattttgtattttagtagagacagggtttctccatgttgttcaggctggtcgcgaactcccgacctcaggtgatccgcctgccttgacctcgcaaagtgctggggttacaggagtgagccaccgtgcccagccttaatttttgtatttttttgtagagacggaggtcttaccaggttgtcctgcctggtctcaaactcctggcctcaagtgatctgcctkccttggcctcccaaagtgctggggttacaggcatgagccactgctcctgacttggattcattttgatggctcaggacagttgtttccctgactgggtttatcttttttattgtttgcaagtctcctccgattttgacgccccacatcatcgagtcaggggttaacgtgatttttgcccagcccagctttcatccacatctgcttttgagcccctgtgtccacccagcagcaatctctttctctctcgtcctgacacttcctttctgtgttggggcaggtgggcagcaatgctggcatcgt

SEQ ID NO: 176970 - DNA, 601 bp, Human
gaggattcagagttgaattgaacacaatccttgtcctcaaggtgttcagctccttggtgagagatgctctctcgataatggtgaactctactaactctgcctgtttgcccagagcttggtctatagcgccaggcccagagcagcctggctttttgcctatgcctctgccctgatgtgatcttcagtaccatcagttagcctgcagagggggcacatttcagacagccccatttgagcttgttgatattcttgagtgcctattctgtgcaggcactattctaggagctgtggggaatgtgtrattcgtgatctcaaggattttaattcagtcaccctgaataggagcaatagaggccatttacaggactctgatgaaaaatcagatgcagtcatgtgtaatagagaaaaagctctccaggaactcagaggagtcaagagtgtccacccaggaaggatttcatggaagaagtggtatttgagatgagctctgaagggtgagagggcctggtagttgcataaaagggaaagaattcaggaaggaaggtcagagtgagcaaatccacaagggcagaaaagttccaaagttttaggagaagggaga

SEQ ID NO: 176971 - DNA, 601 bp, Human
gtatggccaggacagaccttgcctgcctccaggaagcaccaggggccactcctgttctgtgaccctgagtgcagggcagaggtttagtcactgccatgggagagctggacccactgaggtgtggcctcggtgccatctctctactcccttagaggtatcctgtggcctcctgtcctgggcagtggtggtgaccatggagaggagaaggtagggttagggtatgatcttcctccatagaaaactggtgacagaatgtctgggcccagccaggctcagcctccagggtgctgtcacaggttcytatggcctcactgggaccatgtctaaggtctcctctcagagcagaggtctggttggagtaagtgcagggggttatgggcgtgagttctcttggggcttaagctgttggtgtatcctggacacttgcccactgcagaccttgcccctggtcttggaggggcatttgatagaggggtttgacccctgctccgtacaaaggaggtactggccccagcctatctgagatcttggaatcagtctttggctggccttgcctccagaaaaggcccccatccatggtcaccctggggctacagatgtc

SEQ ID NO: 176972 - DNA, 601 bp, Human
ggcctgcatgctcctgggactgctgagtttggccaaggctgcagcaaacactgtaatgtcctctgggactcactgggcttcttttgtgctttgtatgagatagaacttgggccacaagggaagatttcaagtcagttatttctggccaaactccagatgtttccagctgaggagacattcacttggtctcttcgggaggccctgagttaacacttgccctagacttgttacgggggcagcagcagcgtgctggggctggagctgcagcatgctctgaggagtctccaccagcttagcaatsaggagatcccggagctccacttgccaggctctgtgcaggctctgggctctgggggctggactgagcgggaggtgggagcaaggttcaccaatttctctgcaggaatagtagctgcagcagagaacaggatggagcctttctgggctgggcagaggcaggaagtgaggcatgagtccagggccatagcagtcctcagccactgagtggggatgagaatgcctcttcatccccactgcctcctgtcacagccttcctgccatctgccttgccctgaactggcaagatcaaggaatgaggagt

SEQ ID NO: 176973 - DNA, 601 bp, Human
tccccagcatctttctccattgtcccctcattggaaaaggaggctatgcctggatctgtctgtccattctgttatctgtctcccatgggtctttcctctggttcgttcgcttcctttctctctctcctgctctgctttgtgcttctctgaacggccgcttctcacaccctcatcatgtgtgtcctacccaccctgtaaggaaggcagggcaggcactggctccattttagagacagaggggaggtgctgcatgcagagtgacccagtaaattcctggtcaggctagggtgaggaccacgcrgcctgctcacgcatcttccgtccctgtctccccgctgctcagcacctctgctctctggccctgctcctgatgggccagtgcttctcaagctccttctctctctttcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctccc

SEQ ID NO: 176974 - DNA, 601 bp, Human
ctctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggccacggcagccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcg

SEQ ID NO: 176975 - DNA, 601 bp, Human
gtggggccctgggcccacaacggcaggaggaaaccatctcccctcccctcaaatacttttctttgcagaaaatgagaattttttttaaaaaaaaacctcaccttctatacatggtaaagagcctgcaaattcacctctctagaaacacagtgttaggcagaccaagcaccaggtggcggagagaaatggctggcattgtgggataatctttcagtttctagaggaggtctgaggcatgataactaaaattacagagctgctttcaggtcagaaaatgaagtacaaagtgtgtggttttttkttttttttttttctttttgagacagagtcttgctctgttgcccaggctggagtgcaatggcgcaatctcggctcactgcaacctccgcctcctgggttcaagcaattctcgtggctcagcctcccaagtagctgagattacaggcatgcaccaccatgcctggctaatttttgtctttatggtagagatcaggttttgccatgttggccaggctggtctcaaactcctgaccttaggtgatccacccgcctcagcctcccaaagtgctgggattataagcgtgagccatggcacccggcc

SEQ ID NO: 176976 - DNA, 601 bp, Human
caccaggtggcggagagaaatggctggcattgtgggataatctttcagtttctagaggaggtctgaggcatgataactaaaattacagagctgctttcaggtcagaaaatgaagtacaaagtgtgtggtttttttttttttttttttctttttgagacagagtcttgctctgttgcccaggctggagtgcaatggcgcaatctcggctcactgcaacctccgcctcctgggttcaagcaattctcgtggctcagcctcccaagtagctgagattacaggcatgcaccaccatgcctggctratttttgtctttatggtagagatcaggttttgccatgttggccaggctggtctcaaactcctgaccttaggtgatccacccgcctcagcctcccaaagtgctgggattataagcgtgagccatggcacccggcctcaacgtgtggttcttacggtgacaaggtagtttccaaatggcctcttttacccctttctgtgtgacatttgctaccctggccaaacaccacattcccatgtgacgggagaaaggaattccaatgccatgaattcagaagcgatggatggagtgcagtgtgctctt

SEQ ID NO: 176977 - DNA, 601 bp, Human
caggttttgccatgttggccaggctggtctcaaactcctgaccttaggtgatccacccgcctcagcctcccaaagtgctgggattataagcgtgagccatggcacccggcctcaacgtgtggttcttacggtgacaaggtagtttccaaatggcctcttttacccctttctgtgtgacatttgctaccctggccaaacaccacattcccatgtgacgggagaaaggaattccaatgccatgaattcagaagcgatggatggagtgcagtgtgctcttgtgtttttacgtggctacgaggcrctgctgctgggtttcctagttcttttgacctagattttctgcttcctcccttgccccctcagcacacacatacccacatgtccttagtgacaccagcagtcacatttgatgttagaaactataaagttttctgttctcagcaatctcaaactcaaatatgggacacacttttattccttcagaataaatgactaaattcaaaacatacacacataatgctttaaagaacgtataaacccttccatgtcctattcagagctggaggcctccctcataagaataccacatttgatggaattg

SEQ ID NO: 176978 - DNA, 601 bp, Human
ccaaccttagcctctctcctgggtccagactgacatatccagctgctccctgagcttttcttcttagttgaagaattcaactcacagtcacccgcatgcaatctgaagcccatgagccctttctcagccctgcctcctctcatgtatcttctatttctgtaaagccgtcaccacctactcagtctcccaagccagaaatccagtggcatcccagagtcctcctctcccttagcttccaagattggtcaagaaatcctgcctgtttgcttcctgaatttctctaaaatatatcctcacctcytcttagcctaggccctatcatctcttgactggaggcctgcgctcatcttcctgcagtttttctgccgactttagccttgcaatctatcttcacattctgatctctgatacagagctctgtcgctctctcgctctctcttaattagagacagagtctctctctgttgtccaggctgtagtacagtggtacaatcagagctcactacagcctttaactcctgggctcacaccctcctcccgcttcagcctcctgagtagctgggactacaggtgcgcttccaccacgccttgctaagtttta

SEQ ID NO: 176979 - DNA, 601 bp, Human
aaggcaggtggatcactaggtcaaaggatcaagacagtcccggccaatatggtaaaaccccgtctctcctaaaaatatgaaaaattagccaggtgtagtggcgcatgcctgtaatcccagctactcaggaggctgaggcagggggatcgcttgaacccaggaggtggaggttgcagtgagctgagatcccgccactgcactccagcctggcgacagagcaagactctgtctcaaaaaaacgaaaaacaacaacaaaaaaaagagaaaagtttcctggttacctggaagagaaaaaaaaaaatacaccgtggagtaaccattcttccttcccaccatctgctgagatgaggaacttaaggtgctaactgggacaaatgaatttccaaaatagaaaaagggattcagggaagtccttgagtgctgaatttgggaggccaagccacagtggggtgacatgagtggacggcacaagtggacagaaataacctggggtcaggagaagctgactccaaaggtaaacccacggctcctccacaggcctggggtaaatcctagaacagctgttgagttctttcaacttattaacatattttcctctaag

SEQ ID NO: 176980 - DNA, 601 bp, Human
ggatcactaggtcaaaggatcaagacagtcccggccaatatggtaaaaccccgtctctcctaaaaatatgaaaaattagccaggtgtagtggcgcatgcctgtaatcccagctactcaggaggctgaggcagggggatcgcttgaacccaggaggtggaggttgcagtgagctgagatcccgccactgcactccagcctggcgacagagcaagactctgtctcaaaaaaacgaaaaacaacaacaaaaaaaagagaaaagtttcctggttacctggaagagaaaaaaaaaaatacaccgtrgagtaaccattcttccttcccaccatctgctgagatgaggaacttaaggtgctaactgggacaaatgaatttccaaaatagaaaaagggattcagggaagtccttgagtgctgaatttgggaggccaagccacagtggggtgacatgagtggacggcacaagtggacagaaataacctggggtcaggagaagctgactccaaaggtaaacccacggctcctccacaggcctggggtaaatcctagaacagctgttgagttctttcaacttattaacatattttcctctaagtccaaaagg

SEQ ID NO: 176981 - DNA, 601 bp, Human
tcagcccctccgtgcatcactcttagcccgtgaccttgattccaggttctctggaacaatgaaagccaccagaagtgaagctcccagacccccctcccccaccgcatccacctgcctcctgcaagtgtgctcaaacagtcggcctttcctgcagctggctggaaggaactgtcactgcttctagcagaaattctcctctctctctcttccacgtcaacctcctttccctctctgctggatcattcctgtcagcaaacacacacgctgcaatttctcccaacttaccaaaacacaaacaaayaaaaccaaacccagaggccaggtgggttttgttgtggctgatgcctgtaatcccagtcctttgagaggctgagggaggaggatcacttgtggctaggagtttgagaccagcctgggcaacatagcgagccccatctctacaaaaaatttttaaaaattagctggtcgtggtggcatgcgcctatagtcccagctgcttgggaggctgaggcaggaggatcgcttgagcctgggagttcaaggctgtggtggaccatgattatatcactgcactccagcctgggcagcagagagagactct

SEQ ID NO: 176982 - DNA, 601 bp, Human
acaaatgtgtatttcctaaatccccttcacttctgaaatgtttcctttgcgatatggctgctgtggtgcatactccattcctcttcccatccccattacatttcccacacgtggcagtggtgtgtgtggtggcctcttgtttagccctgtagaattgtgtggcaaatactcaggcagaatctccaggccaccagaaactgctgctttcagccctctcagagcacagccaaacttccccctcagtcccagtgggggactcagtctccagtaagtacatccttcctgctacctatgtctcagkttcccaaattctagaaagcacagagaattgctcacaaaggaatccaaagccaaggcctgacgggcttttatcttaaaggaacatgcgtatgagccttctggtgacagcaattagagcagccaccttgaagcaatgtgacacagtcccacctttggccgctgagtgattgcagacactcattttgcttgtctgtggtggagagaggtctctggcctcctgctttgaggctgcagccacagcttgcctggccctgtgtaagtgtttgacctatttcatacatgccacgctgtatgcagctgt

SEQ ID NO: 176983 - DNA, 601 bp, Human
ggagatggacgaggaagagaaggctttcaagcagaaacaaaaagaggagcagaagaaactcgaggtgctaaaagcgaaggtcgtggggaaggggcctctggccacaggtggaattaagaaatctggcaaaaaataagctgttccttgtgcctaaggagacggtgaccctttatttcatccgtatttaaacctctctattccctcctataatatcttttgccacctatagttggaattaagtgtcgtcttggagctgttgtacatttaagaataaacttttgtaaaaaaaaaaaaaaaaaaatcttccagtggctcatcatctctttagttgttttcactaagtcattcctaccataactgtgaatttaaagtaaaaccagctcagaatcttgccagaatctgctctttggtcgttgttctaccctaaactttgtatcacctgaaattaaaccaactcatttgaaagaaaaaagaagttatcatgtttaggtggcgtgacaggccaagctcactagactggagtcagagactcagggttctggcctcagcccttactcagcagtgaccttgaccaagcccctgcacctctgtgagcctcagt

SEQ ID NO: 176984 - DNA, 601 bp, Human
accaaatgcacacagaagttcagaaaggaaaacaaaggctagccaagaccttgtgaatcactctaaccaggaaacggacagaggtattaactcactaggatgggcattcagagaagcaatataaaattgcattaaatgggattaaatgagttgatatttgtaaagcgcttagaacagtgcctggtatatgctgccctcagggtcctacataattgtttgttaaatgaaactaacaatacggtatttctgatttgtaaggttgttgtaacattagggaaaaaggccttacttcttcccccaygcccagcccggcggcaggcctggttcccatggtgttgcaagaatgttgctgtttgggtctctatcaccaggctgtaaatgacagttcaaaatcatgcaaagtcaacagtggagcttatctggagggtagattgtccagtggtgtggcaacatgtgataagaaggggtggcattgtatcagtaaaatggaatatttcagcttgattacacagagaaaaaacgagcgccctagaaatggactaaatggctaccaggcaaaaagtgttagtctgtgaaccagagacctgcactcctaaaactg

SEQ ID NO: 176985 - DNA, 601 bp, Human
caaatgcacacagaagttcagaaaggaaaacaaaggctagccaagaccttgtgaatcactctaaccaggaaacggacagaggtattaactcactaggatgggcattcagagaagcaatataaaattgcattaaatgggattaaatgagttgatatttgtaaagcgcttagaacagtgcctggtatatgctgccctcagggtcctacataattgtttgttaaatgaaactaacaatacggtatttctgatttgtaaggttgttgtaacattagggaaaaaggccttacttcttcccccacgyccagcccggcggcaggcctggttcccatggtgttgcaagaatgttgctgtttgggtctctatcaccaggctgtaaatgacagttcaaaatcatgcaaagtcaacagtggagcttatctggagggtagattgtccagtggtgtggcaacatgtgataagaaggggtggcattgtatcagtaaaatggaatatttcagcttgattacacagagaaaaaacgagcgccctagaaatggactaaatggctaccaggcaaaaagtgttagtctgtgaaccagagacctgcactcctaaaactggg

SEQ ID NO: 176986 - DNA, 601 bp, Human; identical to SEQ ID NO: 37900

SEQ ID NO: 176987 - DNA, 601 bp, Human; identical to SEQ ID NO: 37899

SEQ ID NO: 176988 - DNA, 601 bp, Human; identical to SEQ ID NO: 37898

SEQ ID NO: 176989 - DNA, 601 bp, Human; identical to SEQ ID NO: 37897

SEQ ID NO: 176990 - DNA, 601 bp, Human; identical to SEQ ID NO: 37896

SEQ ID NO: 176991 - DNA, 601 bp, Human; identical to SEQ ID NO: 37895

SEQ ID NO: 176992 - DNA, 601 bp, Human; identical to SEQ ID NO: 37894

SEQ ID NO: 176993 - DNA, 601 bp, Human; identical to SEQ ID NO: 37893

SEQ ID NO: 176994 - DNA, 601 bp, Human; identical to SEQ ID NO: 37892

SEQ ID NO: 176995 - DNA, 601 bp, Human; identical to SEQ ID NO: 37891

SEQ ID NO: 176996 - DNA, 601 bp, Human; identical to SEQ ID NO: 37890

SEQ ID NO: 176997 - DNA, 601 bp, Human; identical to SEQ ID NO: 37889

SEQ ID NO: 176998 - DNA, 601 bp, Human; identical to SEQ ID NO: 37888

SEQ ID NO: 176999 - DNA, 601 bp, Human; identical to SEQ ID NO: 37887

SEQ ID NO: 177000 - DNA, 601 bp, Human
gtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttwcccagtgatgatttaataaaattatgaaaaatcaggagagggagataattagttgcttcctccttcacactgtttgaatcgaactcgcggtgacttttttttttttttaaaaacatgggttgtcacttaagtttggagtgcagtggcatgatcatcagtgagcgtgagatcactgtaacctcaaattctaggctgaagtaatctttctgcctcagtctcctgagtatctaggactacaggcccacacaacaatatctggctaatttttaaattattctgtagatacaggggtcatgctac

SEQ ID NO: 177001 - DNA, 601 bp, Human
caagagtgaaactctgtctcaaaaaacaaacaaacaaacaaaacataatccccactcccccatcaaaagaccccataatcccagtcacttgagcccaggaggttgaggctacagtgagctgtgattatgccactgcactgcagcctgtgtgacagaaaaacaaactccataatgccagaactcaaagagtttagactatctggagaacaagacatactttacacaggaggataataaagcctagagtttgtaatcacattgtaaagacctgcactgtccatatggtagccactagccacayaggactagttgagcatttgaaatgaactagtactacctgctaacataatattttggatttattaggttaaacaaaatatattgaaattaattttttttaattttaaaagcgtagctagtataaaatgtaaaattacatatatggctcacattatatttctattgctggtatagaccagggtttggccaggccaactgcctttatttttgtaattaaaatgttattggaacagagccactgtttccatactgtctatggttgttttgtgcaacaccggcagagttaagtatttgagacaaa

SEQ ID NO: 177002 - DNA, 601 bp, Human
taatcccagcactttgggaggccgaggcgggtggatcacgaggtcaggagatcgagatcatcctggctaacacggtgaaaccccgtctctactaaaaaacaaaaaattagccaggtgtggttgcggtcgcctgcagtcccagctactcaggaggctgaggcaggagaatggcgtaaacccgggaggcggagcttgcggtgagccgagatcgcgccactgcactccagcctgggagacagagcaagactttgtctcaaaaaaaaaaaaaataataataataataataaataaataaaataatatatatatatataaaagagaaacccagggaagccaacataaatacaagataggacttctataaaattattattatttttttaaaagctagctgagtgtggtggtgcatgtctgtgggaggttgaaacaggaggattgtttgagctcaggacttgcaggctgcagtaagctataatcacaccaccacactccagcttgggcaacagactgagatgctgtcttcaggaaaaaaaaaaaacctgaaggaataaaatttaatattaagactccaggattctacaacataccaccccatctcacc

SEQ ID NO: 177003 - DNA, 601 bp, Human
gcctagtctcatatcatgacttaattcccttgttcttgcctctccctgtccagtgagtcctgagcatttcctctctcctcctcatctcactgggttggtcaaaccagaagtgctccttctgattctctcttcatatattcatgccagtctttcatccttgcctcttatagccgcccggatggcgaccccagcctcggccccagacacacgggctctggtggcagactttgtaggttataagctgaggcagaagggttatgtctgtggagctggccccggggagggcccagcagctgacccrctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagt

SEQ ID NO: 177004 - DNA, 601 bp, Human
ccttcctctttgaggttaccccttaaccagaggagcagcctagcaaacctgccagggtaaaaggaacaactaactattgttcaagctggggctctcctaggggaaggaagagcattctgagctccctgtaggagcagaaatctaactatttccatctctgaccctcatctatccctggaccccctggtcacaggtaagtagctcttgatagccaagatattctctccagcacatggcagaaactagagttccataggctggctttggggctctaatgcccagtcttactagattttcaacrctctagcttcagcttttcttacctgggctactcaagtgtgtctacagatgaggaaaggggccaaggcctgcaggggacctggagagagggaagaggctgtgtcagggcaggctgtgcccaacctgaccagtcccaccttcctgcttctccctggctctgttcttcagcatccaccctcttccaaaacaaggtggaaagggtggtcagcttctctggtcccatccttcttgtttttcaaaccctattccctttttcctcaagaactagttctaacagcttcctggtgtcaactcaacctga

SEQ ID NO: 177005 - DNA, 601 bp, Human
cagagacacctacagacagagacttaaagaggagaaaaacagagggagggaggggagagagagagaggtcaagaccagatggtctagagcaagggtgagcttaggctgagcctagcagattcatggcactcacaggtctctatgtctgcagatgccaactttcctgttgccccaaaatgaattcgaatgaatttcccctggagagatggaagagagtggtgatgagttgggggaaggctcatatctgagaccattcctccaccagtccaagtcccaaggccaaggtcagggaccactcacraagcgggaggagttgtcgttccggacggtcttggcattgccaaaggcctccagagcagggttggcctggatgatctggtcctccagggtgccctgcagaggccaagaaggaggcaggtgagagctcttctccctccctttctgcggtacaggaccttggagggcagcaggcctaccttgcccgggctctggtccttcttgctgcggtccccaatggctgcaataacagcaaagtactggatgaccctcttggtgttgactgtcttccctgctccggattctccgctgtgaagacaggggc

SEQ ID NO: 177006 - DNA, 601 bp, Human
ttaaggtagtaggctcagctctgagtacagttatctactgactggaaccggttcaaggtggaggattttgtctgatgacagaaggacctttgtgaaagtctgggaatatggattctatcgatgctgtacacaccactccacgacccagatgcctgagatgctagggttgaaaataggtgcactcttatgatcccctacaccaccctcacacttcctgatccttggatgcataaaccaggcccaataaacatgcaggtgtgggaggtcatcatgcaggtgcccatcctccatgtgtccactytcaagcccctgggaaatcagctgtccctggtgccaccctgtcctgggtgctcagcacaacataggctctggaaccaagggctcggatccttcagccccttctatttttatattccccagaagggagaggggctgctattttgtctatggtgttcttgttgggtgtgcagggagaattcaggtggtaaggccaaagaggcaccttctcgatgaggtcaatgcaggcctgcaggtccatgccaaagtcaatgaatgtccactcgatgccctccttcttgtactcctcctgctccagcacaaa

SEQ ID NO: 177007 - DNA, 601 bp, Human
cggaagtccccgtagaggatgcggttggggaagcctttcctgcagatgcggatgccctccagcacaccattgcagcgcagctggtgcatgaccagggggttgtccatcacccctgtggcaagaaggaagtaggaggagtctgtgagaacactggactgaagttctgggttctgatcctggctttgtcactgattagcttgtaatcttagcaagtcagttagtaataatcatttgtttcattttcttctagccacatttttaactaaaaggctttcacattccttttttatatgattcacamctattatcataggtggtagccagaacagatatatccaatgttctagatgagtaaattaagcccagaggggttatgggactggcccaagttcactaagctgatcaagaacagagccaggtcttgaacccaggtccctgagcctctgtctcctaattagccaaaaatggattaacaatttgaatatgtctcattgggggattaagtggttctgcaggtaaatttaaagttgaactaagattctgtcttggacaaccagctatccaaggggttgtagggccactgatgaggtaatgtccatca

SEQ ID NO: 177008 - DNA, 601 bp, Human
ccactgggaggggtagcatacaggtaagagattttgctaagatgattacaacaggaaaagcatcagaggagtcaatggaaaagagatgtcttcctttaattaattagtctcctttcctcaccttggtgtggccaaacttgtactggttgtgatcaatgtccagggagctgagcagcttctctgcccccttcctgctatcaatgaactgtccctcagggatggccgctgggttcaggatgcgatacctgaggagggaagtgtccagagtcacccatgctctgcagtgatctgctctgcccayagaattccagggtcacctgcagatcccattcccatcagggcagcctggctccccctgttctatgagctctggtgcaccctcatacccacctctgccggaagtccccgtagaggatgcggttggggaagcctttcctgcagatgcggatgccctccagcacaccattgcagcgcagctggtgcatgaccagggggttgtccatcacccctgtggcaagaaggaagtaggaggagtctgtgagaacactggactgaagttctgggttctgatcctggctttgtcactgattagcttgtaatc

SEQ ID NO: 177009 - DNA, 601 bp, Human
ggtagagggaaggagaggcacatcactcaaataggagggtaactctaggatatccccacttggcaagagcttcagaagtatggggaggggaagagtttcaggatagtataacttgggaacactggggaggggagcagagaggaaaggaaccagaaatcttcatctggacctcttcctctggtctcctccatcgaagggtgggaattgcatttgctgatgccaagcacttatgtatgatggcttaatgaaatggacagctttattccctgtctagaggaaattgaggctcaaagatgatgcmtggtctgcccaaggtcacaaaataattaagctgtgtatctaggttgaacccaagtagaaagcctgtgcttttaaaagtcagctcttttccctctgccctttcctcctcctgagggacctctttggaggtctttagaagtgttgatcccagagtcctctgactgaaggaacaagacagtgagcccctgtgcagggaggtgcagggttgtgggaagtgaaggcagagcagggtggaagagccaacagtagcccaggagcctcaccgcctgcacttggagctgcaggtcattcttctcctgca

SEQ ID NO: 177010 - DNA, 601 bp, Human
gccagtgtcagctccagatcatcgatgtcccttttgagctctgagcactcatcttccagcttgcgcttcttggcagtgagctcagcattcatctcctcctcatcctccagcctctcgttcatctccttcaccttggcctccagctgaatcttgtttttgatcagctgatcacagcgctcctcagcatctgccaggttgtcttgttcctgaaggtgaggaacagaggggaggctgttcagggggtaaggtcctcattcttgcaggtagagggaaggagaggcacatcactcaaataggaggrtaactctaggatatccccacttggcaagagcttcagaagtatggggaggggaagagtttcaggatagtataacttgggaacactggggaggggagcagagaggaaaggaaccagaaatcttcatctggacctcttcctctggtctcctccatcgaagggtgggaattgcatttgctgatgccaagcacttatgtatgatggcttaatgaaatggacagctttattccctgtctagaggaaattgaggctcaaagatgatgcatggtctgcccaaggtcacaaaataattaagctgtgtat

SEQ ID NO: 177011 - DNA, 601 bp, Human
ccacaactctcaatctactcacatcatccacttgctgctccagcttgactttggccttagtcagggtgttgaccttgtcctcctcggcctgaaggtcatccagagcctgttggtgggcctcttgcagagctttcttctccttggtcagcttggcaatgatctcatccagcccagccatctcctctgtcaggtttttcacctgccgaccaagaatcccatctcctttagggtcaaaggtcaccagcttggtgccatctgtggggagctccatgtcaaggtccatgctgctctctggatgccragtggctagcctgggtcaaggtcagtatggtctgagagtcctgatgagacccgggctggagccaaagggagctgcccttaccttgttctctgttgcgtgtttctccttctccactttggccagtgtcagctccagatcatcgatgtcccttttgagctctgagcactcatcttccagcttgcgcttcttggcagtgagctcagcattcatctcctcctcatcctccagcctctcgttcatctccttcaccttggcctccagctgaatcttgtttttgatcagctgatcacagcgctcctc

SEQ ID NO: 177012 - DNA, 601 bp, Human
ctagaaagatatcagaaaagttaacatcctctaaccctacccccctctaaacataaacacaaacacacacacacacacacacacacacacacacacacacacacacacagagctctgggcacagatagacatggcatatctaggccccacaactctcaatctactcacatcatccacttgctgctccagcttgactttggccttagtcagggtgttgaccttgtcctcctcggcctgaaggtcatccagagcctgttggtgggcctcttgcagagctttcttctccttggtcagcttggcratgatctcatccagcccagccatctcctctgtcaggtttttcacctgccgaccaagaatcccatctcctttagggtcaaaggtcaccagcttggtgccatctgtggggagctccatgtcaaggtccatgctgctctctggatgccgagtggctagcctgggtcaaggtcagtatggtctgagagtcctgatgagacccgggctggagccaaagggagctgcccttaccttgttctctgttgcgtgtttctccttctccactttggccagtgtcagctccagatcatcgatgtcccttttg

SEQ ID NO: 177013 - DNA, 601 bp, Human
gttttgagaatcaaataggatcgtgtatttattcatttattcaacacattctgtgcctgggaaggtatgaagattcctgtgcaaacacaaacttgatgaggatgtagattatgatgattctcaaagcctttcaaagtcctgagcctgaaacaccataagaccttcaattatcaaaatatgttctgcaagctcactgtttaccaagtctggaaagtctatacattttggaagaacttacactaagaattggaaccacaagttaagcaaaacaaagaaatggccctgatcccctgacttcttkaatgtgagggcatttcttggtgccctgtgggctctctgtgaaaagccacaaagggactttcctaagaggctctcatgtggagccttcctccatgtcaaggaactggtctccaaagagagatgtgtatgaagggggaaggctgttattttcattcccactgagtgcctaacaagaagaaaggactcatgggatacaatggactttttgccagggaggaccatctaactaaccctgatatctgggactaggggaggaaagcccttgcctgggaggccttttcccatggtttgcgcctccact

SEQ ID NO: 177014 - DNA, 601 bp, Human
tggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggawccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaagggaagtgggaa

SEQ ID NO: 177015 - DNA, 601 bp, Human
ctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatrtgaagagagttcagtgactggtcattcattcactccacaaatcttcactgaatgcctactatgtgccaggctctgtcctaggctctggggatgggacagtgaacaaaacgacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaag

SEQ ID NO: 177016 - DNA, 601 bp, Human
catccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctcygccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggag

SEQ ID NO: 177017 - DNA, 601 bp, Human
atgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcatwctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgct

SEQ ID NO: 177018 - DNA, 601 bp, Human
tgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagggatagtgacatcctggattggaaaagaaacaaattctaattcagagtctgattctagaaaacacctcagaaagctagagtccacactgccctgggcaatgaaaaagttyttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctg

SEQ ID NO: 177019 - DNA, 601 bp, Human
aattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagrgatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctga

SEQ ID NO: 177020 - DNA, 601 bp, Human
tgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcrggatgaagtcccctgctctggacctcggcacatgctgggagtgactttggggctatgagtgtgatggaatttcctgggctgcaatgcaggccaggaaaacactgacttaatctaagttaaggacaaagtgtgcttagagggatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtga

SEQ ID NO: 177021 - DNA, 601 bp, Human
aggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccrtgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctg

SEQ ID NO: 177022 - DNA, 601 bp, Human
gaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagacyagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaa

SEQ ID NO: 177023 - DNA, 601 bp, Human
gagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgrgtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtgg

SEQ ID NO: 177024 - DNA, 601 bp, Human
aggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggygagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaaca

SEQ ID NO: 177025 - DNA, 601 bp, Human
cccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctktgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccaga

SEQ ID NO: 177026 - DNA, 601 bp, Human
ccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcaygggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattaggg

SEQ ID NO: 177027 - DNA, 601 bp, Human
gagcttctgggggcagagcagcttggtgaaggcccggcggaagctgtggtggcacagagggtagaggacagggttgacagccgagttggcccacaggagccagaaggaggtttcgtaccagtagtcagggacgcagtggccatggcaggcggcccggatgatcatcagcagcgtgtatggggcccagcagagcccaaagatgctcacgatgacggccagcgacttggccactttcctgtcccgagacagccgaaagcgctgggtgaagctctgggacaccatcttcatgcgcttctccagygaggccgaggacgccgacggcttggagcccctcttgagtgagcgcggcctctcagtgcccctcgaggagctgccggagctggaggtgggtgaagccacggagccgcccccaccgccacccccgagggtcgcctccccggcctcagcgcctacggccgcctcacccaccccatacctgtgcagcggcatggcctccccgtgccccttctgccagcagccccagcagccaggcggtgggggtggtgagggctgggcctcgggagggggctcggggccggctgcctctcgagccccatccagc

SEQ ID NO: 177028 - DNA, 601 bp, Human
cagcaatgctggccaggcaatctttcctgtcaaacttgaggggccctgaggagtcgcagagacagcagactagacaggagcgtgagaactgccaggcggaagtggcgtcggagccccaggcatccgcagcatagccagtatcgccccgagacccctgcacggagcgagaacatctgctgccaccgccctcccactgccctcccgagggggcagcaaccagagtagctaggcgctccttcctttaggcaccaacgcagctctggaagagacagtgacacacacggtgctgaaaccctactcyacagcgtggctctcagcaaggctgcgcgccgggaggactctcgcaggatgcgcctgacatctctccctgcctggtggcagcagaggagcccaagccttccatccagagttcccgagcctcaaggagggggcgtcgcgcccccgtcctcgcctggagactgaagaggctcgagcccagggtcaccaaggggcagaaaggctaagtggggacacaggccacacgcctaactgcagaactgagcaggggacagctgctgccactcacagccccaggtactgccctcagctctgcagaccccat

SEQ ID NO: 177029 - DNA, 601 bp, Human
gatcaatcgattacaggaagtaaccagagtatttgcaatttgccattctgatttacagaattaagttgtactgttcaaaagaaggtactctggtttgggatactggtagttttattgatactttttttttttgctttggttattattgaaacaaataacataatcaaaattcctcatcagtagatcaactgcaggaggccatgaagagatggggtaaatctctcacttttttagatagtagcattcggctccttgaaagcaccgctctcagcactgccacccaaacgtctgtgtgagctgytcctctgtcctcacacacaggaatcacgcacagtcaacactcctacagttgtttttcaagttgtctcttcatcaaacacacccgaccctaaaactgatcttaaaacagaagatggaagtgagtcccaggatcactcatgataaacacagcagagatgccctcttccaaccacgtattccttcacctcctcccagaagaaagagacagatgaggctttacctctgcagtggctcagagcaagaggacctggccagccccacaagacagagtccaatacctacccaaaggggtgcaacaggc

SEQ ID NO: 177030 - DNA, 601 bp, Human
acttgacacccacatgcagctttgagaaccctgcccacccctaatactcccggctcctcctcagtttgcaagactgagttgtaatgagaatgagttattaaccaagcaagagttatttttataagttacttccatctttgttctaaacatttttattacgaaatatttcaatgaaaacggaaccaactagaataatttaatattctctgatcaatcgattacaggaagtaaccagagtatttgcaatttgccattctgatttacagaattaagttgtactgttcaaaagaaggtactctgrtttgggatactggtagttttattgatactttttttttttgctttggttattattgaaacaaataacataatcaaaattcctcatcagtagatcaactgcaggaggccatgaagagatggggtaaatctctcacttttttagatagtagcattcggctccttgaaagcaccgctctcagcactgccacccaaacgtctgtgtgagctgctcctctgtcctcacacacaggaatcacgcacagtcaacactcctacagttgtttttcaagttgtctcttcatcaaacacacccgaccctaaa

SEQ ID NO: 177031 - DNA, 601 bp, Human
aaatcaaaagttttcactcaaaactttcatggtccaaccatggaaatattaagcaccccattttcgaacataacttgacagcacttattctacttcattattccacgcaagaattggaaagaacagctgtgtacgtgtttgcagctgacaccacaatgccatagcaaccgcaggcccacctggaagcagaagcgtccaggaagcccaggtgcacagcactcggcacagaagggcctgcagccaaaagccccctttatttaactgctttattgctatcaaaggcctgattaagtaaacgccmccatcacgctgcctgagccgggcaccacaggtgaacaccctaaacagcaactgtttcctggatgatcgagggcttggaggttcctactgagcaccatgaagaagaaaagcaaagcacttcgggaaccctgcaaattaccccaaatctcaggcaagcttctccagagccctgttacacctctgcttcaagatcctcaaacacagctgctaattatgctttgatcaactcacttacaaccaacaatttataaaagctttcttcaaatttatcccttaagtggaagaaaactcacattataca

SEQ ID NO: 177032 - DNA, 601 bp, Human
tgacattcgtaaccttctgcaaagctccaaagcaaggcaggcctgtgcgttctgggcatgctctgagcaccgtgcgtggctcctatgaacaccacggagaccacgctcctccgcagaagacacagaacttcctttaaaaactttcacaggtcattgtcccacacactttactgcaaagtcagaaaatgaaaggctgtgtcccccgaccccatggaacaaggtgcccaccttgccaccggcagcacctctgcccacagtgtctgcagcccccagtggaccagctgacccacaaagcctctgycccaggtgtgcttgggccacacccagcgcccagagaagggttcagctccctggctcctagtgtcctgccttgtccacgcactgtccactcagacctctgaccccaaccccgaaacaattcccttgggagccacagaccttcttactgcagggccctcattctaaaacctaatgtcaaatttgacagacagaaaaaactgtttctggggtttcctgactattcggaaatggtccctccaagatccatgtaccccaacaccaccctacctggctacgctcctctcacaactttgagatcaag

SEQ ID NO: 177033 - DNA, 601 bp, Human
aaaaagccaatcgagcctgcttcccgtgtcacccttgttcctgtcatgatgcttctgacactgacattcgtaaccttctgcaaagctccaaagcaaggcaggcctgtgcgttctgggcatgctctgagcaccgtgcgtggctcctatgaacaccacggagaccacgctcctccgcagaagacacagaacttcctttaaaaactttcacaggtcattgtcccacacactttactgcaaagtcagaaaatgaaaggctgtgtcccccgaccccatggaacaaggtgcccaccttgccaccggyagcacctctgcccacagtgtctgcagcccccagtggaccagctgacccacaaagcctctgccccaggtgtgcttgggccacacccagcgcccagagaagggttcagctccctggctcctagtgtcctgccttgtccacgcactgtccactcagacctctgaccccaaccccgaaacaattcccttgggagccacagaccttcttactgcagggccctcattctaaaacctaatgtcaaatttgacagacagaaaaaactgtttctggggtttcctgactattcggaaatggtccctccaa

SEQ ID NO: 177034 - DNA, 601 bp, Human
ctcacccaagggtgctaatcacaatcagacattcctgctgatctgtttgcctgttaactgcctggcccccacaacggacacaccatgaaagcaggggctgtcagcctgggaccccccacagctgaaccctggtaccctcatcagccttcccccgtggcccagtacacaccctcggaatgtgctcatgcaggccaggcgcagtggctcacacctgtaatcccagcactctgggaggcagaggcaggcggagcacttgaggtcaggagttcgagaccaacctggccaacaaggtgaaaccccrtcactactaaaaatacaacaattagctgggtgtggtggtacatgcctgtattcccagctgctcgggaggctgaggcatgagaatcacctgatcccgggaggcggaggttgcagtaagctgagattgcgccactgcactccagcctgggtgatggagtgagactctgtctcgaaaaaaaagaaaaaaacaagaacgcgcttatacaaataggcacagttggcgagaataaatagccaacatccgcatgaacgaggtctaatttcactcaaagaaatgcaacttaaaactagacacgatttt

SEQ ID NO: 177035 - DNA, 601 bp, Human
cagcccatccacacctccctaagccccaccatctgccccaggcccctgccacaaccacccccacattccacagctcagacgcaaaagtgacctcaacatacaactttaaattatgccctatccagcttcaaaccctcaatggcttccagccactgaggcacttggaatcaattcacactgcctgcgggcagtcctgcaatacaatcgattcacgctgcctgcgggcagtcctgcaagacaatagactcacgctgcctgcgggcagtcctgcaagacaatagattcacgctgcctgcgggcrgtcctgcaagacgatcgattcacgctgcctgcgggcggtcctgcaagacgatcgattcatgctgcctgcgggcagtcctgcaatacgatcgattcacactgcctgcgggcagtcctgcaagacaatcaattcacactgtgcagtcctgtgatataatcaattcacactgtgtgcaggcagccctgcaatacaatcaactcacactgcctgggggcagccctgcaataaaatcaattcacactgcctggaggcagccctgcaatataaccaattcacactacttgggggcagccctgtgat

SEQ ID NO: 177036 - DNA, 601 bp, Human
acagccaccagctggggggagcccaagcactggagggcccacaggacccagtaggatcgtcgggtgaggccacgcgccacacagacccaccccagtgcaacagcccctcaccatgcactcaggatattcccttctgtggattttctctttgaaagcccctgtgctttagtggttttaagttgtaagtttgctccaagctgaaccatttccagtctctctcagcagcacaagcatgaaggaggcggcctgaaggagtgacaggtgccctgtggcatgcagcctccattaaggggccacgggrttttggagaagctggtcacctctgtgagcctcagcgtctctgtggaaggggactctcttccaggactttctggctctagagatctacagatctgtgaatttgtgcacgccaacatgcggcaggaaggcgaggactgcacacacaagagcaaagcggcctccatcacagccatgctacctctgccatcgctgcgctggaggccaggagagacgccaaccttgcaacaaatgctactccaccacataaggctctcagcaacggccacgccatgtccttccaccccaagagctgacagctctt

SEQ ID NO: 177037 - DNA, 601 bp, Human
gtactctggagaagggagccacgagcgacgtttatgctgagaagcggcatccgtgcacctcacctccgcccgtccacgccgacctgcagcactccccaagcaactccgccagcaagctgccagatccacaaggtctcacctgagctactgccgagtgaacgtttgttgaccaaccaaccaaactcatccccctggcccaccaaggccaagcacggtctgaggcctgctggctgtccacccgtatcccaccctgcccccaggcacaagccgaaccacccagcactctgtgcagacagacacrgacaatgaccaagtcttctcggctgaaactagggagaggcctgcatcacttctgagcaagggccttaagaccaggagtgcctcttggccacttgaagcccttgcagccgcaggactgcagggactgacggagatgagcctccccaggcagatgaggtggcccagacctagcagacagccaccagctggggggagcccaagcactggagggcccacaggacccagtaggatcgtcgggtgaggccacgcgccacacagacccaccccagtgcaacagcccctcaccatgcactcaggatat

SEQ ID NO: 177038 - DNA, 601 bp, Human
ctgcgtctggcccacagagcacccgaaagtggaagagggtggccctatcacctgtccagaatcacagcctccaagacgcccagtccgtgctttcccaactctcagagctctgcgtctaatcgatggtggggcgaagggagagccacggcggccctgagtgcaagcaccatcctgaaaccaggagcccatgaggccgcgggagccggaggaccaggaccgccctcgcactgccctgtgacgagctcccggcccagctctctgccgctctggatccgtcactaagcagctccattaagtgccyggtcaggcaggagcggcagggaaacactggggcacccacatctgaacagagaagatgcccaccttgagaaggtactctggagaagggagccacgagcgacgtttatgctgagaagcggcatccgtgcacctcacctccgcccgtccacgccgacctgcagcactccccaagcaactccgccagcaagctgccagatccacaaggtctcacctgagctactgccgagtgaacgtttgttgaccaaccaaccaaactcatccccctggcccaccaaggccaagcacggtctgaggcctgctg

SEQ ID NO: 177039 - DNA, 601 bp, Human
cctccaaggcactgaggagatgccatccccaagcccagccttcgggcccaggcagagctgcgtctggcccacagagcacccgaaagtggaagagggtggccctatcacctgtccagaatcacagcctccaagacgcccagtccgtgctttcccaactctcagagctctgcgtctaatcgatggtggggcgaagggagagccacggcggccctgagtgcaagcaccatcctgaaaccaggagcccatgaggccgcgggagccggaggaccaggaccgccctcgcactgccctgtgacgagckcccggcccagctctctgccgctctggatccgtcactaagcagctccattaagtgcccggtcaggcaggagcggcagggaaacactggggcacccacatctgaacagagaagatgcccaccttgagaaggtactctggagaagggagccacgagcgacgtttatgctgagaagcggcatccgtgcacctcacctccgcccgtccacgccgacctgcagcactccccaagcaactccgccagcaagctgccagatccacaaggtctcacctgagctactgccgagtgaacgtttgttgacca

SEQ ID NO: 177040 - DNA, 601 bp, Human
gtggcagcccttcccacacaggaactctggtggcacgcccacaacctccaaggcactgaggagatgccatccccaagcccagccttcgggcccaggcagagctgcgtctggcccacagagcacccgaaagtggaagagggtggccctatcacctgtccagaatcacagcctccaagacgcccagtccgtgctttcccaactctcagagctctgcgtctaatcgatggtggggcgaagggagagccacggcggccctgagtgcaagcaccatcctgaaaccaggagcccatgaggccgcgggagccggaggaccaggaccgccctcgcactgccctgtgacgagctcccggcccagctctctgccgctctggatccgtcactaagcagctccattaagtgcccggtcaggcaggagcggcagggaaacactggggcacccacatctgaacagagaagatgcccaccttgagaaggtactctggagaagggagccacgagcgacgtttatgctgagaagcggcatccgtgcacctcacctccgcccgtccacgccgacctgcagcactccccaagcaactccgccagcaagctgccagatcca

SEQ ID NO: 177041 - DNA, 601 bp, Human
gcgtcccgggtagcagggatgcagtgatgacaaacagatccacccgtgaggaacctgcacccacaggacatgctccattctggatatctgccaccccttcctggacaaaccaaggttgccgcctcccaccaggctctagggcctgcagacacacgaccaaacccctgcagggccatgtcacctccacaaccacaaggaagagagatgacaggaaggccaccttccccttctgcgtcctgcaccgtggactccctgcatccccgcagcacagcatggccaccgagcaccgcagacgtgcccrggccaaccagctccaagtggggtgcagtagcggggtgcaggctaaatgacagtggcctggatgaagtggctgacatgaagcatgtcaaaggctcaacctccccctcccgccccacccatcctcatccagcctaactcccaccgacccgaagcacgaatccaaatggggcgcactttgtttccgctattgagcatggctccaagatctctccttaaaatacaaacaggaaaaaacaaagaaactgtcctttgaccccctcaccacagtcagtgacctacttctccatctcctcctgaacct

SEQ ID NO: 177042 - DNA, 601 bp, Human
tcagtccccacagtccctcctctgaggggcctggcccctgccatggcaccacttcagaacctcatggcaggtggcctgtggccctcaacgctgcccctgccaagcctcctgcagccatcactggccaggccatcaatacctcaggggcgtcccgggtagcagggatgcagtgatgacaaacagatccacccgtgaggaacctgcacccacaggacatgctccattctggatatctgccaccccttcctggacaaaccaaggttgccgcctcccaccaggctctagggcctgcagacacacraccaaacccctgcagggccatgtcacctccacaaccacaaggaagagagatgacaggaaggccaccttccccttctgcgtcctgcaccgtggactccctgcatccccgcagcacagcatggccaccgagcaccgcagacgtgcccgggccaaccagctccaagtggggtgcagtagcggggtgcaggctaaatgacagtggcctggatgaagtggctgacatgaagcatgtcaaaggctcaacctccccctcccgccccacccatcctcatccagcctaactcccaccgacccgaagcac

SEQ ID NO: 177043 - DNA, 601 bp, Human
tcaggcagggagccacccagcaatgctccctccccacagggccctgggactgccctccccaggctgcacgtgcagagggaacttcgtcatctcggccctgcagcatgagtcccatccaccgttcactcccacccctctcaccgccataggacacagggctgggcctgtcccagacctgttttcccaccaccaagagccctgatccacagaggccaccctccctccccatccgctcggtgacccccacagccatcaagacagtccctcagtccccacagtccctcctctgaggggcctggcycctgccatggcaccacttcagaacctcatggcaggtggcctgtggccctcaacgctgcccctgccaagcctcctgcagccatcactggccaggccatcaatacctcaggggcgtcccgggtagcagggatgcagtgatgacaaacagatccacccgtgaggaacctgcacccacaggacatgctccattctggatatctgccaccccttcctggacaaaccaaggttgccgcctcccaccaggctctagggcctgcagacacacgaccaaacccctgcagggccatgtcacctccacaac

SEQ ID NO: 177044 - DNA, 601 bp, Human
tgaagtcaacagcacactctcgaaaagttacaaggaggttcagaaagggaggaaatcaccatggaaatcacgtccaaaatgaacctcagcccatggcccccagtgtcaagtggaaggcagggtgcagggcagccccgcaggcgctggggctgaggagcaagaagggaccaagtcccctgtgggaccggcagccttgggagggttccagcgaggccccggcctgcgccccagccagtcacagaggccccttcctgcccactggccagacacccagggtgctcagctcttgacgtgggacacygggggttctgggcccactgtgcctgaagcaatcacagggcgtcaccgcccggcctggctactctcaggcctcctctcacacgatactcctgtcaggcagggagccacccagcaatgctccctccccacagggccctgggactgccctccccaggctgcacgtgcagagggaacttcgtcatctcggccctgcagcatgagtcccatccaccgttcactcccacccctctcaccgccataggacacagggctgggcctgtcccagacctgttttcccaccaccaagagccctgatccacag

SEQ ID NO: 177045 - DNA, 601 bp, Human
accccaggcagggcccctcccacagagcagctcagagctgggaagaaaacattttcacccctcacaggggaagcatctgaagtcaacagcacactctcgaaaagttacaaggaggttcagaaagggaggaaatcaccatggaaatcacgtccaaaatgaacctcagcccatggcccccagtgtcaagtggaaggcagggtgcagggcagccccgcaggcgctggggctgaggagcaagaagggaccaagtcccctgtgggaccggcagccttgggagggttccagcgaggccccggcctgygccccagccagtcacagaggccccttcctgcccactggccagacacccagggtgctcagctcttgacgtgggacaccgggggttctgggcccactgtgcctgaagcaatcacagggcgtcaccgcccggcctggctactctcaggcctcctctcacacgatactcctgtcaggcagggagccacccagcaatgctccctccccacagggccctgggactgccctccccaggctgcacgtgcagagggaacttcgtcatctcggccctgcagcatgagtcccatccaccgttcactcccac

SEQ ID NO: 177046 - DNA, 601 bp, Human
gaccccaggcagggcccctcccacagagcagctcagagctgggaagaaaacattttcacccctcacaggggaagcatctgaagtcaacagcacactctcgaaaagttacaaggaggttcagaaagggaggaaatcaccatggaaatcacgtccaaaatgaacctcagcccatggcccccagtgtcaagtggaaggcagggtgcagggcagccccgcaggcgctggggctgaggagcaagaagggaccaagtcccctgtgggaccggcagccttgggagggttccagcgaggccccggcctrcgccccagccagtcacagaggccccttcctgcccactggccagacacccagggtgctcagctcttgacgtgggacaccgggggttctgggcccactgtgcctgaagcaatcacagggcgtcaccgcccggcctggctactctcaggcctcctctcacacgatactcctgtcaggcagggagccacccagcaatgctccctccccacagggccctgggactgccctccccaggctgcacgtgcagagggaacttcgtcatctcggccctgcagcatgagtcccatccaccgttcactccca

SEQ ID NO: 177047 - DNA, 601 bp, Human
ctgtcacacgctggagttgtaagtactcacggaggacacctgacaaactgtttttctacaaccttccatgaagatgaggccacaacagtcaaaacaggtaacacccagagcccccagaggacactgcagaccagaaggttctgcacagcagcgaccagggcacagcagcagaaggaagggctcctcccccacatgacctatcctcggcctctcatcatcctcccctccggggtcccggcctggctctgctccccatggaccactccatgtcccatcactcaccgctcccttctcctgccaktctggacctgggcacagcaagagtctcctcctggcacctctgccccataggaggcaacttctgacgactcttcccaaaacgccacaatgcctgcttgtgcttgtacatggagattccagacaggtgcccccacccgctgagagcagcccggggtgctggcagcacagtctcctctctcccccacccctccccagcaagacccaccaaaacaagagtaaaggaatttaaatggtcaaagccccaataaaaagagaagagaaggacaagagagttcaataaacccagtgcaggctccatgag

SEQ ID NO: 177048 - DNA, 601 bp, Human
ccccacggagcagcctgtccccaaggcagggagtcagcctcacccgctcaccccatcttcacccaacgcctactgtcacacgctggagttgtaagtactcacggaggacacctgacaaactgtttttctacaaccttccatgaagatgaggccacaacagtcaaaacaggtaacacccagagcccccagaggacactgcagaccagaaggttctgcacagcagcgaccagggcacagcagcagaaggaagggctcctcccccacatgacctatcctcggcctctcatcatcctcccctccrgggtcccggcctggctctgctccccatggaccactccatgtcccatcactcaccgctcccttctcctgccagtctggacctgggcacagcaagagtctcctcctggcacctctgccccataggaggcaacttctgacgactcttcccaaaacgccacaatgcctgcttgtgcttgtacatggagattccagacaggtgcccccacccgctgagagcagcccggggtgctggcagcacagtctcctctctcccccacccctccccagcaagacccaccaaaacaagagtaaaggaatttaa

SEQ ID NO: 177049 - DNA, 601 bp, Human
aacccaacctgtcacggagcacacagcagccccacggagcagcctgtccccaaggcagggagtcagcctcacccgctcaccccatcttcacccaacgcctactgtcacacgctggagttgtaagtactcacggaggacacctgacaaactgtttttctacaaccttccatgaagatgaggccacaacagtcaaaacaggtaacacccagagcccccagaggacactgcagaccagaaggttctgcacagcagcgaccagggcacagcagcagaaggaagggctcctcccccacatgacctrtcctcggcctctcatcatcctcccctccggggtcccggcctggctctgctccccatggaccactccatgtcccatcactcaccgctcccttctcctgccagtctggacctgggcacagcaagagtctcctcctggcacctctgccccataggaggcaacttctgacgactcttcccaaaacgccacaatgcctgcttgtgcttgtacatggagattccagacaggtgcccccacccgctgagagcagcccggggtgctggcagcacagtctcctctctcccccacccctccccagcaaga
